United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 39

SEQ ID NO: 562 - DNA, 170456 bp, Homo sapiens
tacccgcccccaccccctccagcatctcgggccagacagagaaaaccttgttcaagtttgcagcaagtactttcccggtgcgcaaaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctgggtaagagttgggcaaactcaactccggcggctcctggaccttggccggacgccggaaggcttctcatgggcgggggtcacattttccttagccagggtaccggggtgcggcgtgaggtggggcgagatgggctcagtctgcgttgttcatgcgcttcttaagggtttattgttgtttgcatttggttttgttacatgggattgtgtaggaaaatcctggagtatttttgatggagagacatcctcattacgcattttattttgcataattcctgcccttgtattgccttaccttgtgtttgtttcattttgccgggcgatatagctggatgtagggagatttgtggggaatcggactgagcttgaaaggcagtttcagctgggccctttcttctaggtcagttgaacttcctttctgggatcttcactgttttctaaacttctctttctcccgtccttggtattcagattgtgcagataacgctctaggctggcgggatgctcccctttcctgagttctcagcgatcagtaggggtgtgaggtcgcagtcttagaccaaaggggccttgtcagtatgcttggctccttaaggagtgctgggagggacggtttttcaagtgatagttacttaagaaagataaatccggtgttgatctttttcttttaaattccttgttagaggacttttacgcctggtttaaggaagtgttttggccttaattttctttctggaagtatttttcttagtgacaccactgagcaaatgaatgatggcaatatctttgctgcttctttagaaaatatcctcacgcaaggacccacattatttaggagaaagtcaaagttggagatcttattagccaaaattagccattattattgttcttaggctgtgataaccatgctgtgccaaggcagaagagaatgacatttcttcttgttcttcttgccttactcctttatatcctgggtctcactttgtgtatagggttcccaaataaaaatgcttcattccttatggacagaaatactggggccaatttatattatccagaaatgtcatcttcctgacacgagtgctccaagaggtcagcttgcagggaacttttaattttaccactgagagttcaaagagttcagttggtaaactctgggcacccgccagcctgggttcagctcacaactctgccacttttcagttctgtgattttggggtaagttacttaatctgtttatccacatatgtaaaatcaaaatgataataatagcacttacatcagacaattgttaaagggattaagtaagttaatgcatgtgaaggactaacaagcctgacacatagtaggcacaaattagctttattattattgtatagctagcattaactattgttgtatccctctagtatagcttctattagctgtcagtaagtgttagctattattcctatttggatggactttgaagactgtgctcatctgtaagcttcactaccacctattgtcaaacttagctcagacatgatctttgtattgcttttttgttgtggcactttcagttggaaaaataaaggtgtatatggcagagctggaatttatagggtggtgggtcatggatgggcaccaaagactacttggaacaggtgaggaggtgggaaatctacactcagttcacagcctgtatacctccttggaaatcctttacattaatatactttctttaacctattttttagaggtcactcatttgttcagtaagtatttattaaccatctattacatgtcaagcactgttttaggttttatattttaaaaatggctatgcatgagtattggctttatgtgcctcctcccatttcaagtgtgtgacctagcactctataaattaaatcccaagtatttttagctacacaatttccatacctgttaaaatgctcataagagcacataaaaagcacgtatcattgagaaattgaacaaaatattccctatgacctcaagcagattgcttttctccatttaggcatcagttttattatgtataaacttgtgttgagaggtggggaaagagtagaataacctccagtgttccttctggctccaaaatccttaaattagctgccttacttcattggtggctgtttttgaacccccacttttctcttttaacatttgttttaggtacataaattacgttacttccatctttgcatattcatcaaagtgagtaacaacatcgataattaatgaaaagggaaaagcgtttatctctgtctgtctttcactattctcagactttggtttataccagaagcatgaagtggggagatttgttaaaatattagagtgaactatgagaaattgctgatatttgaccatttttgacctaaataaatggcaattttgtatggttcaaactatacaaaccctaatcccttctgccttgatttagaagtagtaagtcttctgtgagttgtgagaagtctgcatttttacaagttccccaggtgattctaatgcaaaactcaagtcacatgctcatttagcagcagtgaatttaccttctttgtgattgtctgcttggtttaatagtgtatttctaaaatgcaaatctgatcatgttattcccttgtttaaaaatctttggcagctctctggatggtgaatgtcagtgttacctgggtgcatgttgaaaatatagattccagggcttcaccccagaagtaagggccagtaatctgcattttgagatctccaggtgaacctggtaaagctgacgtcagatcacatttggagaaacactggcttacagcataaagtctcacctccttaccgctatacacaagaccacctttgcagcacttctcagggttattttctgcttctctggtccccagctctccagctcccactgatcttgatcttgttactatctcaagaatacgctgtgcactttcactcttccatgacccagctgtatatgctgttccttcctctgaaaatgtctttgaccctctttcctgtctaaccaaccacttaccacccattcatcttttaagacactattcaaatccctttgaagactttccctctgaagtttttcccaattatctcataaacttagcgatatctcatgcgagttcccattcttgtggatagatttaatatagcataatcacattgtatcagccatatttattatctgaatgtttatccctaacagattggtgagttcatcattccttattgtaagctcttatacaagtggctggcccatagtagttatggaataaatgcctagagaatgttggagaaaagtaaatggatgaatgatagtcaacattttcttagcagacaaagtggttgggacagtattgtatacatatggagggtgtggaaaagccagttgggaatttccagtttggctagacatagcctaggaagttaataacttcaagtggggctgggcatggtgcctcacgcctgtaatcccagcactttgtgaggctgaggtgggaagatcacttgaggccagggatcctagaccagcctggccaaaatggcgaaatcctgtctctactaaaaataccagaattagccgtgagtggtagcacacacctgtaatcccaactacttgggaggctgaggcacaagaatcacttgaacttgggaggcagaggttgcagtgagctgagatcgcgacactgcactccagcctgggtgacagagtgagactctgtctcaaataataataataataataataataataataataataaataacttggagtagaaaaaggacaagacagaatatcctaagaggacttatgaaacaccaaatgccactgaattaatgttacatgttgaacattattgcaggcagtataatgaagagctgagcttatcctttaggatggttttggtttggtttttggaatgacgtgtcagagcactggaaaggaagtgccaatgccaataaaaaccaactttgctctgtgcttttccatttataaaacacttctgcttctgtttttgtatttgatcagaaacatggtgactggttcaatactgtctttccttctttcctgaaaggacacattcctgaaaataggtctgaagattgtataaaagcctacatattataggggattctggccatagaaagccaaatatattatgaaatctctaattatatcttgctatttagacacagcattcagtgtatactccattttctaatttttctttctttaaactttacacaattttggttattttctcctcatttcaataacagttgaccagctcaagttcaataaatgtctgattcagatgaaaagatttgccatttttggcatgtctaataacttctacctttgtcttacttagtttatgagacaaacacttctcataattactattaggcttttaattttcccatttcccattcacttttttgtaataatgaaaatatgcagtaacatttgaataagtgaatgaataattctctgggtaatgacaaggatggtgattctgcaaaaattgaactattggcttagggcagctgcaccataaaataaacaacataaaaagttcattcattagctggcatctgagtgtcatcatgacacagggcagggaggtagtagcatcaatagatgtagtacaaatatccacattgatggacttcaaacgaagcaatattgaggactgcctttactctcagtttctcaagggtgtgtacccagtatctggttttaataattagtttagttttaagaattaatacaagattcactgggttctgttgatttgtcttcttttaaaattatgtttctgaaatgaactttttctagcttagcataagcctgtatcattttctgccaacctttggaagtcttttaactgctctcctaatctctttattcagtcattcattcattcttcatatctgaatgtcctgaaatttttaatttaccttttgtctctctttaccattttgcattattgttcaccatgatcattctaactctttttaaatatagttattgcagaggactaatttagagcatttagtaaaaggatttctcatactatgagggaaaaagaaggtacaaaccaatgttattttactttatagaactttatttgtggaatggcaagtcactgtgtggatgttatttgataatgcaaactctgtggcattagccaatctggaaagtgtgaatgtgataatacatcctgttattatggttgttcatttctagtgatttcctctcttatttcatttctagtgatttatactcctagataaagaaactatgtaaagcatttaagcacctcaatttcctacttagagggcaataaattgtaccccttcccacttctaagacaaagaaaacagtatttcagtatggaaaacctcatcttgataggtacatgtgcaggatattagcatctgttaaaaacatcttatctttgggaacatcctagaggatgactaagtgccttgtcattaatgtctcatctgacccagatgagctgtacagatttggctgtttctcaacatagccacaggtggtggttcccaagatggatcttttgaataccttctgctgaagaattttggctttcttaaaaaataatttttgatggcaaattgaaaactaaaacacacaaatttaacttgttcctcacagagtgaaatagaactatgaaatttttgcttggtggcacagaagactaatcctacaatcaaaacaaaaaaatttaaatatccacccctattgacatcttgagaaaagtacttgagtttggatgaagaattgataaaaaatatgtgacttggttctttaaaaaagtaataggttggagagttactttttgttccaccagttttttttgttttgttttgttttgttttttgaagtggagtttcattcttgttgcccaggctggagtgcaatggcgcaatctcaactcactgcaacctccgcctctggggttcaagtgatcctcctgcctcagcatcccgagtagctgggattacaggcatgtgtcaacatatctgactaatttttgtatttttagtagagacgaggttttgccatattggccaggctggtctcgaactcctgacctcaagtgatctgcctgcctcagcctctcaaagtactggaattacaggcatgagccactgcacctggctgtttatcagatatttattagctgtgtagggcataggggaaaataccatgtgtaattaccaagaagctcttgccttcgaggaaaaaacagactaaaaaagtacacattgcatgcccatataaaatatctcatgtaacccataaatatatacatctactatgtaccctcaacaattaaaaaaaaaacaacaactgagcaggtaagcctgggtatagtaagagccaagtggcagttttgagagctgccacaagagctcactggaggcttcctggcagtgtgggaccttgaaggagagatttgaatggatggggcatcttaggtgggggaatgggctcagcaaacatgtggtggcaggaatttacaaagcatcttcaagcaatagtgattaaaccattccatagtagtggtgagtttacatttgagaataattttataataggcacttacaggacctgcccatccccatagtactatctgcgttaaaggaacccttcacattacactgcagttattttatagaaactagatgggattagggggacctattgagattcaagtaaaaattggctagaaatcttcctccctattccatgagaaggtgtaaaatgagaaaactgttcttcctttcaaccactatgggattcttggggctagagacggagacagggctcatgtttcttctagtgtcacctggatctgaattcatattttcccttaagaagtttaaaatgatccgaagccactcacccagccacgaataaccttcacttcataaaatgccaccaaatgtgtggcttgagtgtttagaattttaaggtttgggactatggaaagagttcatatcttaacacttagaactaaatgttaaacatccttgctttctaacagttcatcctaccattgccactttctcaccgcccatctttttctgaaggctaccacctccaccaggtggcttcagcgctgtcctgctgtccctgcactcctcctctcttgctcactgatgacccacacccacattcctattatcatctgaagccctcatcgttctcacctgtcttcgtctcaggtgtttttcccccaacactaagatttgataaccacagtataaagtatttgtccttccagtatcctccctgctttcagctggttccttaaacagatgtgcaaaatcagaccatgagtgaggttagaaatgcttgaggcatgtttaccctgtgctctgacttcagaggcacgagaatcacctgcagatactggctcctccctagattttgattcggtaggtgcgtagtggggtcccaggatgtgtatttttaacaaggtgtgctgatgcaggtggcccatatatgcatgataatccttgttggacttatagtgccccattcaaaaggcatgccttttttgtgtgtttttaaattttagtgacttggccagagggggtcacagagaatagctggtctgtgagaacccatgcctctcctctctacttgaagggacaatggctgtaacacaacgctgttcatgtgacagccggagtaaaggacccattgttcaggggttggctgatgtgccattctgctgcggccagccgtccaactgagcttggtagccccaaggaaacagacacacttaaatcagagagacaaagaaaggaggtcaaggccttccacagttaaactacttgcagcaatgtgtcagaggtaggatctgggaaggaaaaaagtaattccaaggaagcatcattaatcctctggttttggagctgcagacatggcgttgggggaacacaagtctgtcaaaaagccagtggatctttggccaaggaagaattattttctactgcgtcacactgattgcaggacttatctgattgcaggattttattactgatttaaaaaataaaaaagcctccctgtgtccccaggctcatcaaaggtacctgatctgaaagcctgcctaaatcaaggtctatgacttcagagaacaattctgtgttcctgggaatggtcactgtgtatatattaataattcccttccagatctagatagctgttttgaagctaagaattttttgagtctgaaatacaatgagtgccattagaaagttattgataagtttggacagttatgaggctgggggactctccagatgccatctagataccctccctcacccctaactttcaaactggattctagccctggagggaaagggttgcaaacttcctgtaaaaatctaatcctgagcccaacaattgcttacattctttgtgtcagaagaagattcaaattcaaggtcacagcctttgcaaaggtcacagactttttccacaggattgttcttttagcctgattactccctttatgaaaaagtatgtcattcattcagcctttgcctctgggtttctttcaaagggagacttagttcctagttcctgtggatacttgtaggtggcttttcttttctttcctttttgtttttttttttttaagttaggcacagaatacagacttgaatgaggcagaacagggaaagccttttctggacgtgatgggttctggagagcccatttacaccaagtgttaggcagctggtgttccctggccagtaggaatccttttgtctctgagataagaggtttgtgtccaggagagggcaatatgtgatttgcttgaggtcacttagagctcctagtaattatgtctgtcattgtaccttgattatagattatcattgcaaatccattaaagaaggagaagcaagcggatttcagagaggcaagtagctttattttcttcattatgttttcattccccccctctgttacagtttgtttcttctttactaaatggttttgccaatgatatagatgactttgaagtggagaatgggaagaggagacttcgtgggtggcgaaaggactgtgctaaacactctcctgattagttcattaattttcaatttgttgccattaggcctgttcatttggctccccatttgtgtgatatagagaggcttgccctcaatgcttccaggcccgaatactgtgctatccttgaagttctgtgtaggtacagcactttttttaaaaataggaaagttaaatggtcccttttactgttgttgtttgtgtcccaagtagtatatataatactaaatgcttttgtaggcataggatgcttaatgggacttagttttgtgtcagaataagggtcctgcccaacaagggcttctgggatgctgacattacatttaatctaagcactggttgttatgggtatgttcagtttgtgaaaacttattgacctgttcagttttgatttatggctttttttctgtctgcattttacacttcaataaaaaattcaaaaattaaagccccatgtttaatgtagaattaaggatctatcatgatgggaaactggaaactctcacataatttgaatcctggtgcagctgggagggcctagagctttaaatacccatcaattcacccttacttctacagtcagagagctgtgtgtcagaatgcaatgcattagcaccatcataggtgattgctttacttctctaggcagcaactccaatgcctaagagatcaatagtgttagcagagccccactctttagaatctaaaacaaatgcacctctctaagttggccaagcagcaaatcttttcattcccactttccaccctcctttcactcattttagtctgtcaggagaaatcagaagaagactctatggattatggatgttttcctgaatctttggatgacatctctcttatggtctaatagtggaatgctttgtttccctccgatttctctaactgggatgagttgatatgaggggtgaagtctttggcttatctccgtcactcatttccactgacacttcctgagctcctcagtgagccacaggagcaatacctgcaaacccatgcttccagtcccagaacaacctgtcgtcctttttctcttgagaagacccttgtcctccatcagtgtggcgctgcatatattatactaaagtgagccatgagtcattgtactgatagaacattccagcttgcttttataatatggagttggtagactgaaatggagaaaataggagcattttttttttctccaaaagagagtttggggcccttcgctttgaaatgggtgcagcacatctatgagaggtctgagtactaaatgtgtacccttcattttggccattggacttacaggttggatgttgatttacacaaacacatgtgattaaagttgtgggttaacagacaagattctgatgttctgggtctattgctgaccttgtcatttactgtatgaggtatgacaaactgggctggaatcccttctctaccactgacatcttggtgactttgggcaggctactcaagctctctaaagcctcttttcatcaaatgtgaaaagataatagcatatacttcaaagattgttgcatttagcatagtggtaggcacatagtaaatgctcaatatatattagttattattatttaacaccaagtaatgttaaaatagggaagaataattaacacatctaggaatcaggtctgcttctcatgaaagaatcgttcaaatgcttaaataagattctattaattaaatgcagacgttagaaaatgtagtctctgatagaaggcataaactataaggaatttacaatattttggaatacaaaacagttaaatttacttataagcataaatgtcttttaagatagtatgttactaaacaaaaaattatttatcttaactatagaattaggatgaggctgctagtgaatgaatttgtttttccttagtaagatgtcaacagaattgaaaacaggtgttcaaacaatgtcttgtgtacaaatgctcctagcagcattatttacaacagccaaaactattatttttggtggaaacaacccaaatgtctatcaactgataaagggataaacaaaatgtgatatatttacagaatggaatattatttagtcatggaaagaaatgaagtatgtatgatacatgctacaacatggatgaaccttagcaatattatgctaagtgaaaaaagctagacacaaaagaccacatattgtgtggtttcacttatataaaatatctagaagaggcaactcaacagagacagaaagtagattagtgatttccagggtctgggggaagggaaaaattaggagtgactgtttgatgggcatggctttttcttttaggacaatggaaatattccagaactagatagtgatgatggttgcacaacagggttaaaatgatgaatgtttggttatgcaaattttttaaaggttaaaaaagttatctcaaaaaaatcagcagatgtttgcatttaggtgagatgtgtctgcatagatcagttgacccctggtcacgtgtgtgctatgaggcaagcctttgttgcatactgaggagaatgccaaaaatggcaagatgcagccttcagcgccttgccagtctgtttatgaggaaaggaaaggaggaggaagcaggtaatctgttccaagtgaatccgtctcagaaggagagatcatcggatttggtgaccagagaaggcttcttggaagagatgggacattgaaagatttgtgagctttgtgtaatcacagaagaggagagagtaccccaatggcagaaatgtacagccctggggagggagaggagtatgggcaaggacaagcagggatggccagactaaaggatttgtataatggaatatcaagagataaggttggggtcagtgcagtggctcatgcctataagcctagcactttgggaggccaaggtgggcggatcacttgaggtcaagagtttgagaccagcctggccaacatggcaaaacccagtctctactaaaattcaaaaattagctgggcatggtgatgtgcgcctataatcccagctactcgggaggctgaggcaggagaatcgcttgaactcaggaggcagaggttgcagtgagccgagattgcactactgcactccagtctggacaacagatcgagactccatgtcaaaaaaaaaaaaaaaaaaaagcaataaggttggaagtgtaggttggagccaagtagggaagtcctggaaacccggctgccagtgcttaagttaaattcaccaggcagtagatagcaaaggcttatcattgataataaaaacagaaaatgaaataaaaatggggaagacaataaggagactattgcagtaatttcactaattgcaacacaacccatcattatttattcagtaaatattgattgagccctcatactccatgcaatcttctatgctagggacagggcaatatctaagattaaacacatttcctgccctcctggagttgcattctagtacacatttcaagcattgacttctatgtccagtggacaaatgtagttgaaaagttaaggtgtggatgtattagaatgtagtggggtatgggtcctagaatcagatttcttggctttgaatcctggcttgccccattgttaactgaatgtatgtccatgaaacagttactctatgcttcagtttccttataatttaagaggggataattatgttagctctttaatagagctgttatgaagtttaattgagaaaataaatgaaaaggacttaggatagtacctggcatatagcaaatgctcagtagggctttcttgttttttgtatctgagattttaatttctactcaaggatttgtctaggtcacttctgtttttaactgagtgagtctatttcagaatcctggcatattgtatctcaggtctgagctctccttaatatgctgtatgattttggacattgaacttgttgaattaattagcatacaaactctgccttcctaattcaggcaagctgcaaaattcttctttccaacagaccacagttctggtcttgttttgggcagaagcttctagataatgctccttctagaccctgaatcaagaagtcttttgaagcatcctggcctgagagagcctgagaggtgacctgacctcaggacatctagtctccctctggagaagccatagtttgaatttaatttctttgtgttaccacatcataagggctatgggcctcctcagctctctgtgcctctgtgcccctttccatgagctgggatgaaatagccaactagaacaactatcaggacgtatgttctttttttgtttactattattattttttgggacaaagtctccctctgtcgctcaggctggagggcagtggcatcgtctcagctcactgtaacctctgcctcctgggttcaagtgattctcccacctcagcctcccaggtagctgggactacaggtgcctgccgccatgccctgctaatttttgtattttttggtagagacagggttttgccatgttggcctggctggtctcgaactcatgacctcaagtgatccacccgccttggcctcctaaagttctggagttacaggggtgatccactgcaactggcctggaggtgtgttcctatgagtgtattcagaaggatgcctcgaagcttgtggaaagagattgagaaagagagcccttaccagaaaccaaattggctaggaccttgatcttggacttcctgcctccagaaccataagaaataaatttctactggctaagccaccctgtctatggtattttgttaacagcctgagcagacgaaaacattaaaagagtatttgtggacctaatttcaagattattcagaattgtggtgacataagaaaaacatgaaaaactgaacctaacccacagtcctaatactcatttaaatggataatgttgactttatttcctatcatacattagtgaggccaaaaggttacagaatttgttggttaaaattcccccaagactcatttttcctctagaggaggtgctaatgagcagtgaaatagatcaaaactagtgagaaccatcgtcggagaatatgaggtaaggaaagagtctggacagtttgtatttcagacttttagttattgaacaattggcctcatagctgtgtgttcataggatgcacccagatttgagggggtgaaagtgtgaggggaggctgagtagcagaggcctgccagtgaggaaacacttcacctagcctaggagacatgtgaggtggttccttgcacccaagagatcctgcttccagaagagtgatgactgtgcctgaacccagccaaggattcaggtgtggagagttcctcactatagctaagccagatggtccacttttattttggtgaaggccaacctgaagcaaaggcacttttcttccgccattaaaaaaaacaacaaagcaaaaacagagacaaaaaagcttgtgatgtggagctctgccaagctagggctggaaaaaaaagtcccttgctttccttccaaggcagtatgtaaatgctgttttgtttgtgcagccaccggggatggtttagagtgcctcactaaagtccatggctgctatagaatctgatttttatgattatgaatatcctataagctaaccatctaggtctagttgtcacctccctgcacaatcatctttggttgaagatattgaattatactgcattgctatgaaagccaaatatcttcagaaagtgatcaccttaatctgtttatagaagctcgagcatgtgcttatgtgtagctctttccctaaaggacaggactctgatctttctgactttttctagagttcaggtgtggcaggcattaactgagacattaactcttcacccaaggaaggtttcttgtagcttaacctaaggagttttctgcttagctagagaatttggaagaccatttttcatttcttggccaggttgtgctatttacaaaaatgaggccatgtaattagggccccggtgccgtgtggatccattcactggtacataagagagactacagtgttttcatgggttagtggctgactgtgccctctctgtttcctttaatggtgaatatgtcactgctgagaaggatggcaaccaagtcctgacaggcagattttcagaacaaagtgttagtgagtgaagaaaggtctgtgcaagccaggcgaggtttgtcactgagttctaaggaacagttctttaaaaaaaacaagcaacttcccaatctgtgtctaggatttggatccagcataagtaaaactccaggtagagcaaaacccatttagcatatgctgggaactaccatgcccgtcttccatggtgcacttacagaaatgaggaggggactgggcctcacagcttggctccagctgctgtgccccagaagaaagagccatgtgcagtggccatcccatccattcactgtggcccatcattgttggcagctaagcgaagatgctcgcgggtggttagcgctgggcctcagattccttgttgaaggcccaatggggaacccatggttagaggaaagaagtccaggcgaagcggagctacctaaggagagacatgcttttaggaggtttcgcttcattgactcagttcaagttttatcttaaaggtactttatgctgggttgtggggggtggtggaatcagccgagtttgagattccagcattactcatgagccaagcttagctgcctgcttttagaattgcattaacttgaggtaatttttttaatgttttctaatcctggagcaaatgaaaatcattgacagtgatgcagatttcaaggccaatgtcactaatccatgaaaatgtttgttttattttgctttggcatggccttgaatgaaacaacaacaaagaaatccttccggagtgaaaggagcacgcttctcccctagagttctgttagataacccagaatactaaaaaaaatactggctctggagcctaaagaccttgccttgagttgtagctttgccacaccatatgatgttagacacctgaaaaaactcttctgtgcctcagtttctttcttcacaagacaaagagatcaaaaagtcccttcccaaccctgtgaacttgactagggagcctctggggccatgtctgggctgttggggtgcagctgagtggtgagaatggggtgggcagggttcatcactggcaaaagctatggcagagccccagcttcgcctgggctagatgttttgcctggccacggagctgcacaccgaatggaagttataagactgtgtgactgaaagtgtttattttgaggatgaatactaatatctaatatctgtggggcagctgtttccctgggtgctcttcctctatgttggctcatggtgagggcacagcctaaagagctctactgacatgtctcttcaaatacaactttagcatagtctcaaaatttcactaacttcagaccaaattcaaattttcttctatccatgatggagatattttcttccaacccaccatgatagatctttgggaacatgtataaaaattaatgttgctatcttcttttattttgaacttacaaatttaaaaaaaggaaattgttggctttaaaaattttgtaaagtctgttttctgtttgccaagagaccctgatggcacagagcttcggttcaggagtgtggtgtgtaaaccccggtcctcctccatggggtaatagagccctgggattctaatccatgccacatgcgatgacctgagcagaccctgtaggaaaacagaagtctcgctgtcccctcatggagcagttgctcacagtccgttgtacagctgtggcctgctttgttgggaagtgcagcgtgacttgatcttttaagctcttttctccctgtaggtattataaataacaactgctctgtgggagtacctgccaggagggcttgagatctgcattctgtactcaaaaagcattgttttttgtaatcttaacttcattagcaattacgagagaggagaaaaataaaacccaaaatcaaagtgactttgttatgatgcagaaaatccaaattagggaaataagaattgaaattgagaaagacaaactcctttaaaacctcaaattccttagaacttttctgagaacgtaaggaacacaaacaggtccagatccctaagatattccaagttcaacaaacaaatcagtttgaattcaggcaggctatcatcgagagctggaattctgacattgcacagtggctgcgaaatgcttgacgcccttttggtttccgtgtacttaaagttaagaaaatgtggcacatatacaccatggaatactatgcagccataaaaaatgatgagttcatgtcttttgtagggacatggatgaagctggaaaccatcattctcagcaaactatcgcaaggacgaaaaaccaaacactgcatgttctcactcataggtgggaattgaacaatgagaacacatggacacaggaaggggaacatcacacaccagagcctgttgtggggtggggggaagggggagggatagcattaggagatatacctaatgttaaatgacgagttaatgggtgcagcacaccaacatggcacatgtatacatatgtaactaaactgcatgttgtgcacacgtaccctaaaacttaaagtataattaaaaaaataataaaaataaataaaagtaaaaatacaaaaaaattaaaataaaaggttaagagaaagttaaattgctctattttggtttctgtgtatgggttctggagggattgccatctgtaacgagatgtaaaattctgggacactggcccaaggagaagggggtgaagagaccaggctgacacaggatcacactgttgttattatgttttgcctccttccactttcaagtcctagcaactgcattaccagtccatgtgcagtccttgtgatccatggaagaattcatgaatgtctgtcttaatcatgcagatgagtagtgaaaagaagtaaacaaggagttctcaccttttgggcagacatctgttacttacgctttaatactagcttgcttttagactttgtaaaatattgcggtaaaatgcacataacataccatacaattcagcatttttaatgtgtggttctgtggcattttaaatacattcacactgttgtgaaaccatcaccaccatccatctccagaactttttcatgatcccaaattgaaactctgtacccattaaatagcagctccccattttcctcttactccagcccttggcaaccaccattctactttctgtctttatgaatttgactactctatgtacttcatataaatggaatcagacagtatttattcttttgtaactggctgattttacttagaaataatgtcctcaaagtccagccaagttgtagcatgtgccagtttcattgctttttgaggctaaataatattcagttgtagtatataccacattgtgtttatccattcattcattaatggacatatgtgtcatttccaccttttgagtattgtgaatagtgctgctgtgaacattggtgtacaaatatctgttcaattccctgctttcaattcttttttgggtatatatacccagaaggggaattgctgcaacatatggtaattccatgttttttgaggaatcaccatactgtttttctacagtggctgctccattttacatttccgtcagcaatgcacaagagttccaatttttccacatccttgccaactctttctttctttctttctttctttctttctttctttctttctttctttccttccttccttcctttctttttttctttctttctttccttctttctttatttctttctttctttctttctctctttctttctttctttgtttcggagggggtgataatagcaatcctaatcagtgtgaagttatcgcattgtggtttgatttacatttccctaatgattagtgatacggccttttttaaatgtgcatattggccattggtatatcttcttttaaaaaatgtctatgcaagttatttgcccatattttaattaggttgtctgttttgttactgctatgttgtaggagttctttttatattgttgatattgatcctttatcatgtattacaaatattttctctcattctgtgggttgtgttttcactctgttgatagtgtcctttgttgcaaaaatttttaaattgtgatgaagttcagtttatctgttttctcttttattgcttgtgcttttagtatcatatccaagaatcattgccaattgcttttagattttttttaaggatagcccctttctctgtaataccacaaaaaccattacttgtagaaatttctctttgaagggattttgctctgagatgtctcttttttacttgtttggagagtggcctttttattacttgggaattggttgattccactttcaccatgctctatcattctcttctcttcttctcagggagatcacaaaggctcatttatggataaaaagaaaagagggagtgagggaaaggcttagtttgaaaatagcctcaatcatttgtagtataggggctaaggagagaaagggcaggtttcagaatgtctggggcatatgagtgggttctttagcaatcaagacttgcaaggagtctgtgacaccaaactggactgccatttgtctaagaaggctgagatctacttcctaaagcaccctccttttgtcctcaggctggaaagattgctgaaaagtgagcaggcccctagctgaacctctaaggaacctcagtccccctcccaaagacataatattccatgcctgaaacttctccaagtatatagacagtgactttttataaatgttcattcccttttagaaaacacaatatattcctcttatttctattaagtgttggtaaaatgcttctaattgaaaatccttttcctccctgccagtttctcatactttactcactattatttctggattatattctgtgtacaaaaatcaccatttaatagtgactacacatccaaacactacagatattgcttagtataaaaaagcaactggggagtacatcataaattcatacaatctcatcttgaagagcaaactaaatacagagacagcctgaaggacattcttctttacacttggcagttccagaagaatatatttaaatgttatgtaagttttagtcttttctcattacttatgtcacagctgtggacttctgagccatagggctgctgtttactttagacagacagttttgagttaggtgagtatttgagtattttcctacccagcatgtgttcagatgtgaggtgtttgcttttatgcttgtacgtctggtatgaaaaatggttttgtgtgccaataattgtccctgtgctgctgcctgcacagtaacttgactcaggaatacagagaactgtgtctggaatttgcagttttaagaagttgaatgatgacatacttcataaagagaactcttttcaaatgaactgtagtttaattagtagatccctcactcgcctatgtataggcttgaagaagtcggagaatagttttactgatgtcaaggaaggctggcagtaagtttctctaatatgcatgttacagaatgcaacgttaaattcctgaaatctcgtttggtgatggtcttcaaaaagaatcatttttattcacagggcctcaatcatctgagggactagatatccagagaagccagcttctcagtgttgcgtgcactttaaaaagtcataattaccgcaggagctaggaaatgctttaaatcagcagcatcccatcacaactcctaattttaatgtgtgcaagtaggcatcctaacaaaaccacagctcagcccccacctcgtctcgccttgctccttcctctctcactgtgcctccttttcatggtctccagggaagcatggtcagttttgaaggagggagagaaggcaaagagggatggaagtcagagcaagcagcccaggtcccacttctatcttaactggcaccaggaaaaagtgccttcggctggcacagtggcttgtgggcaccaggctttgcttgtttgccatataaatcctggtcataacagagaccaatgccattcaggcagtgagcaggaagctgcttttatggggagctttttggcaccgtgtccgacatacactccagtcaatcacagtaaagggcctaataacagatgtggtgattaagcctgaagaactgtctctattttttcatttttgtttcagagaataacaaagtgcttcattaaacccccaatcgcacagagttttgaattgggcatactgatgtggtaaaaacttacatctctgtaaggactttcttctgaagttcttatcagcaaggatgcctcagagggaaggttggatccttttagccaggacagttatgttctttctgggttgtgctttgcactccaataccaaaccatatgcagaatcctggggtacaaccagtttcctataagtaccttggatataaataaacagttttagcttttgtgtgcttttgtaaatgtaaaatgttctctgactctcttaggttcaattttactgcttatagcaagaaattaactatagctttcaatcttagaaaggtttcagataacctgaaaccatggtaaattaccatattttaataagataaattatcttgaaaaaaatttaattacatctgaaaaggtctgtctttgattgtggcagtttctaaggcaaatgtcttcattaaggttgtttttctttctttttaaatgatgaacatgaatctggctcatcattaaaggaaattaatctaagaatttaatgacttgggacaggtagaaaaagtatacgttctcaacagcaagaacacacagctgaaaactttctctttagctcttcctggattgtgaaggctggttctctgtgaccctggggctcttgggaaaggatggctgtctttctgacacggctctatgggatcgtgtagatttggaagccacatctatatcccagagataatttttttgtttgtttctaattccatgtagccatagatccactttgtaagattattgctttattatctttctccaaatgcatacttctgagttttcagggtacctccaagagaatttgtagttgactagattctcttaacctgacccataaagcatatgatttatggagaagaatcaagatttaattataatttcaattcttgtgttaataaagcataaacttaacctactcatccgattagcctaaaatgtaatttgtgtgtatttaacatttgtacacacttatatgcacggacacatataaaaacagtactaacctttatggcacttcatatttgttttctcgtctgaaacaatatttacaattcactttttactacctttatccatttagacaaccttttcctccattgatgttaaacatgtttcttgctaaatgtaaaatcagcaatgtacagactcagattttgccacattaaaatttgttttaagaaaccacccctatatacaccttgtatctaaaagtgagaactcccagatacattggggaagacttgtggtcaggcagacacctccctcaggattattcaattgctgaaaaagtaaagcttttctttaaataagattcagaataacttccttatagtttttcctaagaagggcaagactttctgggatgatacacctcatgttttactttcggttccattgctggtggggagatatttctgtaggttcggggagatgccttgaagatgaagtggaaagttggccaaccaagggcggccctgagctgaagcgccacctcctggcggaataggtcacttcagggattgtttctcagttacccaggctgcctgctgaggcatctgttctccccagttatggatcccactctgttatttctctcccacctcacccctctggatcggttgtctgggactcacaggatatgatctcttgactctcctcaagtgctcaatatactttaatgtttcatgactttatagatcctggtattgttcttacttagcaaccgtatattgatcatctatatattcttgcagatggggagagaagtagaagtcagggaggagtagaataggagacaagacaaaaccatgggctctgctttcaaggacccaacagtctagttgaagaggtgggattggttatgtcaaaagatgaccagcagcccaaggcaatggagaaatatcagatgaaggatgtggagagttggttccgttagagatttctatgcagtttctagtgaaaagactagagaatttttacttatgtcctgaacacactgttaagtagatcttggatgagaaaataaattattgcaaagagagaagtaagttgacagaaagcttatgtaatggtttgaatttcaaacaattagggaggcttacatgttggactaagggaattttaggaatgaatcataggctctttcaaattagcgggatatgaaaaatatattccaggcaggaactatttctacccttcatagattcttcaattgagatattcttcatgtatggtttacattcattagattttattttcctgtttaagttaaatgattaggaagtttaaaatcttgaacaaatgacagtaatatagtttatggaaactgtatttataagaaggaaatgaatgtattcattgtgatggggtgcacttaattttaagtgcttttggctgctgttgtttccaatatttgcagtaaaatgaagatactgctattaaagactttgaatcttaaaaaaaaggagctgagggagagaatttataataaaggcaacagggaaatgacatttgatgaggacaagaacagaagagattaaggaaaatgtcagagattgcaaagcttgtggccctgctgagttcagaactcagtgttagttcaaaaacctttagcttccttagttcaaattgcccttaaagagttatcagaacctgcttaaaattaaaggttttttccccataaaaactgtaattatcttgatattaatgttccagtttatttatgtatttatttttaacattatacttggtgtgcatttatgcccacctgtgcataaaggaaattcttgccttatttaggtaatatacaaacacttatgtacatttggggtccattaatatattttaaaatttataatcacaatgtgaccttcatcaaagaccatcacagatcttaattccttctcaaaattaaaacttaaaaatatatgaatcttgccgggcgtggtggcccatggctgtaatcccagaacttttggaggctgatagaggtgaattgcttgagcccaggagttcaagaccagcatgggcaatatgatgagacccgtctctacaaaaatacaaaaattagccaggtgtgttggaatgcatgtgtagtcccagctactcaggaggctgaggtgagaggatccattcagtttgggaggttgaggcagcagtgagctgtgattgtgtcactgcactccagcctgggtgacagagtgagaccctgtcttaaaaaaacaaaccaaaacaaaataaccctttttctttctgtctatatttcaagcatatattttgaatcactttgtaataaaaatctttttattttctaaagtgtgctaatctaacactctaagaacatgttgaagcagagcagtctttcagttgctgtagaccgtagcaatctgctaattactgaaggttcatcctagggtatattcccacacattgttctttctggtgaagtttgctgaaatgggtccctgtaccaggcccacaggcaggccccaggaattgtgctttttatcaatggagatgcaacacttcagaagacgctttagtgcaacaaaagtctgccatataagtttggtgccattgcacctttgctctgcctccttatcttgctttattacttcctgctggcttctgctgcttgactcccagcccctcctggatgctcccttgctgctgtcaaatgtttgctcatagtcacctcaccttgccctcagctgatatgaataccatgcctgcaagaatcatcaccaatgcagccatgtttgagcaggtccaattattgacaatacaggaaggctaatgagtagaaagccttaagctttaaatgaatttacagaatgattaactattaattaagccattgaaagtgcccatacgttcttttcagagactacatattttttatctctaattaaaacaaatatcccccaaacaaaactttcagtgttttttcatatttgtaatcactggtattgcaatcattttgtttcaactctaggattttccactgcagttgtatattagcaattaaatgataatcttgaccttccatttctgccttttaaatattaagaataatgatttcagggttccagaacaagtgatttgcatattctgagctttatttttcctgtgggccatacattcattcaagaataccaagaacatgtagagatgaacagtgtaccattctgacattaaggagtctggtagctagtggagagatgagcggtgtggtgtgtgttactactctgacgaagaacacatcagctactcttgggatgtttcagggtgttacaggagcaaagaagaagaatgacaaggttagccagggagctcttctaaaagaaagtgacagttgatccttaaagaatgagtgagaattaagttgagcagatagttaagggcattccaagaaggaacagcatgggcgaagacagaggagtgaaaacctctaatgtttggggaaaatcaagtacctgagaattgttcaagcgacatatacatgagtttgttgagtgatgaggctggactcagatatcttgagtcttaaatgccagtttgaattttacctaaaaggcaagctctcaaaagcttttaagaaggggagtgtggggttgtttgtttttttcttgtaaatttgttaaagttctttgtagattctggatattagccctttgtcagatgggtagattgcaaaaattttctcccattctgcgtgtccgctctgatggtagtttcttttgctgtgcagaagctctttagtttaattagatcccatttgtcaattttggcttttgttgccattgcttttggtgttttagtcatgaagtctgtgcccatgcctatgtcctgaatggcattgcctaggttttcttctagggtttttatggttttaggtctaacatttaatccatcttgaattaatttttttataaggtgtaaggaagggatccagtttcagctttctacatagaaaatgtggcacgtacacaccacggaatactatgcagccataaaaaaggatgagttcatgtgctttgcagggacatggatgaagctggaaaccatcattctgagcaaactatcacaaggacagaaaaccaaacaccccgtgttctcactcataggtgggaattgaacaatgagaacacttggacacagggtggggagcatcacacaccagggcctgtcatgtgtcccctgtcatgggggagggatagcattaggagaaatacctaatataaatgatgagttaatgggtgcagcaaaccaacatggtacatgtatacatatgtaacaaacttgcatgttgtgcacatgtaccccctagaacttaaagtgtaataaaaaaaaagtgaggggggagtgtgatgttctgacttgtgtttttaaagcattggtgacagtgtggaggaggaattgagttgattggtaaaaaggatgaactgatcaaactgaaaaactagtcaaagttagtgtttcttgacattggttttgaaactttgctctcagtaatgggatcagtaaatatgattagtgcccttataaaagagacctcagagtgctgccttgcgccttgcaccatgtgagaacacaaggagaaggtaccatctatgaatcaggaagcagcccctccccagacactgaatctgccagcgccttgattctggacttccagcctccagaactgtgagaaataaatttctgctgtttttaaggcacccggtttatggcactaggttgtagcagcctgacctaacacacccattgtatctttacagtaaaaagtcaaactgagggataaaaacttgatgatgttttcaggaatatccaaccaaaaaagtggccatttcctcatccctgatagaagtttttgctaagataaaaaatgataaacagttttaaatcatgggaacataccaagtagccatggttggcatcactggctaaaaatgcatctacaagaactttgaaaagcagatgaagtagccagatgatatgctttaaaaacttgtaaaatcatcctagaatatacaaagcttaaaaatgcatgaagtaagagatgagaactctccaacaatcttgccattgaaaaattgacttaaacataaaaaaaataggttaatgaaaaacactgccaataagcagatcaaacgtaattggctgagaatgaggggaggaaaaactaaaatgctggtaagcctataaaagttgtaaaactatgtatgcccaattgcaaacaaacaaacaaactcaaactcctttcccagaacttttaaaaaataacagaagagaatatttttacggtacataagcaatgcacaattgcctaatggtatataaaaattgctaattcctgaaaaacctgtgacttgaaatatacatttttcaataaacttttatttgtcaaactcaccaattctaaatcttgttccaaacccttttctttccttctctctttcattacctccctccctccctccctcccttcctccctccctcccttcctccatcccttcctttctctcttcctttcttgatagagtctggctctgttgcccaggctggagtgcagtggtatgatctcggctcactgcaacccctgcttcccgggttcaagtgattctcctgcttcagcctcccaaatagctgggattacaggcatctgccaccatgcctggctaatttttgtatttttagtagagacagggttttaccatgttggccagtctggtcttgaactcttgacctcaagtgatccacctacctcggcctcccaaggtattaggattacaggcatgagccactgtgcctggccttgcttttcttctttaaactagtttttcttttcttaaaatatttgttcagatttacatagtggactcgtctctatgtctttgtttagattcattcattcatttgctgtgctgggtgctgttttaggtactgaggatactgcagagaaaaaagaaggcatcattgcactgaggaaattaggagatgtcagtttaccttccatcagctctttcacatggccattggcaaaacttctaccatgcttgtatctaatctgctcctttgatgcatagattgagtagacataattcactgcgagctcttcctcctgggaatgaaaaggagcactcacaagttgccttattaaagtctttggctaactaatcaattttttactgttaaacttttataagcaccctagggccaattatctctatatttgtaccctattaacagtggcatcagccacagaaagaaagtaattgcatctttattatctttgcgtatagcaattcgtattattgggcaagacagactgacaggatcttgaattttggcttaatagtggcctaaggagaagccatttagaaaatagctttgtgaccttgggcatacttttaatatctccagaccacagcatcatcatctgtaaaattagagtgttggaccagctttctgctaaaggctatgttcacacaaaagtcgatgaatcttaggcattctggaggtttataagaaaagcaaagagaaaatatcactctcattataagtttgcttgccatgaaagctgctttcctgactgatgtttctgaaaaggaaataaaacagagagggagccagtaacctgtgagtgatcagtttgatgctgcatcagactagaatttacccctgtcattgtctccacctgcccccatggcatcaggtcctgaatttcactaaaaatggcagggaaggacaaaccaggagacacagggaaattagaagagataattatggatgatgtgaatgaaggaagtaatatggaaaatgacactcgatttcctaacaatatgagattgttctccaaccattagggtcagacagggtcatttcttgagtgaaagatcagtctagataccacaggaagtggtgttgctaattcagcatgtggcactttatctactgaaacaaagccccattttaagagtcataaagatgggatttgggttgtggctttgtatatttgcatacatatgcgattggccaggaagtggaagtgggaggtgaggctgcccaagcattttctcctgaatgtcctgaccaaatgcagctttgaatactgacattcttttacctacttatacttcctcagcagtttcctcgcattttgcctcaaatcttcaaagcctttgacaatgtgggcttaaaaccatgaggataaatgtgttcagattcttttgtggcaatgcctgctgcgagatacctgtggtcactctgcttcctggtctgggttagtggttcagaactgagtccactgggaagaatggcagctgagtcacaaatgtcactgattattcaaaacatctgtacagtgtaaatatggaaatatcttttgtactttccaattcacatattcagttttgaccaggaagtagcttagtctcttagagtatctaacttttagtgaatatgcattccaagaagcgtttattgctacaatacacaggtgaagtgttattttagaaagactgagactgttttacctgatggacaggtgatttgactgtaagttaagagaactgagttctgggttctagtgttgagccacctacaaatgagctctgtgatcatggccaagtcatcttaacttgaccttctattattttatccataaaatgaaaggattttgattggactccatgaaggccttcaactctaacattctgttctactatttcttacacaagagctctttggattctggacatatgtattgctctagaaactcttgggagccaagtaaatgtttaaaaactcaaatttctgtatcctgttagaggaatgctcagggtgtgtttgtgtgtatgtgtgtgtgtatgtgtgtgtgtgcgtgttcatgcatgtgtgtgctcatgcttgccttaatggaatctggatagatttagttgacaggaaaattttctaagattttggttttacagaaattcttttcctcataaggtctttgttcctctatggggttttcttttgacctttgaggaaaggaaggcttaacttggattgctcatctgtgtcctgatagtgagtgcttcagtatttgaaggtcagcttaatgacccaaagataggagagcagatgacatgtaggtgcccgttgtcatgccagtgatgggggcagaatatctgtttgcatccttctgactgttgctgcagacaccactgaaaaggatcttcccgagagagggaccttgcctgtactcaggcttcctctcagtgtccctgtcctccccctaccatgggaagggaaagactgaagattctgatgatgctcaagtaccctgctacatgtcagagaattatatttgctcctccttctccttattataatttgacttttcttttctcaaggaaattgccttcttttgtcatttattctgttatgattggattttttcccctgcttgtatcatcagaggattggtcaaagtggaaatctttcagcttcttcaattagcgcttttgcaaaaaaaaaaaaataataatgctttaggttaaaagaaaaaaaaaaagccctaagtcttcttttcctcctgggttgatcatgttccattttctgggtcatttttctcagattccttcactgttgaactgcctgaagtctcatgaggtgtttggatgtttcaccttgagtaaatctcaagccataatattcattgccattcctgatctggccctaaacttcctttcccactcactttcacactgtgcttcaaacaatcctgcctctttgcctttcctctgagcactcactttctcctgccttcgctcttactgattcctctgcctatactgctccatctacccagcaaaaagtttcttaaagaccttttctgtggagtcttcaataatgctatctgttatccccattcactggttgtaagtgctttctgaatgcccatacatgttttgtaatcctcctttgaccctaatcacattttacattgcccagtcattaccatctacgtggtactactctcacattagattgttaattctttgagggtaaacatggccttcaccagtgtttgctggttgaaataacaaatgtttgttcattggcaaagcatttgaaaagtgtccatgtgaaaaattgttaaagtaatcacatgattacaacagctgatgaaatttgaattaggtctatggattaaattggtactattgcattaatgttaaattttttgtgtatcattgtatgataattatacaagtaaatgtccttattcttaggaaatgcacactgaagtatttagaagtaaaggagcctaatgtgcacaaattacccttaaatgattacaaaaaacatatataatgtgtatatatatatttacacaatgtgtgtatacacatacaatgtgtgtatatatatatacatacgcacaaacacacacattgcatatacatatatatgcatatatatatgtatatgcacaggcattctttgtggtatttttgtaactttcaagtaaatttgaaattattttaaaataaaaagtttaaaaaattaaattgttatttattactgatcagggataatcatagaaaagtagcccaagtgcggaaaaataaaagaaacatttatttgtagatgaaaaagtaacccagtgaacagtctgaaattcatttatttaatattttataagtgacctacacacagcacatgatgaactctccaagttatgatgaggcaggtcaattcttctagaaagtcacatgctagatgactatgcctaaatggccagataatctgggatggtgccctgtgtggaagaatagcagatgtacctcaaagtacaggcattgtgaggttatgccccttggcacaaaataactcaaactgtgattagaagatgatgagctcttgccaggagttacaatgtagagaaaagatttcagaatcattgcaggtggttacttctgtatgttaatgctactaaagatgccaatgaaatgatgggcattattaggaggtattttggaagtaaaactaattttggtatgacatacttaaacataggcatattggttatatattgctgcttcacatgaactcaaaaattagtggcctaaagcaacaaagatttattactcacagtttctgtgggctaggaagttgagagtagcttagctggtggttctagctcagggtctcatgagtttataataagtatgttagcaagggctgcagtcatctaaaggtttaacaggggctagaggatccactcccaagatggatcactcacacagctgttagcaggaggcctcagttccttactgtgttggtctctccatatggctgcttgagcatccgaatatcatagcagctggcttcctgtgaaatggtgttcaaagaagtgagatgggaatttcagtgccttctatgacctagtttggaagtttatcatttttgtaatattctgttggttatagaagcccacttattcattgtgagaagggcttacacaggcagggatcattggaggccatcttggaggctggctacaataatagggtataattatggttgctgtagcagcgttgaaaaaaagaggaaaaaaagagtgaactttataaaaacgctaagagggcttttattttggtggacaggccaggaaaattaagactcttaaggttgagaagaatgagtagggatgttattgaagtgtatcaaattatgacaaatttggaaaaataaatatgattttattcatcaaagtttggaacaagaaatagtgtttgaagtttctttctctaataaaaaagagatgtaacttgttttctcagtaggaaataaacagattgaacccagaatatataaccaggggattcagaatgctttaaacccaaaacagctctccttgatctctaccataatttctattatttctcccagtcctgctgattctttctctcattggtttctcacatacttccgattcctaggctaccaccctaggaaggtcgttccacttcacacgtgagtgcagtaacctccacactctgtctttgcctccaaaggatttggtcccttggttggtttttgcacaccttctctgttaatctcccaaacacctctttcatcaaataatgcccttgctcaaagacttcaagtaaattctactgcagagaggaagaattaaactgaaccccttagcttggtgctgaaggccctttatcaccaccaaacaccaccctcctttctagcgttacttctcacaatctgttataaaaccttctgctctccaccctcaaggcttggctcttatctttctctttgccttgtggcccctccttgagtttttatttactcagaagcttccttttatccaggtgtgatgctgagggctggtcacaggcattgtcgccatcagccaggcctgttcgtatatctgctcttacctgattgtctgacttccagggagacatttaatctcagtattccctgcatggggataatagaccttctcctgtggactcagtgaggtttcattgctagtgtgaggtgccactcagtgatttctagtttcctttctttttcaagtccctgctcaagtttgactttcttcatgagccttcatagctcttgttggcttcctctcctcttaaaactctggcaagtcatctctaaacggactcatttggcaaataatcatattttgattataattttttccttagtagattttaagctattatgggcagagactgtgctttacaagtcacaggagttgccatagtttcttgcccttagatctttaatgagtattgtttgtagattttttccctcatatgttgtgggtgatggattcacagagacattgtagaggattttccagagctgatgatgagtgaattaccagggtcttccccaaattatcccttaacaccacctatataatgaccgtggggttggctgtttaggtaggtagggccacgtctctgttcccatagcagcttattctggtcttaatcatggtgtgcatcatgctgattgaataggtcagtttgtggccattttccatgtggggctgtgagctccttcgggatagctcagcactggacattgtcagtgacttgcccagtttttgtttgatgtgaagtgcccaaagaattagaaccattagtaaacttcacttcatgctaatgtttagggatttttttgtggagatggggcttgtttataaaaccattttaagtttataaacagatttgagagtatatatatatatatacatatatgtgtgtatatatatatatacatatatgtgtgtgtgtgtatatatatatatatatatatatttttttttttttaagacagggacttgctctgccacccagctggaatgcagtgccacaatcacagctcactgtagccttgaccttcgaggctcaagcgatcctcctacctcaccctatactccacccctctcagtagctgggactacaggtgcatgccaccaagcctggctaatttttttttttaaataaggatgtggtcttgctatgttgctgaggctagtcgcaaactcctgggctcaagtcatcctcctacctcggcttcccaaagtattaggattatgggagtgagccaccgcacctggcctttcttttattaatgctggtaggcacactcatttaacttaaatgaatactctgttcctgccattatgtgatttaatttgatttagaatatgcttgttgtgggtttgatgttagcaaaatgacatgaagccctcaaaacaaagtaaatatagcacttgtactgtttgaaatgaatagtcatacctggataatatgttattagaataactagccttgctcagtgaacagagaagtcatgctaatgccttaaggattcctttcatcagcaaactagtatttccatggaagtcctcatctgagattgttctcagggcaaccagcaagcattactcatcctacatctttaatgcactgaagctggaccattgcttctctgttcacggcctcaaagctccaggaagaacttagcacactgcctctgccggcctttctgagtagtttgaggaacagtgagtacatcctttatagataacacgatggagtggtcaggtgaaatggatggctcttgttgaaaagtggctattcttaatcaataaatttgttttaatttaacttagagatatgtgagagaatcttagcgatatgtgagtagcagaaaatgagcttgagaaaaaactggttgagggtaccgaagttatttctatgtgtgcacttaattgattctaggaagaaaatagattttggagccaaaaggaatcatctggaataattttcccctctgttgtttcaaaaataaattagtaagtcaacaccccattatttatttctctttaactcaatgataaagaaactactgcttatcatcagaactaagactcatccattgtaaggattttattcatcctgattatttactgaggcttttgtggtagaataagcaaagcttgccttccaagtggagctgcaaaacacagacagcaagggttaactctgtgggctgtttccctttctaataggagcactttagcaatgctaatcagttgtactgattttgttttgatttttccataataattaagtgaatgatctgaaatgcaatcaagtttggcactagggggttcatgcaaatgactctttatttttttacattttaaattttgttaaacggaatcataaggaagttatttgaagaggaagtctgagtgggtgagggtagccaacacccaatttagagatttgaatatattcaaaatgtctatcttaatgaagcaaatcaccactgcattgcctttgttttcaattgaaataatactatttttaaaaaattgcattttgttttcatttgcattccaaagtggaaaattataagacaggatgacacagcatagaagagagaaatgaggaagaataaatttactggactttccttcttcagagtaggcatagtggaaaaagggtactcactatgtttactcaccaaaacctatagaagaaaacaaagaagatagggaaaaagtaaatgaatgccctatctgctgcttttttcttttcttttcttttctttttttttttttttttgagatagagtttcactcctgttgcccaggctggagtgcaatggcacgatcttggctcattgcagcctccgcctcccaggttcaagcaattcttctgcctcagcctcccaagtagctgggattataggcacctgccagcatgcctggctaatttcttctaatttttagtagagacagggtttcaccatgttggccagggtggtttcgaactcctgacctcaggtgatccacccgcctctgcctcccaaagtgctgggattacaggagtgagccaccacgcctggcctaaatgtcctatcaacttctgattttgattgcatctcagtgcctttattaaacaagatagaatgaaaggacaatccatgtttcctaatttagagaaatgctgtgtttcttagttctctacagcttattggcatatttgtgagatgtcttctctcctcatcgtctataacatctgtgttattttctcaaacagttttaaccagcttatgtgaatttgcatgatccttgcctcttgatcaaacaattctttttggtttttcagactattctagagctcagttaattttctaattttaattaggaaaacgtattgggacaaagataccaagtaatacacacatacatccacacatatacacacacacacatatttttcaatgtactgatattttttctttcaaaaatggtacctgcgacttttcaatgcagtttgatatttctgtatactgaacttccaaagcaatgagaaggtggccaaattctgctttttctctgtcatctcctcttcacagggcaatgcatcagatacaaagcaagaagagaaaccagaagattagtgtcaatatttttacattaaaataaaactcacaacctctttcttgttctgggactttgattcatggcttgggacaatttctaactttatagactaaacatttctaattggtaaatggatggtttgagtctgagatgactcaggaaataaactttccaatttggggtaattgtttatgagtaggttactgcttaccagccttcatgtctttgaggaaagaatgaaagctaaacacatttcacacttcgttgaagggaaatacttctcacatagataaagcaatgagacaaggaaataattgccatgctcatttgttacagccaaatatattaaagatttttttgatggatgaggaaaacactagctgtatattacacggcttcaactgtaaaacagggacaataaaaactactacttcttagttaagttgctgtaaggattacatagataattcacataaatggctcagtactgtgtctggcacacagtaatcggtcaggaaatgttatctgttattgtttattattatcatcatcattttttattcattccccttaaatgaaatagcttctttatataatgttaagcttcagattttacaacttcatgatgcatgtgagaaatgtcaataatttgaattaatctataagttaattttggttaactatttacgctttatctattggaattatttagtgaccattgaaatatcctttttaagattttacagcttctttaatggcttacacaatatcttttaattatactacaaattcatgattttttccttattccaagtcaaacattttcttttagcctttgttgagtcagcaataggtaacttgtcatagtatacttaaagaatcttgattttgaagaatttaatatttcctcatttgatctgtcctgaatttgaatgataaactatttcctaaagttgtttgttttttgctgttattgttgtttatttgtttattttaagataaatttgccttttcaagccataaagttattattcaatacatttggttcccaaatattaaaaacttcttggcatggaaaatgagtataacttcttaaaatgccagctcccacccagaaaatcactgctttgctcaaataatctggctcattattactagtttcactagtttaccaacaggcaggttggcacttattttgtttgtaattaagaaatggatcagtgatttctaattttgtatccatttttataatgattagatgacatagtatgacaattaaacttttccttcttactaaattccagaggctgcaggagtgcctgtgattctcaggtgcaaaccattacaggtgttacacacccgggcctggcgcaggtcctagcatatcgtatgtgttcaataaatgcttgtaggtggctttgcttgatgatatcagaggaaccttcaacttgacctatctaaactgaactgaaagcttcccctccccagaggagggcttctatgagtcccatatcagcgaggggctaacaatccccacaaggggctaaaccagaagctcctcccctcccttaatccatgttcaatagacaagtcctgtcgattccgcatcctaaaaatctcccagagccactccacttcctgcaaccccattgctgctgccttgatctgctcacagtcatgtcttacctggcctccctccaagagcctccccttgcagctagagtcattcttctaatgccactctgcaccatttactagctccatgttatccttggatgaagttccctactgcacaatggcttatgaaacccattgcgactcaccctctgtctctttctccagctgtcccctttttcttgccatgaattaacttgaactccctaaatgcacctggccctcccttacatgtggatccctctgcctggaacattcaccctcttcaatctcctttgccagcctatctattttccaagcttttaaatgttactttacagtctttaggttcattttctctaacatcgacctgcaaacagctttacatttttttctatgtataatctagtttttagaaacccctgtgagatgtttggtttcatttctgttcagcagatggagaaattgaagcactatgtttaagaaacttatgtcatgattactaagttataagtatcttaacaggcagagatagggactggttctgtgttttatatccagtctttgaatgatgactaggatggagcaggcattcagtgcattgagtgacttatcaaatgaatctcagattgagcctgaggtacctctctcttgattcgatggagcttctgtttcatcatttattttctagaacaaatgaggccagctacctctgtgtgccctcctcttctagaagggaaatatgccaggtgagagaatgtggaggcttgtgttgctctgaattgttctggtagatttctttaatattggctggcataaatgagaagggcttttgttcttgtggcaattgatgatgatttgcatattttagtaatttacaaaatagtagccaccttgcacaacataagaaacacccctctctcctggaccatggaatttggtgacctggctattgaaatacatggcttgttatgcacatttcagccccactgacaactggtacctggtggttgctgtactgaaaagaattctgtgtgagtcatttcaatgcatttctaattgggattttttctttcttgtaggttgttcttcagaaaaaaatggttatttctttgaactcatgcctgagctttatttgtttattgttatgccactggattgggacagcatcacctctgaatcttgaagaccctaatgtgtgtagccactgggaaaggtaatggttttgaaaggagcctgacaaagaattgctgagaagttcccttatatactgtaattatcagtcagatgtataaaattagaatttgtgaagagattgtgaaattacttttatgtaaaaatcattagtcatagctagcaaattaggtggtgttagtcaccttggtcttatagcatatatattatgtgaaaaaagtcttgatatatctaattctaatgcaggtgcaattgtaagattcagggaagacattaatagcacaattaaaagatcttcctaatgtcttgtctctgatttgaatttgcattaattttggggagctggacttatgcatgggaacccatgagtgagaagtggaaagcagcatgagataatatactaaagtattgaaatatatgggatttaaaagaattttgctgtagatggcttgaaaacggagacctaaatttggtgtaaactggcaaggctgcatagaggtagtgtcccctgagatgctcttgaagaactgaataagatgagtgggttgcaatgattggaaggggatcttggaaggggagtcagtttggcagtttgaaatcagtgccatgtggaccaccgagaactgtgcacaaccagagcagagttagtaccgtattggaggagggtgtggttatgtgaaggcagatgatgtaatgtctagatatgagcaatttgcagtagaaagtacaaaacagtagatcatcctctgggactttatagtcccttttggaacacaaaaatagtgcaaacccatccagcgatattgcagtacaatcaagtccagttggctctgctctaatgtgctacttgaatttcccagaaattatcttatccaaaaactgtaaatgcaagtgttttaaacaaagagaagatgttaagtactggagggtaatatgtatttttaatagctgtaagtacaattatatcaaactcttgatcttcagcaccatgattagcaaaccacagagcacacattctaatcacctttgttccccactgttaggatgcataaagcccagagcctctcaagcacagcagtggtattattctggggacatgctggtttctcactcagtattatttttggtaagggcttatccctacctccattggtagtgttacaagcagggtaattaaaacataattacctgattagtcaatggagttatatattattatgaaactttaagctgcagagagaatatatgtatataataaagttctatatatttgtggtattaactacattatacagaatttaagcagaaggacttcctattagtgctctttataatatttacagcacctcccataaggcatttcatcaataaaatatataataaatacttattaaagtcatgaatcattggctacatcaatgggtacaggtcaaatttagtaaaggaagagaccattggtagttgaacttcttggagggatgatagatttgggatgggaggaaaagtcaagtttgtgagatgttgtgaaataagaatcaacagatcttgataatacattgactgaggaagtgaaggaggcagagaagacgaggatttagaacttgctgtgtgaagtaatccagatgacattgcgcatatggaaaaataaaagaaagagatttgatttgaaagggaaggggttagtgtgggtttgccatgttgtgtttataaaatcagtttaaaatatgggcctggaagtatttgggaatatagatttgggaatatccagcatgatgagatgtgagatgtgaacagaggaactctctgagggaaagactataagagaaaaaaaggttgggtgcggtggctcaagcctgtaatcccagcacattgggaggccaaggcagatagatcacttgaggccaggattttgagaccagcctggccaacatggcaaagccccatctttactaaaaatacaaaaagccaagtgtggtggtgcatgcctgtaatccagctacttggggggctgaggcacaagaatcacttgaactcaggaggtggaggctgtagtgagctgagatcatgccactgcactccagcctgggtgacagagcggaccctgcctcaaaaaaaataaaaataaaaataaaaaaagagagagagagaaaaccatttcaaggcttcaaataatccggcacccacttataaatacacattttgtcctgcttccctggtcagcagttgaccagagctgccaatgcataagtgcattgtctggctcaccactgataattcccactgtctaaaacactgccttgcatgtggcatgtgtttaataaattgttgaatgagtgagttcatcttctgataggaaacgaaatgactaaatatgtacatcaatgtgggaggggcatggagagtgagaaagacagatagacaaggggcacattaatctctaaacctaatagaacccaacaactgtgcaagtgattagtgcaaactctaaaatgctcatgaagggggagggaaattgaatgtgaacaaataggaaaatgatgaaaaaaacttccagtttttttaaatgtactgccaggaagaagagttgacagctataatcttcttactgataaattttctgttgtaaggctagataatgatttctagaagaaaggtaaaagaaagtagaattgttttgataagaatggggaccagtatagaagataaattaaaatgatcaaataaaggcacaggtgacaggttcgtctagtattttcaaaaatgtaaatgggcttgaactgaaatggggagaggaagatgagctccaagggcataattctggtagtagggctcattttaagctcttcttatgctcaaaaccacctgtacccaatggctcagaaccatgcaatcacctggaggttacttctcagactgtggtttgcagagctgaggcatgaacttgttagaaatacagactctcaggtcccaccccagacctactaaatcaaaatctgcattttaacaagatcccagggaggtttgtctgcatattcaagtttgagaagcactaaacaaaaatacttccatcaatggcttctagctgcatcccaattgatatctgaatatttattttgaaatagagatgtgccttgttttaatgcagcgattgtgattctaagaaattgtacataaaatgaaattaaagaaaatgaaatcatttaaaatactcaaggggtgtttatgattaaaggaactctgtacagtgtctttttggaaaatgaataactctagaaattatctattccttctcctaaccttctttctgtattctatgaatttgagcttttccattcagtggggtttcttctaaagaaggcacaagtgaagagaaaccacactttgaccaaaccttcaattactaacacagaagggagagtaattgaatcagcagtcctgaagcaagcagagataagaaatgaagattattaccatatctgattaaagtaacaagataatttaggcaggtaaaatgtaattaaccactttggaacgtgcccaagtgataatgtcttcctccccttattctccatctcctcccccactccctggttctttgaccttaaattaaatcttgctggggtttctccccagataatacttaatagattaaaatcacggcaatgatatattttcagtatgtttgagaagattaaacaaacaaacaggaaataaagagttttgcctctgaatgctgaaagttgtgcagaattgggatcagttttttaaaattccagtttcccactccttgtctgttttagaagctttaaatgttctatagtgatgtttgagagaggatggggcaggacagtgtctgagggtcttggtgttactgctgacgctatatggaagctcagtgttgctcattgtcaatgaaagtaggattggaccagataatagaagtggtgccctcacactctgtgacttcaggagcagctgctggtgaatgtggaggtatggagtgttagcagaggaactaattaagttccatcagcagcctaagcactggccatagtggccgtgataaagaccagaggaggcaggcccattcttgaagacacttttcttcatgattcaaacacatcgcttccagaaaatggaccccttgaagaatgacaacttaattgcctaatgattggtgggtattgagcaaaataggtgtagtcacttacaaagtatttggcagtcataatttgaagactatgtactaacatgggaaaatgcttatgatatactcaagttaaaaaagaatgttttagaaatatgtgcatggcatgattattataacctaagaatttagaaataccctcaaccaaaaactaaaacctcctggaaactgtaaagaagcacaacaacatgctgttggtggttatgtgagagctatggagttctgtctcttgctctgttttttaaaaatgtgttttccaaattccatagtgtgattataatacctttacaaatgaaaaaaaggaaaaactgtatagaaagaaaaataatgtgtaagaaacaacagaaaagaaattcatgttgaaaaggcttagtacctttctcctataagcttaagtggacgcttcagtttctgaccgatgataattaggcaggtaattatcattggtcagaaactgaagcgtccacttaagtttatacagtaatttaactatagttaaattagttgaactgtagtttaacatagttaaattagttgtactatagtttaatatagttcaaaataatttatatgcagtcagttctgtactgggtttgagtgtcaaaataattttaatgagtaaagccaagattgaggagaaatactcaaaacataatgaattttatactcctatttcccccaagctatatatatttctccatggaaagctatattgtattactttcagcatttaaatattggtctctcattaggttgagagctccttgagggcaggaattgcatagaagttgctcaataaatgtttgttgaattgaaatcctaaatactttgattgtccttttaataaaagagctattggtgagcagcaagtgacaagaagaggaaatttatgtactccaacattccctctcatttaaaaactctttttggttcctagaaaccagtgaaaacattttacttgtttgcttatggaattggttcttccatccacatcaaatagaactggccaggatgcatttactgatgataacattttgcactccaaggcacacggacttgaatatcataacatggcctttgaaattttctggaaactctgtatcaggtctagttccaacaaatgaatttagttcagctaaattagtactgtagagactggttgaataagttttttctcccaactggcattaatttagagtggcttcttttttgttcttatagcatatgtggtaagttgctctattttgctcataggtgatgtaggactgtacctgtacaccagttgtatacacagaggacgttcattcactttgttctccactagaaatggaacagagatataatgctgtaggccttaagattcagctatttacaagcagctggatagaaagtgtcaactttaaacaatgagagtcagaaaatatgattaagtattgagtttattcgggcgcaaaatttgaggacggccatacagaaaacagacttcaaaggaatgggctcagtgttcccaagtggggaagttaaagtttcacctatataggcagaaacagagaagtttagtaaggttcgacattttccatagaaagccagtacatatgttacagtgatttgattgattacagtttgctacatttcaaggaagattgcttcaacatttcatgaggaagggtaatgatctgagggggtcttatctctgatgccatttggttatttctaatcatttataggaaaaagaagttgcagctgcctgctgcatgactcaggccacatagttatattcctctcaaggctcaaaataatttaaagttccaatagctttaaatttgaattatttaatttcacaggatgaaaaaatattggtaaggaagtcttagaacctcaggacaccgctagggttctgaagaaaatacagatagcttaatgtgatatgtcattccaagaatattaatattttagcaggggcctcttgctttacccaaaagggttatatcatagcatgcaggcatttgcacactgtatcctcatctgaacttatttttgcaggtagcaatgggtaacatttgttggaggtagaaagaaacagtcatctaaagtatatgttagagattcaggatgctaaataagaggggatcttcaacaccatctctgactccttttattttaaaacgtgatcatgaggacccagggaagtgaggttatctgctgaacatctcccagtttctcagtgtcagtacagaattataaccttctaatccagtgctcttttcaacagagcctgtttcattgcccaacatttatgaagggtccctaaatttacctagaaataaattgcaatattccaaagaatgaaatacacaaaactatgaatagtacgattacttcatggctgtcctattgaagcctgatacataatgactaccagagaccagctgcagaaagaaaacccattgtttgtgaggctagcaccacatagcttttcaaatgagaaggttctgtctaacctgaattcttcatgctggcattttaacttccttccttcctattagtgaacttgggctattgatttgcagcaaatgagtctgtgattatggcccatttttttgtttgtgtgaattaaagattttactgaaaatctttaagagaattaaagcaaatagaataaattgtttggagaagattatccacgttttcttataggcagacactaagctctttagcatgtaatagactgtttaaaatgaagaagtctggaattcaacagtgagtattcttcatatttcatggatgttttccacccatgttcttaggcccataggcttgtatgttttcactctaagaagaacctgttagtgaaaatgtattggaaaacagactatttaagtagtagcaagctgttggtatgattattttaggctaattgtctcagccatatgtttagaaccaggtttaaagactactttatagtatttatttagttgttgtatactgtatagtcttccattgcctgaaatcaaattattccaagttccaactagagaaaaatatgttctttctgatattttaagaatcagtagcaaaatgcactctattactttacttgaattgtttctttgctgagtaacattatttgcatgcagacttagaatgaaaaccttctgtgaatgatctttgttatgctttgagccctggggtaagaggagggaattaaatgcagaaaaatacggagtggtatttttaaatttgggaatattagggtttatagtgaggagtaaaagagaattttctttaaaatttacagcacaaatcgttgtattttaaatgtattgttaaaattgatccttttggggttctagtttaaataaaaacccataaaaacatggaaattgtctgttaaaagtcactatggagttgcaaatggagataatttagcttacaaacttttaaatacatagtatattattaatttaaaaaagagaaatactgatttcttatttttccatttcttttcagctactcagtgactgtgcaagagtcatacccacatccctttgatcaaatttactacacgagctgcactgacattctaaactggtttaaatgcacgcggcacaggtaatagaagctcaggcatgtttgtgagtttggctaactgggaatagattctaatacagagatattaatgacagcagaaagtgcatccattcattcagtgaataggtattgagggcttgctcctgtcttatttttgtgccaaatcacaggggatgtagaaaagcagaaaggtagcccatgccctaaaggagcttacagcctaactgcagagaaagtgtctgctgtttaccatcatttgttaacaagaattcatctagcctctgtgttgcgcataactgggggagacactgttacctatggacagcagcagatgtcaagcaattcatatcttcgcatatgtttccagttgaacatctgactcaatttaggctaacttaaatttgacccttaagtaaaacaagatgtattttttttctataaatgtgaacacagaaacaaaactaaaatataattaaatattaatgttaatatagaagggaactctgatgccctaattttattggtagtatactaacatttatagtgtatgagttatgccttgagtgcagcatctgctgattgtactgcactaaatgatgttatgctcaatgtcatttcttcacacaagctggccttggccactctgtgtaaattagcatttcccgcctgtcacattctattccctgactcaggctttatttttcttcacagcatgtaatcattacctgccattatatgatctaatcatttgtttaatgcatgtccttactttaacaaattcagccagatctgtcttcccaagtaaaatgtaagttccttgagagcaagggatttgtattgttttgcttactgctctttccccagtgtctagaacagtgcccaggatatagtaagtgctcaataaacacatgctatgtaagtgaatcagtgaataaatggcactttagttcaatggagaggtcttttgtctgttagtcttctatattataatgggatgagactgccctaaggtttttaagggaattctctgaattcttcctttaaaacatacgtaagtgaatgatgctttgatgggtatcatatatgaattaatcaatacttttcaacatatcttaagataagtgaaagagggaaatcatgaaactactgaccccttaaaataaagcatagattggcttcaatagggaatcttaatatcttcttagcaaattgatgagttagtattatattggtctagacatgtattccatatttcttcataactagtttgaaatactttgcttttcagacttttattatgtttaatagctaatttttccttctctatagagtcagctatcggacagcctatcgacatggggagaagactatgtataggcgcaagtctcagtgttgtcctggattttatgaaagcggggaaatgtgtgtccgtaagtaagactgtcacccctttgagattcgctagtttttcccagtgctggtttgcttccattaatagcagctgagacagaggtctggggagatgggtgtcttggaacattccttttccctctggttgctacttttccttggcttgtgtaatgaaggaaacattaactctgtcctcctgtcttatccaaagtctccaaatgaatgttgcttaaggtgaaaacagctgttacagaaagatgattcaaggccggatgtggtgatgtaaattataattcttcaataaatgtctcattggaaattggtcaggactcattggacctgggtcccagaagagaacagagacctaactttcctgcagctgacctgagtcaacttccgagaggccagcatattcttttctggtgcacagaatgatgaggcttattaaatgtagaggagttttcacattaaaaaatgacaataagtctgcatcacaaaatagaacttcttttcattgtcattttccctcttctctaccctccccacttcaccagttcattctgagatgtcttgagagaagtttcgtatcttatgacacacttcagagaatcctagaatatgagatgcatgtgagatgcagtttgcaattgagatttctttctttgtgtataggtcacttagaagagagatcattaaagactattttatttgagtattatggctcaacacacaggtagagggacagctctgctttctgagttgagatgctgatgttgagtagcacagagagaaggttctgctgtaatttggaggcaccaggaatgactggatagatctcagcttaagaatctggaaagcccagtgatatcactggttctaccatcacttggctgggtggcctcagataaaccatttatacgtcttggaggttcctttgctgtctcagagatagggcttggaatagtacatatctcgtctttcttccaacccctggattctattctgtatgcagacaggggcagctccttagcttggattcagaatcagggctatatttaataatacatgttcatagaaagaaaaattagaatatgtaactaagcaaaaagaagaaaataaaaatacgttgtgaatatttttcctggtcagtaattatacttctgtaacatattgcaaatgtcagtatattgttgcattataaatatttgtttaatcaatctcagctgttgaatggtcacacaatttccaaattttacctatcgtaaactactctaaaggacatcattgtggttaaataattgttcatatccttcattaagtaaagataaattcctagcagtagaattgctggattagaagtgtacatattttaagactttcgatgtatttctaatttaaatacccaccagcagtaaatgagaatggctttttgcttataccctgagccaatcttcctttcactaattttttcttaatttgcatttctttgattaataatgatgctgaataagaaaaattacatgtttataatcaaacatcttagagaataatcatgagcagatctcagtggcccaggctgatgggaaattttcaaaagaaagcagtgtggagtacacacaggggtggggattggggaggcctggccactcaggctggccatttcccagaggccttcagtgacattatcttgatgcctttacctgggttcaaccttacaagcacaaccatcaacataccaagagagtacttctgtctcccagcacacatttctattaacccaggggtcatagaatttgtatatgaagccaggatgctattttcctaactcatacaaaacttggaaaggtgcttgtgcctgtcttctggccataccttctctccctgaaggcctggcatgtgggatgctagatttcactggcaagctggtgggggggtgtagatccaagcaagctcagttagagagacagcttcaatgtttcctggcatcagccgcataattcaacacctccgttttttaactcagtagtgcagcccttcttagaaagttaggcaattccactggcactatcacgcctgaaattacatgggtaaaaatacattttctctcctgctagacagcttgcaaagcatcccccaaactgcttgaatggacacctctagcatttgcctcaaaaattctccttttttctaggcctcttgctgaccaactgcccctgagactgcaatattttttcctttagatatgctaatatatttaatcagcttactctctagtctcactggcctggaagctgttggtctctggtctctaaaatattttgtgtctctccactctgatgtcttgatttcattgcttccccacacccccaccccgcccaacaattgttacgcttctttgttcttggaggtgactcccagtgacttttctgtactcttcacagttggcacaagtgaggcaagcttgtagatagagaaggaacaaaaaatacatgattcttgtttgtgttttcatagtctctttttttctaccaagttttgctgccagacagataacatggtcacctttcttaactgtttccagtcaccaagataaattaaacacaggaatcagtcatcatttcaaattaattcttggtagtttacctagaaggaaaacaaggatgatttaatgcaaatacctgtatttgaaacaagtttcttttatgtactcaagtagcaccttcaggagagcaggtcctgtcttcccctccctccccacctctgtttcatcctgccccacccgctcctccatgatagaccccactgtagatggtcattctggaggcttgacatggaactgccagctgcctcaccctctttccacagctttctgaggtttcctgtggggacctgaccggctgtcttcgttatcaagtgttagtgacatgtccttttggttcttatcttcccctcacccactcctcccactttcagagatcagaacacttcacaaatattaaaagtagctcttcattagaaaattgtcagggatatgtttggtgaagaatgatcttctcagggccaagcatggtggctcatgcctgtaatcccagcactttgggaggctaaggtgggaggatccgttgagcccaggcattcgagaccagcatgggcaacatagggagaccccgtctcttaaaaaaaaaaagtcatcttctctaggctccagagactttactgaagagtgggctgccagttcaaagtcagctatgattgaggaaggggagctgagtggcctccaggagccaggctcaccttgtgaaggagtctatggaatagtgccagtctcagaaccataaggacagcttgtagatgtcaccaggatggtggtaggaccatgcagcttagtttaacttgttttgggagaaaagcaggtttctattctacttgtccatataaaggaagtcattgttcctttatcgtagtcatttcctctttcacaggaaaaatcagactcaacacagtagattcaattcaattgaataaaacatgcattgattgacctacaatgtaaaaaccagtgagctagaccctaaagattatgtatgtatatatgagccagacatactttctgccatcaaagagttttgcagtctaagtatcttttttaatgcatttcagacaacaacgaagtcatggttaaatttattgtgtgcttactacataccaggtatatacattatcttataaaatttctaaaacattatgaggcagatataatcgtacccatgttaaagatgaggaaaatgtggctttgagaaattaaataacttttttattctgatcaatcggtgatgagtggaggaggaggatgcagatatttatgctgaacagagaatgagatgctttacctaaataaaataactgaaattggcagagtagcttatgaaccaaggattatccaactcctgtccatgtcacatgttgtcaagaaattctcagctgcatctcattacatgacttcaaatatttaaataaaacatacgtattaaataatttcgacttgaaaaaaaaagttgagaaaattctccgttctctatgttcaattccatctctctttttaaggtgactaaaattagtaaaaatctcttttcttttgaaattggatttttaaaatgttcttgaaaacaaagaactttagagaaattaagtaaatagatcttacacatgcggtgattctgtctacatcgaccagaggactgatcgctgaccttacaggtatcgttagtggatattcaggattgttgttactgctgcagtttctaaacttttgggaaatttagcaaggcagcctagtcaggtgctcctgccttctctgtagtgtcaaggttccagggaaaaggacagtagctcagaaagatcctgaagattttaagtttcatattaatacattgagggccagagcgtcctggagttagtctttcatgtagattcacatggaaactgtcccaggacgaggctctcatttcatgtttatgtgcaatagaagcagcaggtggtcactgaatggctcttcattctgtcagctgtggagattcttggagaaaaaactctagttttcttgtatatagagcatgatgaagagactggctctgcttccgactggaatgagcacacagaacttttggggaggctggtaaaatgcagattctgattccatgggtccagagtggggcccaaaggtatgcatttctactgaaccctcaggctgtgtggaactcctggtccacagagcagactttgactaacaaggctgtctgtccgaaagaccaatgcatgtcatcaggcaggaaagaccagagcagagagtgtgggcaacagtgtggttagaagccttttcttagaatgtgattagaaaaaaagaaaggattggaaattttttaattaaaatattactaggacaggaagaaatctgtgattccttgtggtggttttactctgtttataaatttaattagactctaaatttgttcatcctttaagattaatattcttgcctgatctgtggtaagaatttagacatgtttcattatttttgatttggagatttttcttttatttcaattgttttttaaggaacaggtagtgtttggttatatcaataagttctttattggcgaattctgagattttggtgcacccatcaaccgagtaatgtacactgtacccaacgtctagtcttttatccttcacccacctcccacgctttcccttaagtccccaaagcctatcgtatcattcgtatgcctttgcatcctcatggcttagctcctacttaataagacagaatatacagtgtttggttttccattcctgagtgacttcacttagaataacggttcccaattccatccaggtgctgcaaatgtcattatttaattcctttttatggatgagtagcattccatggtgtgtatgtatgtatgtatgtatttgtcacattttctttacttgttgattgatgggcatttcggcttgttccttaattttgcaattgcgaattgtgttgctataaacatgcatgtgcaagtatctttttcgtataatgacttcttttcctctgctagatacccaatagtgggattgctgaatcaaatggtagatctacttttagttctttaaggaatctccacaccgttttccatagtggttgtactagtttatgttcccaccaacagtgtagaagtgttcctttttcgccacatccacaccgacatctattatttttgaattttttaattatggccattcttgcaggagtaaggcggtatcatattatggttttgatttgcatttccctgatcattagtgctgttgagcattttttcatatgtttgttggccatttatatatcttcttttgagaattgtctatttatgtccttagcccactttttgatgggattgtttgtttgttttttcttgctgatttgtttgagctcctcgtagattctgaatattagtcctttgtcagatgtatagattgtgaagattttctcccactctgtgggttatctgtttactgtggtgattatttcttttgctgtgcagaagctttttagtttaattaagtcccatctatttatctttgtttttgttgcatttgcttttgcgttcttggtcataataatttggagaattttaagtacaggttgagtatccaaaatgcttgagaccagaagtgtttcagattttggatttttttgagtttaggaatattttcacatccataatgagatattctggggatggaactcaagtctaagcatgaaattaatttatattttatatatatcttatacatacagcttaaaggtatttttatacaacattttaaataattttgtgtatggaacaagattttgactgttttgcctatgacaggagctcaggaatgaaattttccacttgtggcttcatgtcagtactcaaaatattttcagattttggagcattttggcttttgggtttttgcattagggatgctccacctgcattaataaagaaatcctcagagaaatgaaattgagaaatgtccagaggaatgaaatagttgtaatatatgtgtgtgtgtacatatacatatgtgtacttgtatatatgtgtttgtgttgtgtgtatacatatatattgtatgttttttaatgtcacataactgcctcttataaaattgctatttatttaaatctcagttcttgtacctaaataaatattgatccaaacacattccaatatattttcattaacacatatcagtttttataataaatatttatgtattcgagagacttctgtggttcttcatgggatggcttagagttaaccaacacttttttgttatatacattaatcctaatgcatgtataggaactatagttatgttagggagttagagaagcaagaagtatgattagtttaaatgtttatggttgagaaatcactggatactattctctgctttcaacatataaccatcatttgactgtaaattcaaatatggacatcctaagtggagtgcacatgaccaatgtatagttttccaaggaaaactgttatatttattatctctcccttttggcctccaataaaaaaaagttcagttcagattgttaacatagaatggagaaaacacatgaattaaacctaggttcaaatcccaaagctaccctgcatgtgtaatgtccctgggacacaacatccttgatttctgtgaacctcacttcttaatctgtaagatgggttctcatgcctattaatcatgtagggttgctgttaggatctagtaagatatattaaagtgttttgaaaaatgcaaaagacttgcatgtacagtattaactaactgaaagtgatggttctggacttgattttagtaatatttgtgatgtttggatttcaattagaagataagaattcttctgctgtagctctaaagttgagtaaatattaagccataagattttcatgaggtttaaagtaattctcatggcaattctttatcacgaatatcaaactgacttgctaaactatgcaccatgatccatttgcttatatccatgtgcttatgactactgtgattagagataataaatatgatcaaatcttcctttctagtcatataaaatgtattgtcttttacttttctctcagcagaagagtgtccctgaaatgaaaaagcctgccttctttttctgattctagctttgtaacacatgtagctattttaaaatggaaatgcaatcaaatttaaatgtagaattatttttatatcaaaaatacttttttgatttttttatctcaaactacaaaggcaatgaatttttcatacaataagccaggtcacccaaatatgctaactactattcagtatttgttaaacgtgaagtttgtgtgcttctatatgtgtaggtgggtgcatatgtgcacacacgtatatgcaatatgaaaaagcctattcagagatttactttgtttttaataattagtatttgatttactatagttataaatccaaaaacatagttgcttcttaagcaaaattcagctggcagatgtttcattcattggtctaacaaatttaacaaacacattaagaagcctttgactaatgttttataaacttaaacaccttcaaatttttaaaatggaattcgtacatttaatagatttgattttcattttaaataattcagcttccaggctgacaaaccttcccatatacttaaataatttttgtaaatctaataagcccaacttacaaataaggtgaaatcttatgaactctaaaatgttaaaatataggctggatgcggtggctcacgcctgtaattccagcgctttgaaaggtgacaagagcgagaatccatctcaaaaaaaaatttgtattagtaagattaaactttaaaataacattttaaaatcaattattccagtatacatttaaagaataaaattagtaagctgaccttttattctacggaccacattctcttaaatattataaatgtcctcttaaaactaaaaatatgaacgctatagattttgattctctctcacatttctgtgcttaactgaaaatcttcacaaggttgaaagatagttaccttctaagcatcacctcataatttttggtttaatttttaatataagtttggtagtctcttcaattcattgaatttcttgatatttatttttatacggtaaaaacacatgacattaaatttaccattttaactatttttaagtgtaccattcagcagtattaaatatagtcccatttttgtgcaacatatctttagaacatttttgtcttgcaaaacagaaactctagactcattaaacactaactacccctacccacctccagcccttggcaaccacctttctactttatgtttttatgattttgactactttaagtccttcatataagtggaatcagacttcgtcctttcatgactggcttatttcacttaccgtaaccataatgtccttgaggtccagccatatcgtagcagcatgggacaggacttcctttttttttttgttttttttaggctacacaatattttttctgaagattttaaatatcagagaacatggtccttgactactaccttgatggatcatactgaacctaccacctgttctagatggcgtacccagtattcattcaatgtaagacatattatttcctagtactagtttcaaattagattagaactctcaatccagttggctactctgattgattaaatttttgtgcatatctttggtcattgagatatgtaaatatttttggcctaagtaccatgataactgacagaattatgtattcttttaatataattcttatatgaaaatcttataagatgtgtggtcctttatttcttgtaaatgttaaaatgatatcccattgcattttccaaatttcacggctatgtttggaagtgaaatcacaacctctaaggtcatcttgttcactctcttccactttgcctttgggctcatctcacatatagtctgaagttacaccagtgacactggtgtagctctttctccagggtgttaatttcatctgcagtatcagcaatctctagacacttcccatttctttgtccccacctttcagcctgcccaaggctccagatagttctctaatttagaattttgaccttgttcctaagataaaaatttgtataactcaagttgtcttgaatattgtgtgtcccaagcttgtctgttaatgtctgttccctcccaattgctgtgcctgtcttgcttcactttctccttcttttctccctgccccttcctgccctccattccttttttcttccttccttggttctcttcctccttttgtctctcctccattttttccccttcttctctccttcctttctaagcagcaggcacaccgaagactgaaggatgagtaaatcactgttgatgttcttcagggctcagtctgtactaaacagaaggaatgaaatacaaactgtggaaggaagggaaagacccctgggcccttcccttctcaactgtgctacactgtttatcagaagtaaaacacctaggccacttcaaaaaagacataaatttgttgtatatatatttttttcattgatttttaaaaaaattttgaagttgtagtttttgtggatacatagtaggtgtatatatttatggagtgtatgggatattttgacacaggcatacaatatgtaataatcacatccgggtaaatggggtgttcatcacctcaagcatttattatttgtgttgaaaacaattcaattatactcatgggggtagagagtagaatgatggttaccagaggatgggaaggatagtgggggtggggtagggggaaaatggggatggttaatgggtagaaaaaaatagaatgaataggatctagtgtttgatagcacaacagggtgattatagtcagtaataatttaattgtactttaaaaaataactaaaagagtaaattggattttttgttgtatatattttttaattacctaaaattatttttcatactgaagctatttttttatctgtgtaaaaaactggaaaacagatgagcaaaaagagaaaataaatcattcatagtcctgccatttttgtttgtatctttccggatatatttccatttctttaaattcaatataaatttgtaggttatgccatgcatattttttgtaagctgctttgttcatttgtattatattgtagacatattttcttgtctatcaattacatctaaataataatcttataattacattttactatattaatatatactaacgttaggcacacgtagttttgcggctacagggagcatcattttatttatccctttgcatgtgtgagtgattcatacaataaattattttaagtggaatttctggaatgagaggtatgcatactgtatcatttagaattagatttggctatgtagtgcctagaagtaggcaagccagcaggggactcaagcagtttttacccttctgctccaccatctctttgtcacatgctctcgccaagctacaagggcatctttattctgccactcctgtaacttcacactacacatggaatgagcccaaaggcaaggtggaagagagtgaacaagatgaccttagaggtcatgatttcacttccaaacatagccatgagacttgcaaagtgcaatgggacatcattttaacatttacaaaggtatggtcttcatttccatgtaccattattgacctccacacatcaacagacggaataggtgggagaaagaggcaaatggcaatgccaactgtttcctaaggaaggttcctagcagtgatcatgttccttttatatcccactggtcacttggtctcaccaagctgcaaatgcatctttagtctgtgtggtcagaggcccagtaaaaatatatataaatatatatatttctctgggaagggtaaaatggatattgggagacaggaataatcttagccacatcttaatgcattttgagacacattgccaaattgctgtccagacaggttgtaacaacttacatgaccaccagtaatgtatgagggtacccacttccttacatttctgctgacctaggtattattattgctttcaaccttttgggtgaaaaatggtacctagctttattttgcatttcctaatcattaataatgctgttcactttaaaaacttatgtttattgctgggcatggtggctcactcctgtaatcctagcattttgggaggccgaggcaggcagatcacctgaggtcaggagttcgagactagcctggccaacatggcgaaacctcgtctttactaaaatacaaaaattagctgggcgtggtgatgcacacctataatcccagttacttgggaggccgacacaggagaatcgcttgaacccaggaggtggaggttgcagtgagccggagccgagatggcgacattgcacttcagcctgggcgacagagtgagactgtctcaaaaagaaagacaaaaaaaaaagcgtttatttaccatttgtattttggctttagggccaggaccagggtgggagatacagtgagactgccttgttcttcagagagccataagaacaatgaatagaagcaacaggggacagtggcaaatgaaagagaaacaggttgatttgggggctgataaagaagacagtttgagagagagactttactaacatatgccccagagaggtcagttcccatggatgtgcccagcagcagcagcaggaggcccaggcccttcctagctcttgcactcatcgacatcacggatgctcattctctcctcaccccatagttccattaggcctcctttcccaagacctcaactgtctgcagtttgcagggatgatctggagccagggaaatctcttgtcttctcctactacctacctctcccatgagcattgtggatagaggaatgatctctgatttctggcagtgaggtaagctcttggcagtccaaactgatatgtgaatggcttgacctatggaaaggagagagactcgtgatccccacatactgtggttcattcaggcacatgctggaataaatgaacaactattgaggttgccctagggacctaaccattatttacaacattataactccaagaaaatttacacaactggtttccaaacacatctttgaaacccgacctcttagcatgttggggactgcttatagatttagtgacatgggacttggaaaagctcacaggaaaagcagcagaagagcagagtgggaagttggcagctaccctctgtgggaaggattggttaatccagagagaaggctggccatacattctcagtcggatgttcttggcttcatctccactgatggcagagaaagcgaatcattgtaagcagcgctgcttgcagcagaatcgtgaatggacaaaggagatggccaggggtcccttctccagtccagctcccattctctttgccccacatgccttgtcttctcctgctggatactgctgtaaaggaagggactgttctgatgattattttctttggggtagacttaagtctgctaactctgtttttgttagatggagaaagtcaaatggtaactcaaagttcaagttctaatgggggcgtccaggcaagtgtggcttgtaagaaggacagagggaagaggtttggggactgggtaactcactttattgcctggcaggccagctctgatggtgagagatcagttcccatggatgtgtcctgcctgtcgttggcactggttaagagaactttggaaccgtaaataagaagccttaactcccacacactgaactgtgtatgatttcctgttcttaacagaaaggagtgtgacaattgattaccagagcagtgaatgaatattcacagctgatttttaacttggccaacttcatgtaaaactgaaccggctgtgggcagataaggagctggaactgtggttggtgtctatatgaaaaatagttctgtagatgaactttactcttgtttgaatgtcatgcttcagaaaacaatgggttttaagcccaaattttgaggcgagggcttaaaaaacacctgcagttcactaacccaggactcttttccttccaggaggcagatatgctacacaggtggcactttgggagtcacaataactgtttgccatataatacgttttcctttatttcttctttttaaaattggaatattatgttattttagactggaattaacaaaaagctttcttttgggaaagggagtgctacctcttggaagtggctgcctggaacattgtgtttagaaggattctgaggctgtgtctgggctaagagagaaagagcaaagtgactcactagtgatttctgccacgggattggagtggcagtgggtggcccgagtgcgcctcatttgccatccctgtatttgactgcatagtatcctgtggcattctggaatcatggagatagcaaccgaggctcctgaatcacacacctggctaaaggctcctgttatacctacctctgtcatttaagtgagaagttatatttactgttcttgctattgtccccagaaaaaaattaccttcctttgtgagctggaatatttgacatgcttaactcgggatcatattgtcaacagttttgtgttggggatgggaaaggattttcaatggctatgttttgcctcagtgtcagccacaggggggtctgattaggagagggattggcaggcttgagcaaattgggcacggcttctgggaagagctgaactgaagatagtttctttccctaccttacaattatgtgaggacacatttaattatttatcctggctttgtatcattttggtcttttcctgctgaaaagtttagggcccagattctttaggctgagaggagctgcagtgcagggaagatgccttgttttggggtgagaagagttagccttcggcagaggtctgtttaggggaaagctaggctccttgggtggatttggggaagcaaaaggagagcttcaggaaaggaggagtacctcttattggagtttgaggcagacagagccttctgttttggatttgtttgattctctcaggcttgtttaatgataaaattgtgatcttgtcaaatattaaaaaaaaaaccatagtcttttgatccatttaagcagatcctttcgagtagagataaaagtgagacaatcctgttaagctagtcaaagagagcctgactgacaacaatcagatggtatgttcccaaatatacctacccatgatgccctccctgccaccggcattgaatttttttcctgtttccatagggaccctgtactctgttgctatggtgtccgacgtggttcagaggaacctaccagtaaatacaggggaaggccttttgtccacataccgtgccagcagaaattccaattttcccacacatctatcggaacctaaacttctgctttccagtttgggtcgttggtctctgctagcagggaagataggaaatctaataaataacaagaaacctttgttgctttactgattgacaatgcttgctcagtgtttaggattttataaatagaaactaagaatttaatttttaaaaaatccactataaattcaagatagcctcaatctaaacagaaggagatcatatctgctgcctatttttttttttcttgagaaagcctgactttagagtcccatggagacagggtcaaaaggaaataatgaaaaaatccttgccttatctctagaaaattagttcctgaaattgcagtctttgcaggacaggtaggatttttacaggcctaataatttatgcaatccccttgcagggatagaaaatggctaaaataaaagccaagaactgagaagcaatttttattgtactatggttcaaatcttttcagggcaaagtaatttaaaaataatggaaaaaacacagtttgatctaagtgaccaaccacaaaacattgacatgaccaggtggtgacagaacttgcatgtttttagtctggtatagcgccggccagcgcttttacagataatccagtggtaaacctagtgcatccatctgggccacacacaagagatgctaaaggagggagagattgatgcgctggtagaatcaatgctgcactgacattcttctttcctttggttgtagtagtagcccaaggtccagacctatattgcttattgataaccaattctaaaaaaggctggaaaaaaatcagagagctccaagagagttaagacagagaaactcagacttcttgattcaagtgacagaaggcagcattagctcaaggtgggcctccctgaccggctggccacgttggaagggcaaaagtggttatggcaagtttaaagatatggccatcaaagtaatgtagatttaagctaaaaaacaatagctaagttaatttattgtacttagcatgaaattgagggacataaaaggaaatatgccaccatgaatgaaacatacatgttgatccagggaggagaataggtttccagaaacttggatcctaggcattatctgtagttgaatccctctagtgtgagatatggaatactcatcctgcagaattcactgttgcattatccagttagtttgggaaatgcagtatgttggatcccatttcttgaagatttgcttcagcctattaaaggctctgggaatgcctgcagtaaaggcatgtctcaaacttttttgaccatggaattccttactccctataccctcttcccttttctttccccaagaacataagggaagaaatagttctctggatctacttacttggaaaacactgctttgagggattttgttttctgtaaacatacactgggtaattttaaatatttataatttatttgagactctttggacctgtaatttcttctaaggacaattatattatctgttctaacaactcaagaaagggaaagctttagttgaagctggaaggctataatagatacttccttacctttgctatggcatggaggagatgcgtattttactgcctcattgatggggacaacttcttctagacctctcccccaaattttgaactattatcaacagaggtattttatgacaaacagttgttcaccaaaagtagagctgtcaataaatatgcatataaagtggctcctgatgtgaaattcaaaataactacatgatcggttaatagggtagagagaaagaaaagaatcaaaatagctatataaatgatagatcgggcagctgatacagggtcaaaaaagtgaaatgaagacaaaagggagactgaggtgggaggatcacttcagcctgggaggtagaggttacagtgagctgagattgtgccactgcactccaggataggtgacagaacaagaccctgcctcaaaataaataaataaataaataaataaataaataaataaataaaatttaaaaacaggagaaagaaaaaaaaaagtgacccatctaagaacttaaaatccctttattctgtgttcttttaggaccatcacttagcaggggctggatgatctgatgcataattgtaggggttttagggcccatacaattttatattttaaacaattttaacttaaaacttgagactttcatcttccatggaaaaatcaggctattggtaacactggcttgatattcctatgtggcaacagacaagaaactgaaggaaagcatcccactttggatgagcaagtgctccctgaatttccccaggtctaacctgatttgtaatagttctttaatttatccatgtggcctctgaaggcatttgagtttgtgttccctggttttggggcattctcatagcaaaggttctgctgccagctttctcttgaaactgtagcacttctccttttgaagaaattctaactgcttgatttatacatttgaattaagactttcataccgaaatgcaaaggttcctgacaagggaaataatctcagctgttgttattagtcattgactccatttattctcaagctggtgtagacagggaaagagagtggaaagaacatgagggcaccagagttctagaggaaatgtccagggaccaccactaaggagggagaaggggcaaaagaaactgagtgggaaaagtggtactctaattatgacttccactgccctattaactttctctagggctggcctttattattcatatgtgattcagatgtattggataaccggaagcaaaatgacagcaagatgaaatagggcagaccaggggaaatgccatgtggtggaaaacatgctgtgggaaacaatatttgtaaaagaatttatggctccatagagagtggtcagggcaagagaaatgccattctaaaaacagaagagcctgggatggcacttcctgtgcatagaagcgtcatgctttccttatagacacagacatggcaggaccagctggtaaataatttgtcccaaatgaaggtaccttccttctgatttcttccctaaacaatatgctgacgattttgaaatccttctcaaattgaatcaatttgcagttgtatcatcagacctgttgtaggttcagttgttaggaatttgtgctcaggaaaactagagtttattccagtgctggttaacattttgatgttttagtccattaaggtcatgttacttacgttacttaaatctgactcaacctatagagacacactgtgagagttgtggccagaatagataatgcctatgtaagtgtggaattaagctaaaaactctttctgttttcaaataaatgaataggattatgtgccccacagatggtatttcaatcccttgtgtgggatccattacaacagactatttcaacacaagctgttttgtttttttttttttctgtatgagtcaattactttgtagaggaaaagcttagtagaacatcacattgtcattttttagtattagcagttccccaaataaatatttattgggagggtctaaagccaataccttcataggcatttaaagagctctaccctccagtgatgacagactcttagttaaattgaatagtatgtacatagaggatttgagtgttagctcagatttttttttttctctatggagagagggctctttgcctttctgtaaaagttctcctcttactctagggtttttttttgttgtttaaacagcttcatggaggtaaaattgacatacaataagctgcacattttaaaaggtacaatttgataaatattgacatatgtacacaacccttaaaccctcacctcaattatgatagtgaacctatacatcacatacaaatgtttcctcatacccttttgtaatttctcctatccacccctccctgctcaggcaaccattgatcagctttctgtcactctagattgcttcgtattttctagagctttatataagtggactcatagagtattctcgcttttatatctgatttcttttactcatcataatcattttgagatttatgacattgccctatgcactgttagctcattcctttttattgctgagtaggattctattgtatagctataccacaatttatactttcatgtacttagcacatttggattttttccagtttttgacaattacacataaaacttctctgaaaacttatgtacacatctttgtatgggcatacatatgctttcatttctcttgggtaatacctggagttggatggctgaaccacttggtagttgatacagaagtgttcagagatactttatttgaaatagccaaaatctggaaatgtttggtattgctttgaatctatacaactattggaggagaatcgatatcttattaatagagtcatctgactcacaaacaagtgctgtctcactatttaagataatgtgtatattgtgctgttgttgggtaaagtgttctataaatgtcaaatagatcaaattgattgacagcttttttcaattcttctttactttctctcaacaatgttgtttgtttttagtgtacaggtccttcacatctttggcttgatttgtccttaagtatttcatattttttgaggttattgtaaatggctattcaatttctgattgttgctaatatatagaaatataattgaggttttgcgtagtgacttttatctgtaattttgttaagtgctctttttttagtagtttttttgtaaattccattagattttctaaatacatatatttacatagtctgtaaattaaggcagttttacttcttccttcctaatctatataagctttatttcttttccttgccttattacacttgctagaacccccagtatcatgctgaatagaaattgtaagagcaagaatccttgttctgttgttaatcttagaggaaagcatttcattcttttaccattgactatgttagtagtaggttttacatatttgccctttatcaggttgaggaaacgcccttctgtttctagtttgcagaaattttttgttaggaataaatacatttttctaaatgcttgctaaatgcaggcatcttttgaaataaccatatatgtgattattgtatcattcaggtctacttaggttatatatatgtatatgaaggaactatatatataggttatatatatatgtatgaaggaacatatatatgtgtgtatatatatgtgtgtgtatatatatatatatgttggaacaaacctcacatggtcataaagtttaatccttttacatattgttggatttaattcactaaaattttgtttagaatctttgcacctatgtgagtgatacttgtttgtagtttgtttctttcttactgcaaatgtctctggttttagtgttaaggtaattttggcctcacagttgggaagctgggaagtagtctctggccttcaattttctggaataagttttttttagaattggtattatttcctcttttaattcttggtataattcatcattgaaaccatctggaattggaggttttttaaaatgggaaagcttttaactataatttaattgctttaaaatatataggtccattcaggttatttatttctacttgaataagctttagcagtttcttcatttcatctaggttatcaaatttattggcataaagtttttattaacatttacctgtaaaaaaatctatagattttatggcgatatcacttctctcatttctaataccagtaatttgtgtcttctctctttttttcctggtaagtatagttagaagttgatccgttttgctgatcttctcaaagaactaggttttacttttgttgattttctcttttgcttttctgttttttattttattgatttcagctttgatttttattatttcttttactccccctttcactggggtttaatttgatctttgttttctagtttcttaaggtggaagctgagataatttcagagttttcttctttcataatgtaggcatttggtgctataaaatttcctctatgtgctgctttaagagcatttgacaattttgacatgttgtgattttgttttcatttactttaaaatactttctgattaatatatcttttgatttcttcattgactttgagttatttagaagtatgttattcagttccaaatatttagaaggattttccagatatcttgctgttactgatttctaactaaatttccttatggttagaaaactgctttgcatgcgttgaatcttttaaaattgattgagatttgttttatttcatagaatataacttgattattgttctgtatgttcttgaaaagcaaatatattctgctgttattgggtggagcgtactataaatattaattacatcaagttggtttttagtttcaaatctactatatcttttcttattttctttttaatagttctatcaattattaagactagttattcaaatctcctgctttaattgtatctatttctcattgcagtttttgaaactgttattagatgcataaatgtttaggattattatttcattataatgaattgaacatgttatcattataaagtgaccttcattatctctaataatagtctttgttctggaatcttcatttgatattaatatagctactccagctttcttttgattagcgttagtatggtttttttttttttttacatacctttacttaaaaaaaaattattattttttttttttgagacggagtcttgctctgtcacccagactggagttcagtggcgcgatctcggctcactgcaagctccgcctcccaggttcacgccattctcctgcctcccgagtagctgggactacaggcgcctgccaccacgcccggctaatttttttgtatttttagtagagatgaggtttcaccgtgtttgccaggatggtctccatctcctgacctcgtgatccgcccgcctcagcctcccaaagtgctgggattacaggcgtgacccaccgcacccggccaaatatttgcgtttttatcaagtgtgtttcttgtacttataagcagcatattgttaggtcttacatttttaatccaatctgttaatatctgtcttttaatttagatattagaccatttatggttaatatgattattgatgtagttagatttgatttcttcttgtcctgttttttgttctcatttttctcttttatacttttactttaagttgaatattttttataattctattttatcttcttcattggcttactagctataactgttagttgtattgtttttgtggttgttttggggtttatagtatccacatttaactgttctcacattgtaatttgaggcaaaatgatgcttcagggagagaatgaggtatgtatctaatggccagatttctaattcccctcatatcttttggtcatcccacttgcactaggtcgtgacacctttacttaaaatgtatggcagaagttctgagttcttgtatctcctccttatatagatgggtcttccatttttctgctagtatagatttttatttaatttagtaactgactcacctgaaagatcgttcaaaagagcagtgtattagttacaaatcatgttttactgcaataaatagagatttgaaaaatagaaacatatacataataaggatccttatgtcatgataagtctggaagtgggtggtttatggcacttatttatccatgcaaagaattcagagtgaagggttccatgattctcttggtccttccctcagagttgcctggtgctttttgcagattcagccatgtcttcacaccgggcagcaggaaggagaaagagaaggggagtcgcacttaccacctgaatctgtctcttgaaactgttttccacataggcatttcaatctagaaagagggacaataaatgtagtttattgctgacgtcactgctggccctggtacaagtaagattctgttaataaaggttgaaggttagacattgggtgtacaattggcaatgtctgccaaagatactgccagtaatagctctttgtacttgcccttaaatgacacgaaagccctataaggaatggagagaaaagacttatagatacaaagtttttgtattattattattacatttactaagtgcaaacatctaggttcctagcattctcaagctctttccaccactgatcagccatttatggacatcacacatgtggaccactggtggctgtggggtaagagcccttgaccccaagtaaaacgttatggaacttcagggatgggatgcaaggaaaaaagtgtgtgaagcagctgtttttgggcactcctccctgcaacattatttcaaagatatccactttttcagctcagatgttttatctttcatgagatccccttgatctcaccccagttggaattaactgcttccacagtccccacagtattgttataacagttttgttgagatgtaattcacataccatacaattcaaccatttaaagtgtacaattcaaccatttttagtatattcacaaagttgtacagccatcacataatcaagttttgaacattttcatcatctcaatacaacccctgtacctactacccatcaatccacgttaacccacagccctagacaaccaactaatatcctgtctatccatatggaattgtccatttggacatttcaaataaattgagtcattcaatatgctctcacagtatttttctgaaacctctcttattatccctggattctactctgcatttattgagtttgatggatctacatcagatttcctttacagactaagagttcccagtctgccatcttaatatacacagtagtgcctatcagtgtacctagtgcatcagtacatattaaactgaagaaaaagagaattccctttcctttttataagcaaacacaatagggtaggctgcaatataatgtttggaaatatgaaagcaaaacgattcctgtgcactttgtaattttgtaaggactttgcatgtaattgtcctcagataaaagtgtggggaagataaagtatatcttggaagtcaactctctgtttgcttctttctccttcctccttcgaatcttctgactcctgactcctggccatctagtacacctgccatggtatctgacccagaacaccctctatcatccttttcacccctactccctctcactcccattaaaatccatcttatgttttggtccactgggagtcagggaccagggtttaatcctatttctgtctttaataccaactatgaatattggggaaattacccattttcctgatctgttttcttgtctgaaaaatgtaggaatgatgctcagtaaaggcacctttaactctaaaactctatattcctctgtagcaactcactgaataaatgagagaaaataagatttgtgacttacactctttgctcatagcgtcagaataaaaggaacttctggtgacagataggttagctggaaggtttgtgtttctgttggataattgttcctttaaaaaactattttgattctgaaaacattttccatattaatttaaataaatatattctttaagacaatggtatatactctctttagagatataattgatttataaagaaggctttagtctttctactcctcctttcacttttttgccatccctaggtgaaaatccaaagggaattgtatgtggcagaagaaaaactattgagtatagttaatggctctcagtattaaagccaagtatttacaagtaaaaggaatgaggtccatgtcattggtaatgggatttaaatggatttaggaactgagactgaaacaggagcctaattagagaagattccagggtcatcatgtcagtgcccacctgtccatcaggcagacagactgtccacagctttcatttcaaagacatggcctgttcttctcatcagtgtctcttgcctcctagttcttgagggaaaagacgtcttggctgccctgtgcagcttgctgtgtctgaaggagcatactgagagtaggttgagattcagcttatatctggcctctaaaaaagatctggactcagaatatgatctttaatgattttcttaaagatcggtgcagaaaagaaatcatattggatagattatctttgcttgttattctagttttaattgcccttttaaaaaaagaagaaaggacatgggtagggaataaaatatctattcccattcatgggacaaccacacttataatgggtcctttgtacctattctttatatctctgctactgaacatctgctaagtggacctctgttcccttttttcttttctagttcattttggggttttctacatgaacaattaatgtctttagcctatattggtttttcatgtggagcatgttagttatagaagcagcacccagagtaggtggcatttgaagctgaataggggaggtaagaccaaggtagtaattgagctcagctaatctcttggtggtggtgtgggcgtctgtgtcatgaatgtgccatagtcagtgtttctgcaccttggtgagttgggacatcagagaataaagagagttctatagcttactctgccttcctctgttgcttccctttgctcttttccatctttgacgaggtttgttgctggatgtggagagcccagagatggtggaaaagggcatgcagcagagatggcacttgtataagcgagtctaatgtgtgaagattctccatcatggaagtaggattttgtgttctttccttttagactccatcccaacaatatttctcatcatttagatcattatttgcctttaggcatcaatgctcagaggtgattccattggctttagctttaattaagaaaaaagaaatcattagggaagcagattcccccttccaattcctaattaacttacaggcaaatttgttttctgctaatgacgcatccacattttgtttcagactttggccaaatgttagctcaaggttttcataaatgtaatccatattttaaaattaccatcacggatttttttaaaaaattattacaattgactgaacttcttggaattcatttcataaaacacaaagtttgcactatcaggaatcacgcatgagaacattgtgtgattatctagcaatctcaaagcattctgaagcaggtctcctttgattctgaacttagaaatttacttattatcttttttggagttaacaaaataaaagcaacaaaaaaccaatggattgggatccaaccatatgcaattctgattcttacttctctggaacatatgcttaacttgtcatgcatttatttacccaatctaataagttatcttgatattagagcagggtgctaggctggcttgctcaatcttacctttcttaccagttgattcaggtggaactcaattggtgtcatcctggagttaagagtcaacacaactacaattaaaaccaaagtttaatctccagcttctatggtgtatatcaaataagtagtgtgtggaagagaaagacgagtggtaaaaagtgaaaatgaagataaaaagtgaaaaaaatgaaaggatagagaagaaagggagagcagtgaattgagacctgtccatagaatactggaaatattctcccctcatagccagcttcttgctagatgaatacaaaactctaggttgctctgatggaatccagctttttgagtacccagaagttttcaaattctcaaatggtaatattaatccttttgtcaaataaaatcttacatagatgcccaagatataaaaacaatttaagtagtattaatataaatttaccatataaatgaacatttataacatttctttagtatgaagttaattggtgagaactacactattaaacacaaaagtctgaaattcaagaatatggagaatacttcctttcatcagccaccacattcaatttctgtgttttggtttaaatgcacggtgtcaaagaagtcttgtttcactttaaaggcaaagagtatctaatttttaaaacttctggaaatattcaaacagaattttagtagctttactatgttgaagaaggagaattggtaaacttgggtctgaaggctattcactgtaatagctgcaaacatagatgccatcagtacctaagacaagtgggaggcaaaaccctctcgtgttgacatatttacagttggtgccagagctctcactggtgggagagtctcctgtacccatgctgccatttaacacagtgtgagatagcatccagagcataccctgcactgttagacccaagcctactgtgacatttagttgaacttcccacactcaagtatggtagtttgctggctttaggtatgtacatatctaaattttaacaaaagaccagtaccttgtgcttacaaatgaatgacatctacaagttcaaacacatacctacaggtggaagcagacactgaaccctgaagttggcacatactgacttaacttggcagcaaaaatcaaaatagtgcagggccagtgtgttcatatgttacaggcaagttctgcttttaattgcaatgaaatatgtaattgtctgactcaaatattatgaggttgctaagcacttccttcaaactctagtaccagaaaactctaccctggaccagggtcccaaggtcaccagtcctggtattcctcactaaatcgcctaggtgctaaagagttgttctgatgatagcaagagagcttgtgttttccaaaatttatggccactttatttcattgtggtgtcctctccctgttggtttcttataacaaatgtatacttttcattaaactgttcctagcgaattctcacaataaagccccaacaccttaatttgtttttcagggtctctctctctaccttgcaaagctattgccccaaacactgcacccaacagaacttatttcatttgtttctctttttacctgttgcttttgctttctcttcacctaaaatgccctcccttatatatcttcatctctaaatcttatgatcaagaccttagaagtagtcatttttggttcagcaatatatgcactgtgagtgtgtgcacacgtgtgtatatacatatatacacacatattaaatatacaccttagtgcataaatcacatatattaatattaatgacatggaaatattactgccattatattaagtggaaaaagcacattgaaaaatatgattctatttttttgaggagaaaaatatgtaggaaaaaaatttctgaaggttctacatccacaaaaatgttaccagtttgagctactggagataaggcttattttactttttggtgttttatatatttgagcagtaagtcttttgtaataagacatacactaataaaatgcatctctaaagtacagagcacctcatcccacccttaaataaaattttagaatatccgaaccccaaaccctttaagtcgttctcacaattatgtatatatccagatattttaaagaatgtttaactgatgtgcatggtactaaggttgatgataatgatttggcacagcatattttaatgcctattttggaaatcatcagactgtccattcactcatgtttgcagtgatgccccttttgtctccaagggttgagtacacctaagatctttactaatgaaagaggattgagatttactgtttcccaaagacctgggtggcatttttcaaatattctcctcaacagaaaaagagcaagcaattctgctgtgtcatagttgtgaacaacgtgttcacaaagaagtgtgactattgtttctggtgaatgtattatgtaaaaaaaatcataatacataatcataatactccccatctactctgtcactctgaggccctgatatcttgctttgtgtttcgtttctctatataggcttcttctgaaacaaaaaggaatatttgatactcactgataatttttttaaagagtgaattaggcaattttccttgaaacttcttttctaatttagcatgaagtagaatagaatagtagaaatgatgggatttatttggtgataccaaaataagaaggggaattgtttggtcctacagcagactgtaagagggctgaggaacggactgaagaaaattatcaagcatgcatgttgtttttaagtgatacttgagacttggatgtgcaacagctgtgttgttggcttttttttcttgtgccaactttctttatttgattgattttctctctgacagcccactgtgctgataaatgtgtccatggtcgctgtattgctccaaacacctgtcagtgtgagcctggctggggagggaccaactgctccagtggtaagtttccacctgctgttgtctgtctcgggatgtttttgctgtaaggccctccttgtctgcagatgaccctgagccatgctttccctcttcatccctacacagagcatagtgtaaatgccacgaccaactcagtcatacagtttcttttaaatctgtacatgtacatatacattattcgttaattaagtataaagaaaagttcttggaaagaaggaaatttcagtgatcatacaacagctcatacttctgtggatatgaatgcattttctagagtagggtccacaatttagattccttacctcagtaaggcagttgtggtaacatagctattgtatcctaacttctgtttttacctgttgatttctctaagaaaatctcttggtgattaaaatttaccacctgttggtttttaactcagaagtgaaactggcatttttgacactaacatatctttttgtctctgaattctgagatgcaaataacgagtacttgttcagataactttagggagacttatctgtaataaaagaaaattcatgaaaattttggtacttgttaaatcaattcctaacatagtatataatttgtctccattatgttagaattataattctaaaatgatggtattttggactaaaagcagtctacacgtaacatttcatatgcattatcacaaagattatatcatggaatgtcatgtaatacagttgcttttctaaatttcacagtttaaaccaaaatcttctggctaacttgttgctgtacacgtaattgcatccacttccttttcctttatacttcttttttcgccttgagaaacgtgagaaggaattaaagtgcaactaaattgtaatgcgtgaaacattacattttgaaaaaggaagccatcgttttaaaaagttagcaagttcgcatgagagcacacatttctcttcgttgccaccaagtaattttttgaaattagtctgaatggacttatttcaataagctgattttaaaaatttttacttgcttattttggaattggggagattattctttatcttgctaggactacttgtttcggacttgtgatctcttggctctccttgaagcagcttctccaggggaagcccttgtgccgtctgtgcacagaacacttggtgtgaaagagccttttaactgtaccttaaacagggactgggactgtgtgtgtgtgtgtgtgtgtgtgtgtgtgtgtgtgtgtgtgtgtgtgtgtgtgtctttctgcccctgacaggcttctcaattccaggggaaaactgtcttgcagggttttgttttgcttctgttggaaatcaggaggagagtgggcattttgttcacacgccattgaggcaaaatgtttgggatgtgggatttggctcatgtccatttttctggccgactgacctcaaatgtgatgttgctttcattaacttttccagtttaaaaatcagttgtgcctagacatcttgaagaaaaataacattattataaactagtgggatagggaagagtgggcgtattagtcatttaaaactatgtggtttgccactaattccagggcaagaatgccacagaataacttcagttgtattcatactttgtctcctaagaattgcagactacctcgagctaagggctcagactgaagtgattgtgtaagcaaaacaaaagcctacatgggtttcagactctctagaactgattaggaccttctagaaaataaaccgttgctttattttggagtttaatgaagactctagaattctgagaacagatgttcttttaacactgaaatatgatattgaagcaacttttagtttattttttacaactcacgttttggctttatgatgaacaaaagcacaaataaacatgaacagatgtctgaaatgtttaaaggtgttctgagaaaaacatctttgatacctttttaagcaggtaaaaaaacgatattctgagctgaacccagaatataggtcttgctatctgggttttgtctgtggcaatcaacctaatgtcaggaaatgtatcattttgttcactcttgactagataattctggaaccaaaatctattgtctagtaatatgctacttagcaaaatttaaatggcctaatttctaaggattctatttccatctcccccctgctttggttattgttatgcatcaatttgatggtggacattagatccataatataattgctttgataattagactggctccttgtatcacttaagatccaattaggagatagaaaccacagtaatttttaaatttttaaaatacaaattggttttatttgggaacacttttagacttatagaaaagttgcaaagatagtacagagctcctgtgtgctcaaacccagtctcccccattgttaacttcttaaattactattagtttgtcaaaactgggaaactgaccatagtatattactattcaatcaactgcagatgttatttggattttatcaatttttccactaacgtcctctttctcttccggattccagctcaggccaacacactacatttcactgtcatgtctcccctgtcttctctggtctgtgacagtttctcagtctttccttgttttcatgaccttgaaattgatagtctagaggagaactggccaggtatcctgtagaatgttccccaatctgtgtttgtctggtgcttttctcatgatcagacatgggttatgagttttgaagagaataccagaattgaagtgctctttctcttcacatgatatcatgatatccatgtgacatcactggtgtcatcacttggttaaccttcatcacttggttaaggtagtgtgctaggcttctccacataaagttacaattttcccctttctgtactctactctgcagaagcaagtcactaagactatcgagccttcagggatgaagggcaggactcaagctccatgtctttgaggaaggaatatctgcctatattatttggaatttttctgtaaggaagatttgcttcttctcctgcatttattcaaacatttatttatatcagtaagaactcatgtatatttatttgacattttgggttataaaacagtattacataatttattttgttgcccaggtcattccagctttggccattgtgtcttttttttgttttgtttttagactagagtctcgctctgtcacctaggctggagtgcaatggctgatcttggctcactgcaacctctgcctcctgggttcaagcaattctcatgcttcagcctccctagtagctgggcttacaggcatgtgccaccacacctggctaatttttgtatttttagcagagacggggtttcaccatattgcccaggctggtcttgaagtcctgacctcagttgatccacccacctcggcctcccaaaatgctgggattacaggtgtgagccactgcgcccaacccattgtgtccctttgacatgactcatctttttgattttgagtgctttcttactttctggtgctagaagatattccaggctaatttttaatttttcctactgcagccctaaaatgaactatttttcaaagaagccttggtaccttttattgtagagtggtatttataaaccaagatctaggtgctggtgtggtcattgctactgcaacacagagtaactggaaaggagaaagtttaatataaagaatattaactaactataacaggagattggagtaatgagggatgggctagtaagaagtagatagatctctagagaatataggaatagcagatataagaagcaaccactacctctaaggtggacatagaatgtccaaaaaggaaaccccactaagggtgcgatccagacctgctggagagggcacagtcacagctcactcagatccagagaggtgctgtggtactatcctagcagaacttgctggaaatatgccctctaggacttttataggactttggaaaaaactcttcatggaaaagtctcaccagaagcactctgctacaaaaaaggggaagtcattggctgatgggtgcagctagccacagtgtactgcaggagcggtatgctagagaagctgtccgtgctgcaagagcttggttctggataagcaatttgtgctacagaaacaaggcattggaaaagccataggtgctccaggagccaggtactggagcagctattggcactgcgcttacattgcagaagcttggtgctttaggagccaagagcacaagtgcactacgtgctctgagtgcactggaagtagaatggaaaaactccttttgcaatgtctctctagcgccccctattgaaaatacttaacatttggccaaccagcaatagaaaaatatttggagggcacatacccatttttgtagagcaggcaatgaaggataaatttagagctgaaaggcaataaactgataactgttgacgcatactcctttggttatccaattcctatatgcaccctccacacatgtttgcattcctatacataaaaaaaacccctgtatttccacctaatatacagcaattcatcttagaagtgaacatgctcatactctcttcctaaaatgaggagatgcaagtcccaacattcattggattcattgctggttatattaaatttttttcaaattaagtcacagttctactgaatattctgtttcctagatactaaagttaacttgaaacaactagcatgtaaaacagaaaggaaaaaaagaaaatagcaaataaaataaacatatgcatataacaaacaaataacaaacattaagagctattaaaaatgtctttcatgtaattggtcacaaggtggtaactgatatctatggcttccctcttctacttcccatcccatatttcccccactctcagcccaaacttcagttacttggggttatttacctggtggagtggctcaaaccatcattactgaaagatctgcattcctacttgtcctgccttttttctggttgttgacatttgtcatcaacttcattactgtcatgggagtattaagaggtattccacagaatcctcgggttccagacctaggtgttccctccctgtgcagcagcaacccaattttcccttgataatctggatcaatcactccaaccagaagtttaactccttttactgacattaggagtctaaaatggtcagatggtaatcaattgataactgtcctacatagctgtcttttttttttcctttctaaaatacatgggtgattaagggactgacaaatactttcagtccaatttcaaaaggcttctctttgagatttgatatgtctgtttgccttggcagctgagggaagggttcctgcctgtgacaaacagtcagtgttcctggctttcctgggtctcaatgtattctctgtataaaaaaccaggtatgtcagagaattgtaaaaagtttgttctcccaaaatgaaatcatgatttatttgactaggcttagacatattccttctttttaaatttgattaaattattgtttttaaaaagcacacatgtgttttacctttattggcatcctaatgcgtatcctagcttttatgagtgaatgacattaatctattttatcccatctccttcttccctcccctcttccctgctctagctctgttcttccccccatcaatttatctgcccatgcatcaatcctccattgctcttctcccctcactggatgataaacaactcctggagggcaaaggccatatgttattaatctctgtaagcctccattgtgcctggcatgtggttggagcacagtaaaacttccatttaattagattgaaggaaccatatgattctatatgattctgagaaggtcattcatgtgttcattttgtgaactttcattgaatgattactgtgtgcaagggactgcattgaatgctggggataaaggaacaaatgagtaatggttgctgctctgacagagctcatagcttgggagaaaaataaagtgaaagaaagagaactgcctctgtagaagaagtagattgagggaaactggatggagtcagataaggtagtgagagattttctgagtggacaagggagacaagggctaagagtgtacagcccttcactttcagttggggacagaaaacagattgcaatagactactcttccagaaacttctctgagaagccaaggagaggaagcaaagaaatagagagttagtaagaagtaagtgtacggtcaagaaaaagttttttgttttcatgcctttgtctatgttttaaggtgaaaaaagactcagaagctgagaagatggtgaaagaaaagagggagaggctggagactgggttgagagagtggattgcggaatagaggcaacaaggcacctgagaagacagctggcagatgggatgggatcctgggcactgacagagagattagtaaggagtactgcccattcccaatagaatgaggaagaaaaccatggccagaataggtgtaaacaggtttctaggtatcaggggtgctggtgggcaatgggatggagaatctgaggaagtctatatcagatgaccttccttctcttgataaactgtcaggagagagagtctgctgatataaaagggggcagaagggcggttacattgatgatcatgatgatagtaatagttcacctttattgaacacttgatatgcaatcatcattataagagctttacaggaattactctcttaatggccataacatactataagatggttgcagttattgttcctagtttacagatgaggaaacggaggtgcagaacatttaggtgacttgcctgaatttatgtatctattaagtggtggagccaaacttgcatctcattcagagccagtaactttaatcaccgtggtatggggctaacggaagttggaaaacaggtttactgaaagtagcaagaatcagcaacagtgaggagaatgagagcaggagacaggggcagatgacaccggacgattatgaaaacaaaccctctgagagacgttgagggcccattaatactagagatgatgaattcataatggcacccatctagactttcctcattcataatcttgtgaatgttggggcagattctatttatgatccttttcaattctgtgattttatgtatgacttactttaagcaatatgtatatgcaactcctgagatctttctttgtgatggaaaccctttaaaccttttgtatgaatagcagtaacacatttgttttcttattccatataatcctatttataatttcccaaacatctatagagaaatctatttcacctacagctatagggcacaaatggtagagccctaaatcagccagcatatggttttcaaatgcttgtccctcgggctctttgcttttgacattagtaccacatagcggcaaaaatagaaattagctttggtctagaaactccaaacttgggttttattgagtcactaatagcattccggttaaatatacttggcagtagtgaaaatatccctaggaggcaagactagctcaaacattttcaggtgcagcgtaaggaacactgataaccttttgtgtaaagcaggcatgatgtacagcatggagaaagtaataagattttgcctgcaggatattcgaatggggggaatccatttgaaggatattatgagccagaaacataaggcacaaaaagctgacatatttcctagcaaagtctgctgtaaagatctattgactggcaacaatggtgggatcgatgctgtctgcggagagtagacgctgggagcccagtcctcgctgcagtcattaacaggcctgttgcgctgtcagaattactttcgaaatcaggttgatggagcagcaagaataagagtagatcagttgggttcactggtgttagggtcaggctgatgatgataactgggaaggattgggttctgaacagttcatcagaacggtcccaaaggtagtttcactgatggaccatccaaatagtttgataaaggtcacagacagaaactgctgattttgcctttcctaaggagtccaaaatttggactgttctttgccactttcaggaggggcaaagaactactaccaccaccctctgtcacccaccctggaatggaattgctatccccctaactgctctcctttctgtgatgtttctgtgcctccctttcctcatgctttgaacaaggataagaatatctattatactcataggcttgtggggattaaatgaagacttaacaggtattcgccagtgctgtgcatggcagtatataatgacaagtaaatgctacttatgattccttgtgtgacaaacatagcttacaccacacttcttcacacatggcccagtcttttgactgaacagaggatggggcagccctttgtgacatctcttcctgtctcacaggccacacccttctttatttacttatttatttttgagactgggtcttgctctgtcacacaggttgaagtgcagtggtgtgaccatagctcactgcagcctcgacctcctgggatcatgccatcttcccacctcagcctcccgagtagctgggacaacaggcacacaccaccaaacccagctaatttttttattttttgtagaggcagggtctccccatgtctcccatgcaggtccctactctggggctcaagagatcctcctgcctcagcctcccaaagtgttgggaattacaggcatgggccaccgtgccccgccccctacaccctgctttaaatggaggctctctttgtccacagttgcttgccacaagattccccagacagaagacctagtaaagttttattttgtttttgtttttggttttttttttttggtgcattatttccaacctctgatcacagatgtccttaccagatgaaatcatatccagtttatattgcttctggcatagtgagaatactaatgatgtttaaattacttgtgctagtgagttcatgcagtggctttaaagataagactgggctgtcatgttgtttaactccacttcatatcattcattgatttttcttttttttttttttttttgatacttggtgcaatattcatttttcagcaaatcttgttggttcaactccaaaatataacccaatccaacctcttctcattatctctactgctgccactccagtccatgccacgttctctctaaactggtgatcgcggtagtctctttgctggtttccctgcttcttcctcagatgccacccaagtcaattatctatgaccagagtgagactagcgtgatcttgtaaaaatgtactttagagcatgctgctctccttcccaaaactggctggaatttccccttacagttagaatacactccaaagccctgagcacaatccatctagccatgcatgatctattccttcctgtttccctgatgtcttctcattcttctacctttcaggatatcacactgctcagtctctgcccttcatttatggaacacactcgtcttatttttgcctttgcacttgatatttcctctgctcagaataatactcatctccctggttctttatatggccagcttctttttttttttttttttttttttgagacggagtctcactgtgttgcccaggctggagtgcagtggcacaatctcagcccactgcaacccgtgcctcccgggttcaagtgattcttgtctctcagcctcctgagtagctgggattacaggcgcccaccaccatgcctggctaatttttgtatttttagtagagatgggatttcaccatgttggccaggctggtctcaaactcctgacctcaagagatctgcccacctcagcttctttccaaagtgctgaaattacgagtgtgaggcaccacgcctggccacacggctggcttctgtaggtcagttagtcagcctaagtgccaccaccatacagacactatctctgacctccatatgcagagtatgaccctattactctgtatcatatctcctttttaacgtttttaaataggaactttctaaaaatacttgatttgttaacttgttttttttttttcttgtctgtcttcccctccaggatgtaagccccatgaaaacatgggtttttgtctgttttatccctgctgtctagctatcactgaatgtctagcacagtcctgggcactcagttatgcttaataaatatttgtggatggaaggaatgaaggcgtaaatgtgccaggagcagtgacagatataaaaatgagacatgagagatgagtaagacactgcctcttctttttaggggctcttagtttgatagaggagctgaagtatgtaaacaaacagattggcaaagcatccgaagcagccagggaggaagggaccaaaggttttcgacagagagggcgtgatgcgaagtccttccttcagtggcctaaggttgctcaggcttctgtggcttcaggacgcaccttggctatgtgcagtgtagacacattcttttttttctttccttttcttttttttttttgagatggagtctcgcattgtcacccgggctggagtgcagtggcgcaatcttggctcactgcaacccccgcctcctgggttcaaacgattctcctgcctcagcctctcaagtagctgggattacaggtgcctgtcaccacgtccagctaactttttatatttttagtagaggcatggtttcaccatgttggccagtctggtctcgaactcctgacctcatgattcgcccgcctcggcctcccaaagtgctgggattacaggtgtgagccaccgcgcccagctgacacattcattcttaatgacttggcagaagatcccctggccatagactggtagctgcaatgaaattatagaagtcaggcaagatgtactgggtgtgatttctgtgaactttgaggaaaatgtgtgtctcggagttcttcaccctcaagagagaaaaaattataatgtaaacatcaaggttattactgagagggaggagtgacttctgaaatggtggccccatgactaaggaaggtgtttgaaaatcagcccttgtttgagtggagaatatttaacaattttgctatctaaactttctcatattacttctcaaggtggaaattctatgtgaggatgtagaacttagttgttaaatttgtacccaaatggtgtacaaatgcatacaaactgcaaatgaacagtaagaaattaggcaaagaaatgcagactacaaattatttctaatcacatagtgatgagtcgaatttcattaatcttcttagactcctctttaattaaataaatagcaggaaataacagcccggtttaaaagaatgtttgtacagggagcagaaatattagatcataaatctttataatttctttcatataaacatatacatgaaacatatacaaaccattttctgactgtaccaatgtgtttgctggctgccgtgctcagagtgaagtgatgatatgtacgagatggtgctgtagacctgcttgtttccctctcctactgtcttgggctactgcccgattctaatagagccatgtgtgtcttgtctcaggggattatactgtccactgtccattggctgaaactaggtgttgtagtttattttattgtgttttgttgttgtttctttttgtttttgtttttgtttttctcgagacaagagtctcgctctgtcacccaggctggagtgcagtggcgtgatctcaactgactgcaacctccacctccttggttcaagtgattctcctgcctcagcctcctgagtagctgggactacaggagcccaccaccatgctcagctaatttttgtatttttagtagaggtggggtttcaccatgtgggccaggctggtctcaaactcctgacctcaaatgatccacccaccttggcctcccaaagtgttgggattacaggcgtgagccaccgcacccagcctgttctggtttatttttataattcggcgtctgtcatggctatatctgatatcttattttttgtgagtgtgttaaagaactttttaaaacacttgaaaatttccccaggtcagaatttccccccaaaagctaatgactctttttccttctttgatcaaagtatttttaaaattcatacacaacctagttaattttaatgagtttgaacatttgtgcctatagcctggagaaaattaagtgttcttgagatggataaaactcatgaagggcagaagtaaaaagacaataatatttgtcctagttatatagactattccagtagaacaaatagtagagtttataagaacatagctcttggtccataaataaatggtgtcatcttaaaattctgtgaaaaccaaatggttttactactcactatttttgcataaaactagtggaggtaggtagcttgtaaagaaagtctaaattttaatggaattgatttgaacttgatgttagtatataattggaaatttttgttcatacattaaagaaaagcagccattttaagaaaaaagaaacttatgtggtaaaatcagtattatataagcagatttatccatgccttaaattagcttttagaatatttagaccacatcagagtttaaaagatttttaagacagaagatactatatgcaaagttaaaggagaagtgagagattaggaaaatatttttgccacataagtaaacagacaaatgattatttataaaatatgtaaagaacccccacaaattaataagtaaaagaacctctgaactttaaaataggcaaagggtaggataaggtaattcagaggcgagaaacctgattgaccaatgaacatgacaatatgctaatctttgtaataacaggaaagtacataataaagaaacaagatgtcatttctcaccatcagattggcaatggttaagaagtctggcaatggttaaaaagttaagtgttgccaaggatgtgaaaggaagcttccacataccacttccatgaaggcaaattggcagagtaactttagagatcaatttgactatgtctagagtagaattttaatgtgtggaccatgtaacccagcaatttttatttctacttctttataatttgtttatatattttgtggaaacatgtattaggagatagattatttgcatctttttaacagtgaaaatttggaaacaactaaaaatatctgtgtatatgggaaaaggtaaattttttggaggctgttaatgtagtgaaatgttacatagcagtttatagtataataatgaactccgttactataaacttgtatatagcattccattatattagcagatttatcattattaatcagcttatagtcctagctaccaagcaggctgaggtgggggtattacttgagctgaggagttcaaggctgcagtgagctaggctcatgccactgcactccagcctcggagacagagtgagataaataaataaataaataaaaataaaaagtaaatctcaatatcataatattgggtgaaaacaaaagattcacagcaacatgaacattttatataaagctaatacatatataaaataattctatatcttatttctaaatacaccccccaacacacccacaaaccagaagaacatatattaaaactatcacagcatttacctttgggaaaagggtagggaaagagctgggaaccaggcacaaaggagtcagataggactttatctgccatgttttatttcttgaattcagtgaggaaacaaatgttatacaatgttcataaacagttaagtctctgctgtgggtacatgagcctttgttatagcattattcgtagtctctcatagtcccatcgtttaaatttttttctcaagaaaaccatattaaatctttcagaccaaacaattagcattaaggattctagttttcttactctgagattttagggaagtcattgaaagcctttatcctttatcctcatgtgtccagaaggaagataagcattttcacaacagtggtcctgaatattcatcctttaatattcatctcaattcctacttcctctgggaaaccttctctccccctcctttctctccactgcccaaaggtacatggacataggtcctctatgttcccagcaatgtgtgcaatcctgtctcgtaacacctagcacattcttttgtgataaatctcactgtgggccagtctcttccaatagataaggaaatcttagctatggtacatgtcttggtaaggagcaagtagtaagtgctcaataaatagaacttcgtagccagagaagatgcttaacaaatctttaatgaaagaataaatgatcaacagaataaaaatatgacaagactttttatagcaagacatcttataagggctcctgaggttgttattcttcttttcacatcagtgaatgaatgtaatcctcccaaattatgtaactttagcctacaagttatatccttgagattttcctgcaccgtgaatagggtcatcaatatgttgtcatagagacacatcaacatttgcacttcagcacaatagagaataaatattttacacccctttttctggttcataatttgagataagcttacactgaagttataaaatgacagttcatttaacaaacattttaaaagaagaataaaggttctctctcagtcactgaataaaattaatataaacagcactgggtggttgtccacggtgatcgttggcactctgtcagctctccagaggggtttttgacatgtgaaggacgtggggttttagtgctttcagagtatctggaaaatacatttttattgttcttcttcatggatggaaaagctttatgaagttgttttatttttaaagtgcttgatgttttgaatgaggatcttttcttctaccattaacaaagggaatgacacaccacagccttgttagcctgaagcgcaaggaatgaaatcccagggagataaaagaccctcagggaactgaggcttaagaagaaagggtgtatgtttcaggaagaaccatgtttttctatcctttgagacagtggaaaattattttggtctcctctaaaaggcactctgtagagatatcttcttgaaagtgacttatttgtactttgcccatgttttagactataaagtattaaattttcttctctattaatttatctcatagtcatggattttcctatgtttaaagtccatggagaacattatagccaaacctcatataaatatatattgtcaagtcagtatactgattttgatgcatcctaataaatacttgatatttataattttttttttttgaaacagagtctcactctgttgcctaggctggaatgcagtggtgtgatcttggctcaagtgattctcctgcctcagcctcctgagtgctgggattacaggtacgcaccaccatgcctggctaatttttgtatttttagtagagatggggtttcgccatgttggcgaggctggtctcatactcctgacctcaggtgatctgcccgacttggcctgccaaagtgctggaattacaggcatgagccactgtgccgggccgacatttataatattgaaggcatatgtagtgttagttattgcaaacagtaacaccagtggggttagttatgtattataagcggacatctctttccctatgataagcttgagttctaagatttgatatgttatcccactgtaagtatctggtagagatgtatcttaaagttcttgacccctatgtaattcaacaattagatcccaaggctattaaactaagactttaaaacaacaacaataacaacaacgtggctgtgtatggtggctcatgactataatccctgcactttgggaggcccaggcaggagcactgcttgaggccaggagttcaagaccagcctgggcatcgtagtgagaccttgtctctacaaaatatttttaaaaaatcatctgggcatggtagcatgttcttgtagttctagctactctagaggctgaggtgggaggatcgatcaagcccaggagttagaggttacagtgagctatgtttgtgccactgcactccagtctaggtagcacagtgagaacctgtctctaaaaacaaacaaacaaaacaaacaataaaaaacacctgacctgctcagttcacctagggtttgtttacacctagtacaggtacacagaactgggcatttctgttgctgtcatttagaatcagttcctttaataagcatcttacagttcaaaatgcatttcaaggttgtatctgttgtcttagttggtgaaccatgggcatagataaactgaagaaaaatcaaggcagtgagattatttggtgcctctcaatttggcaatgctgtccagattttatttatgacatctttttatactgaagtggggattgctaagaaagtcatgtttttgtttatttctcctttcatatttccggaccccatatacaagcctacacttctggacatacagtcaccagcaagtaggaaatgtctaaactccagtttttaattggcaatgaaaaagactaaatgtaaagtagttctgggtttccttgcaggcctgaactcactccagttgtctttgtaaaaatgaataaaaggtccaagccttgtttttttcttgatagagttactgggcaatttcgtttttgaaattttacattgtgagaactaagttgtcctttctggcatgaatgattcatgcaagacaaacaaataatacaaaccaaggtcagacacgttagtgcagcttcatacacagttggaggatgtttttctagggcattctttttgctgggctgggacatcccaatgtgcaaatcagggaatttctgctgttactagatctgtgcagtgtcacatataacaaaaagtactttttgtgtaattagtgtgttccaccatcttcattttacaacaaataaaggttggggactaccccaaggttctgtagcgatgaattggccatgggctagctagggcccaggtctaggcaatgtaaagaggctacagtccctccttgagccagctagtgattgaggaattttgtaacaaggtgaacatgatggtaaacatcacttctttcttaaagggcaaaatgagttcatctatttttatcaattgcttggttggttgctgatagagtcctttggatgagacaatgtattaatgtacccttattccttcctccagagcacctctccatttaacatttctgtttatctctaatcgtgccccctttcttgtcctttgtctacctgaaaacaagagatttactagattctctccatgtgttcaaagactttttctaatgccttgtttttttgtcaatacctgtgtgattatggacatgataggatattccttatcaaaactattctgatgaacctgctgctacatcttgaagcctgggaactgtcattttaagcaaacaactattatttctcagataaacagttgtgagacatttgttctagaatgttcccctttgaaaaccaggcagaagcagttaatctgcactgattccggttttgtaattgatgaccatcacttctttggggtgttcagcgtggcataagggatgattgcagctttggagacattgcattgatggatttgggttgaacccttgcttttgccactcaaacgccaagtggctttgagcaaattgccatttgagttcattttgcaaatggaaatattggaataattatatctaactcattgagttattgtgaggtttaaataaaatagctgcataatgtccctcataatgtaataatgcctggcacatgttagaaactcaatgtatcttagaaagcctcccgctccactctctgtttcgtgtcgtttgcatggaaaattaggctgagggtttgaggcaggttaggagagaagaatgtacctagaattttgatgatgattttctgggtttctctgcttgtgaaagttatagcgctctacactcacaatcactctcatttattcaccagatattttctgaatgccagccatgtgccaggtactacatgggcctaattttcagatccatatactcttaaagctaatgacattgatactatgttcatagcaagctttctagcttttttgtttgtatagtattatcattattatcattttgaggcaggatctcactctgtcacccaggctggagagcagtggcaccatctcagttcactgcagcctcgacctcctggactcaagcaatccttcctcctcagcctcctgagtagctgggactacaggtgcatgccaccacattcagctcacttttgcatcttttatagagatgggatttcgccatgttacccaggctggtctctaactcttgagctcaagcaatccacccacctcagcctcccaaagtgctggaattacaagcgtaagccaccatgcccagcctacatagaattattatcaacttctagaagctcttcaaatctggctagctccttaattttcttttttctttttatttatttatttatttatttatttatttatttatttattttttgaggcagagtctggctctgtcgcccaggctggagtgcagtggcgcgatctcagctcactgcaaactccgcctcctgggttcacaccattctcctgcctcagcctcccaagtagctgggactacaggcacccgccaccatgcccggctaattttttgtatttttagtagagacagagtttcaccgtgttagccaggatggtctcgatctcctgacctcgtgatccacccgcctcagcctcccaaagtgctgggattgcaggcatgagccactgcccctggccaattttattttttctttgagaaatgtcttatgttctcactactgaggtaatttctttctcagtgtccctaaatactgagtaattggctgacccccaaagccttactcagtgaatcattaatcatttgttgctctgccttagaaagagtgctggtttcatattagatgagaaatataatggtggaatattatacttaaccgaaacatatcatttcagcacttcaggagcagaatggcctcatgtaaagcccttgaccttttgtatgcagaaagccttgggtttgagtactgatgccaccactgactagttttgggacattttacctaaatgttctaatcctaaatatcctctatgtgcttgtcataattgtcatgaggactagaaatagctgtaatccagtcagaatggttactattaaaaagtcaaaaaataacagatgctggcgaggttgttgggaaaagggaataccctgttggttggagtgtaaattagttcaattattgtgaaaacagtgtggtgattcctcaaagagctgaaagcagaactaccattcaacccaagaatcccattattgggtatatatccagaggaatataaattgttccaacataaagatacatgcaggtcaatgttcattgcagccctgttcacaatagcaaagacatggaatcaacctaaatggccatcaatggcagattggataaagaaaaggtgctacaaatacaccatggaatactgtgcagccatataagagaatgagatcatgttctttgcagggacatggatggagctggaggccattatccttagcatactaatgcaggaacagaaaacaaaatactgcatgttctcatttataagtgggagctaaataccgagaacacatggacacataaagaggaacaacagacactgtggcctattggcaagtggagggtgggaggagggagaggatcagaaaaaaataactattaggtactaggcttagtacttgggtgatgaaataatctgtatgacaaacccccatgacatgagtttaccttcataacaaacccgcacatatacttcctttttaaaaaggaagagatatgtaaagcataaagcactgaacctggcatgatgtaaatgcccagcagatagaaccatttaaaaaaccttactgcttgattttcttttactgccaaaaggatacatatttactgtaaaacatttagaaaacctggttaaaccaaatgaataaaagaataatcatgcataatctcaagacccagagatacccactgatgccatttcactgtagctctgtctctctttctcattttaacccttttccctcttttccccagatagtagtttcaaccatatgcagttgctgcatccttacctaaattaatggcagtttcatcaggttcattctgatatattgctaaaattggattacatggggcatcttttttttttttgagacagaatcccactctgtcatccaggttggagttcagtagagcaatcacgactcactgcagcctcaacctcctgggctcaagtgatcctgccaccttagcctcctgagtagctgagactaccagtgcaagccagcacgctgggctaatttttgtatatttttgtagagataggggcttgctgtgttttccaggctggtctctaactcctgacctcaaatgatactcttgtctcagcttcacagagtgctgggatcacaggcataagccactgtgcctggcctttttaaaatctactttttataattatgatatcataaatatggttccagttcataaaatcatcttctataaaaatcatttaattaatcgatagtattccattgtatgactgtaccacaattttttcaccagctgcctattcctggaaaactaggttgttttcaatttattgttataatcagtgctaggataaatgtccttatagctttggagagagtgaaatatagtggtttagaacacggactctggaggcaggaggtctgtgcttcaccccttgctacctgcgtaactttgagcaagtcacctggatctcaatttcttcatctacataatagggacaacaatagcacctgtttcatagggtcactatgagagttaatctatcacgatgcttggaacagtgtctgtgggcatgctaaggtattattaatgagttagctatttatcttttatgaacggttattgtctttatgtgtatatatacatacatacacacatgcgcgcgcgcgcgcgcacacacacacacacacacacacacacacacacacacacacacacacacacatacatgcttatttctttaggaaaaactcccaagagaagaatttatggtaaaggggctttattagactttgccagactaatttctaataaggatgtggtaatttactgtcctgtagtactatataagagtgctggtttctagctgggtgcagcagctcattcctgtaataccagcactttgggatgccaaggtgcgcagatagcttgagctcaggagttcaagaccagcctgggcaacatgatgaaacctcatctctaccaaaaatacaaaaaattagccagtcatggcagcatgcatctatagtcccggctactcaggtgggaggatcacttgagcccagggaaggttaaggctgcagagagtcaagatcgcaccactgcactccagcctgggtgacagagtgagaccctgtctaaaataaaaaaaaaaaaaaagagagtgctggtttccacacaaagggagaggctaccattatcactgtaagtatcagtctcaacattattattattattattatgactcagggtgcacagattttcacctctgaaatcagaatgcatctaatcatcatcgtcaaacagatgactgtcattcatgattgtacaaaaccttctattgactctgctgaaatgaagaaagagtgtcattgcatcctaacatctatgaaattccatttcatttggaaattacagaacaaggcaagcaaatataaagattatgaactagttgctgggcacagtggctcacacctgtaatcctagaactttgggaggccaaggctggaggatctgttgaggcctggagttcaagatcagcctgggcaacatcgtgagaccccatctctacaaaaagtaaaataaagaaaaattatcatctgagttcaaagtgaatgccatggaaaatagataatgccattttcagagagcatcttagatcggttctcaaaagtgtgcctaaggacagagtttcctgagctgcatttcgaaggctggggagtactgagggagcaagaggacaggtctactatctctccatagttatttctacttctttttgttgtgtacagagctgtgaaaatgataatggccatagtacaatagcagagagaatcaagttcgtgttgataaacttttggctgttgcatgtatcattccctgcagcccctgcacccctcacacccagacttcctacttaacagtcctctaccctgtacctaaatgtggcacaccctgccttttggtctcagtttaggcatcagtttagctgggaagccttttctgatgcaccaacactggttggttaagtaccatctccttatgttttccgttgtacctaagccatcccctgaccttattacttattattcagtattgtattgcttcagacttggtgtctctgtcattaaatggaaagccgctagaagcctgtgctctttattttcctttgaattccagtctagcaccatgtctgatacatgacaggtacttaaaaaatatcacttgaatgaacttcagtacccagcccgtgaatgtaacctggggttactggggtattggaagttataaccgtaagggttccaatgtgagtctattgtcttgagaagatccagttctctactagttttcacttacggactggagcttggattatatgtaatccaagtagtacccagcagtttaaacttccaacttattatgagagcttattagagcaagctgtctgtgcctgtctgagactctcattaagccattccatgaaatatctgcatgaatctgggcatcttgcatctgagagcccatttccggcggttagtgcagttagaactgaaaccagaggctgaaaatgagtcggcacttgctcactagcatttaggtcactttcaatttaatctgaaataaaattctgttcctttacttcttttttaaaaattaggatactcaagctattttcatgttaactatatattttctaagttgttagtgggaatagccaaccagtcactttctcttgtggagtgaaagaaactcttgccctgtgagattagagtgaggtgttaaggaaaagatgtcagatagtttgaattcagaccttctccgagctgtctctccaaatgtggtacttgaattcaggataactggtcaaattctgcactaaacataaggaatgaattctgcctccagtctagacaaagtcagtgtacccttgtagttatcagggatgagagctggcttatatgctgtagactgtgtaactcactgggatacatttaaaaatggatgcattgaagtggttaaatatgacaaatgaagaaaggaaaggaagtcacggtaatgtctgaattcaacccaggtttctgtgtcctacttgttcttatacctatttgtctgtaaacatgtggatttttttcctgaatagaccatgttgatgtatggtattcacattgtgaggtccatgtattagtggcattttaggaaaatatagcccgaagtggggaagctatcacttgaaaacatgtcatcatgcttggacatagccaggaaattaaccatgtcagcatgataatatttcttgaaaagcctgaaacccatttttctatgctgatagttatcagtttctgctataaactcacttgtattatgataagatatcttcaaagtttttttttttcttttttttttgttctaatcctaagaaaacagagctggtgtctgcctgactgccccactgggagataagttgttgaatgaggtgtagaacagggttgtgaagaagaggaaaaatcagttctgtcccctcagttcctctacttctccctacctctctcttgttatataaaacatgttctgtaaagtgtatgtgcttggggccaccctgaccacagtgtcacatgggggaaaattctgtaataacccaccgtgatttttaaaagtgttttgacatgatcttgttgtttttatcaaagtaatttttattaggtaaaatttcttttttgttggtcaactaattctctactgaacataaggagttgacagatatttaattcaatatctgaggttcctagaagttaagagggacatggaaactttggagagcattcagtaaaaggataaatgaaattgaataaactttttgaaagtatggaaaagtattggagttgtagtatctagagaagagcaggccaagctgcattcacatttgggaataaggtcatttttaatacagaggagagtggtgaactggtttactatattgtgaaaaagtcaggagaaaaaaaggattcaatgataagataatggatttagctcatacggaatgatttttcttactcttgaggattgatgaatcaagtaacaagttacaaaggcctgtgtaatttgttttggagtcccttcaaaacaggatggagtcttctctacctggggtagctgagatcaaaagggacatatcatgtaattttcttaaagatttttttcttttgagatcctagattaaaagaattacagtggaaaaaagactcattgtccatatccataggcaataaaagaaacaactcatatgaataacaattaggcttcagtctcattttgaaactaccacctaatcttattttgtgaaagaagattgtgagttcttaggtaattgctttcttgatctgctttaggttcaataattctctctcattgtttttaattgtattaaagtgtgtttattaaaatactaatgagaccaaagtcatactgattaaaaacagaattattcatttaaaccttttgatattatgaaatccaaggtagagtctaatattggaagacgaattcagtacttctgatgagttgtttgctgtgtacctagagttttcttcttttgaacaatttattccagatctgttgaagttacaaaatttttatgaaatgaaacttttttttaattgtaaaagcagtttattttgagctctaggcagggtgcttcttcttcaagtgatttttatagcatctaataaatataccgctggctcagcaatacatactaagagtagattttgtttatcatcaccctctttaattttttagaatgtttggaattgaagtttttttccttccctgctccccttttctactcactgacttttgtattgcagccgctctttcttttctttggaactgcactttaaatatatctctcaaatgccattttcttcctttgtcttttacctggtttcgtttgcctattatcttttcatttaatttggattcttcggcttcaggcttgtcttattttttaaatatgtcaatatatttaagcatatttgtccattttttctgcccttttttttggtcagtaattcagattaccttccaaacacagatgttttgactgatatcttttttttttttttttttttttttttgagacggagtcttgctctgtcccccaggctggagtgcagtggcgcagtcttagctcactgccagctccgcctcccgggttcacgccattctcctgcctcagcctcccgagtagctgggactacaggcgcccgccaccatgccctgctaattttttgtatttttagtagagatggggtttcaccgtgttagccaggatggtcttgatttcctgacctcgtgatcctcccgtctcggcctcccaaagtgctgggattacaggcgtgagccaccgttgactgatatcttaaaagcagatcagtagtttacttcttagaggactcaggactctggcccagacctgtagcagggtcagtccactccccagtacttctgactctgtgtcccctctcccttttcatggttactgcctgtgatggtcatctggactgttgccatttttcctgctccatctctctgcctctcatcgtcagctccttccacacacgtaggaggaggcaaatctgtgctctcccttcttaaaatctttcactaccaatcccttgttcacaagatgcaatccaaaccccttaatatgctaaaaagtccctgcatgagctgatcattcccgtctgcctagccaggctgctctccttgcagaacccctgagctcttcccctagcccacttctctagccacatcaaactccacactctggatgcagaacacagtctgagtaaaggcatggagactttttatttatttattgacatgattgtcaatgaagtgataattaagcaatggagtgacaggaggtggcccagttggtgctgagcaccagtttgtgaagcattgccatgggttggggccagggccctgatgtccagctaatgaatggccatgagaggtcaccaagccattctccccgagaggcgaagaaatctggttctcccttacccactgatatccactgtttctctcctcaatctcagcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttgtaagtcacatgctgcccagcagcagagcagagcccacccaccctctccattcatgctgctgctgccatcatatttcttgtgcctcagtttgcattgctgcctgaagagttactgatgggtctaggctgcaggcacagttatagaggtcagcagtgatggccactaggtgctgctgctgtttggcccttgcacatcagatcccagcctgaatctaagggtcagcttccatgctttccttctagcaggcaaagagagagagggtcagtcaggatgttgtgttgaatggcactatttgggggttgttggggcatatttgggattctgtttggatctcccgagaatatgttcatttatactgctggttgttaatggtccatgtctttttgctctttgtggcaattaattagctggggaaagctgggtgggttcagtgcattagaagagaaaaggaggaaggtgttaaaaataatccataataaaagattaactcttagggatacatacattatttaatgctcatggatacatattgctttgtgaatgtgaagatatatgtattacatctatgtagattttgtgcacacacatagtttaattctttctgaggaacattcaagcaactacttaacctccactgtctttattttgttggaagggcattcttcagttcacttctattcaccaacagaattaagaggcagaagttgctaaaaaaaagtaagagatagaaaaatcctcttcccttactgagaaaattacatttataaatcaaagaactaaaacttgaaaaaacaaaatgtggctgattaggtaaacacttcctgccaacagtgttaaacgcctgtagagtggagctaaagaaaaaaattgcattagcctagaaagccctgattttcagaattgatgattatctcaaactgtttaattgttaatattgcttttatgggttttcatcaagaccacaattgaactgggctgtgggaaacttggagcaatttcccaggagagcaggaaagacaaaggcttaaagaagaagggccatgcgacacgtgggtgggtgagggaagggaaacttgtcagtcagtaggagagaacaccaaaaatggatgatgagaaggagttcatgtcctttgcagggacatggatgaaactggaagccatcattctcagcaaactaacacaggaacagaaaaccaaacaccgcatgttctcactcataagtgggagttgaacaatgagaacacatggacacagggaggggagcatcacacactggggtctgtctgggggtggggggaaaggggagggagagcattaggacaaatacctaatgcatgcggggcttaaaacctagatgacaggttgataggtgcagcaaaccgccatggcacatgtacacctatgtaacaaacctgcatattctgcacatgtatcctggaacttaaagtaaaattttaaaaattaaaaaaaaaaggatgatgaatatgtgcacaaagggtgtgatgtgcaacatctcaattttctttgggaacagaacaaacatataaacaaaagtagacttaaactggagcacaagcgctttataagtgttacatgagaagttcctgtcatcaatgagtgtttggccagttttcttcctcagtgttctcagataggatagcttctcttcaaaccgaaatggctttattagaaagtaccccaaaacaaagggaaggactgggtgactcctcaaagacacttccaggcaatatgattaatgttcttgatgttaattaattaaatgaacaattattgaacacagaaagcttgtctattttggggaccctgggtacagtgaacccgagggtcatgtgtctgggaaataacagtgtcctttgtcacatgttaatccctcagctgtgaggatctttgtcctcctggtaaacatggtccacagtgtgagcagagatgcccttgtcaaaatggaggagtgtgtcatcacgtcactggagaatgctcttgcccttctggctggatggtaagcttccttcccacctcctctgcccctgccccaaagtcacccattccaggatactcagtgcatacacatgcaggagactttagcacaaaggaaagttaccatgatggttgaagattccaaaattggaaagactcaagccattttaaatctgaaactcttcagttctgaggagacagaagaaggtgatttagtcctagacttgaagtgcattgaaggttgtcatgtaaagggtagtggccatctgtcctgcatttcccttaaggataaaaaaaagagagacaaatatctagtctcacatgacagtcagtgctgataaacactggatttatttaacaatcattttcataattttgttccatgagttgctgttgttctttgggaacattattcttaacagtgcaagtgtcacctgaaaaaaaatcatagaaatctggggatacattgaggtaaaccacatttaccaagtattgcaggacttctcagagccttgagtgtgataatccaagaggaagctattcaacatgttttccaaattttgacgagaataccctttcttcatgtagcaatttcacatgcttagagttatgtagaatacacagtgacaattagcttcaaattagacatctgaaatcaggaaatataataatattgatgtcatctctctgagttggtttgtgcctgtgtctgcttgaaggcagatgagtgagcaaccaatatctgtttccttcattaacaaactatttaacagagcaattgacttttttatcaccttctatttccatgagcagtgctaaagctgttctttcagaggttacaagggacttaattaccaaaacccttctgttctcattcagcttcatttctccaaagcttttcactctgttgagtaccaacctcccttccttaatccctttgccttctatttttctaatcatcccgtctcttacctttcatactaaagatcctttttctaatctcccttcttctgcatacttcttcattacaggattttgtaggtttaagtcttgttcttctcttttctcaccataaatccactctggcaatctcatccagacccatagctttaagaagtacttgatggtttttccagattttgatcttacctgccttgagcttagatttatatttgtcaccccaaccttgataacctatagacacaaagccaccgtctctttgggcaatgcccaagctagagtctccacagccagacctggtagtagaattggtctggtattgccttttcttgtggctatggaacaaaggagacctggagtccacttttccatgagggtcttgggaagtaagaacagtttaagatgtcaaggccactgggacaagtatacaataaaaatcagatctgagagggttagaaatggtgagtagcccagacaaagttcattctggagccaaagcatggagaaacagcatgaggcaatggagttagagagagaggagaactttgagtgcctgaggatgaagacaaggtgaaaaagaagctgtttaaggagtactgagcaggtttgagtaggcctggcagagtcaatgataataaatttaataaatccaaacttgtacacccaagcctttagtaaggctactccttctctaccttttttgtcttggttaaaactaacacttctctcttagttgtctgaggtaaagaagctgggttatttctgactcctcctgttctttcatttcctatactcagccttttgccagtgttggtcttttgcaatgaaagtattttgctggagcagcagagtgttgagaactccatgctctttggataaggatcttcaggccttttactcctaggacttctgtgtagatattgtctgtggagttgccttgccttgaggctgaagctcttctcagttgggatggtcaggatgtgggttaatggtaaccacaggcttgggttatgagtcccagcacgtggacagatggacccctccctagcagcctaagggagcctcctctcacctctttatctgtgtcccaggccccttaccttacttctgcttcaaaaatgcttcagtttgtttttttctcctgtgtagctgagctttcaatttatacttcttctttacaacatgttatttgtgctgtcatcctaggtgcttttcaaagatgaatatatattcctatagacacacataccttcatattgaaacgaagagaaatcatgtcctctttaaagctgcttgtgaatgttaatctttatgcacgaaaatatttcagcgcatttctgaagcttatgtgggaccattgtgggtagttaagtcaggccctgggagagtgagaattttcaccccttcttaccacagactgaccttcagtatgttattcctacagtcatgcttttacctcacattaagtataccatgtcaggctagaatggagagactagagcgatttttacatccattcccctccccacattgtgagctaattgagggttgttaccttatctttgattctcagtgcttagctcaacacaggcacatagatgattctcagttaagtgctgattcgaatcatctctcaaaggccttttccattccaagagtctgtggaagaaatttccctgtttgtagatagctagaaaccaccagaggagacttaattagcacaccaactgcctttgtgggtagccaggagttagaggaagtgtattttcttatgctgtccagaataaacatttaggaaaccatctggtgttcactagcctccaatttcagagtgcccacagtctgcctttttttagagagagggaggacagagcaacagcttccaatagttaaaaacattagaaaaatccctgttatttgggatatgttgtttgtctaattataactccaataaatagatgagaagctatgagcccaagtgatacagccaagtgaagaagaaaacaagagtatttcattgacttattggtacagtatcttattcctatccacgcaagattggagtaaatataatgactgtgcttgacaagatggacagcctctagggtgaggagaaatatccacgttactctcttggtttttctccccaggaaataagttttcctattgatcttggctcagcaatgcttgttgaatctgctgaaaataaaatgtttttcttctgaaataaatgtctaggttcgttcctgtagaagtctgtcttcggcaatgtgattgttaattcaggtacacaaaatttcaatcttgtgttatgctacattttaagaaataaagccaatgataaaacatgtattttctctagaacacatggtaaagcatttggatattccatgtgcggcagatgttgccatttatgtaacggatgctcaataagtattgttgacttattgtgcatgtaagacacaaggaagaacacttatgaggatttatacattccttaggttgccataataatttgatgtaactttgttttaaacttcagtttttaatatggattttgcttaacattactattcagccgtctttgaatgtatcttgagatttgggcttactgagtaattaagtcaatttaatgtttctaatattttaaagatgatgaacagtttatgtgctctaaaattctctaatctaattttcttgcagccctgttccccatccctcctttctatttcctctcttttcttcttcatccatcagttgtctttccctggctggaggcccatctaattttccaagtctctttgaatgcagggcacagtgtgtggtcagccttgccccgagggtcgctttggaaagaactgttcccaagaatgccagtgccataatggagggacgtgtgatgctgccacaggccaatgtcattgcagtccaggatacacaggggaacggtaagggatgcccttgtatttctctgactgtttataatgatgtgaaaggaaagtttgtagggtccggggagcatcttcaataccatgtgtccatgactcttccataatatttcagaagtagctatacagcctcaatgtgtttgacagattctatcttaattcagtgtatagaaactgaattataaatagcaatggtaaattgaagataacagaaaaagcactaaaaaaaagaccataaaatatcagctattcagaacccatgatgaaaatgtcattctagagagttgagtgtttagtactgccacttacattgtaagtacttggtgatagatttatttttaaatgggatgtgtacttaggtacctttcaaaagtataaagttactttcttatgattcagtattctgttaagaatattgatcattatattgtgtggtggcgatagagtcagatctgctggaacttatagggccctctggtcccacacgaaacagaaaaaatggctgtgctcatgcgggtcttactgccgctgtttatcatcctctgtatttaatggtaaactgttatctcagagcgctttgcacaccctacttctttttctttaatttttttatttttattttttttgtgggcacatagtagttgtatatatttatggggtacatgagatgttttgatacaggcttgcaatgtgaactaagcacattatgcggaatggggtatccatcccctcaagtatttatcctttgagttacaagcaattcaattacactcttcaaattatttcagaaagtacaatgaagttactattgaccatagtcaccctatatgctatcaaatagtaggtcttagtcattctttctaattttttttgtacccattaaccatccccatttcctccacaccctcccactatccttcccagcctctggtaaccattcttctactctctgtgtccatgagttcaattgttttgatttttagatcccacaaataagtgagaacatgtgatgtttgtctttctgtgcctagcttatttcatttaacataatgatctccagttctatccatgttgttgcaaattactggatctcattctttttatggctgaatagtactccattgtgtatatgtaccacattttctttatcctttcgtctgttgatagacacgtaggttgcttccaaatcttagctattgtaaacagtgctgcaacaaacataggagtgcagatatcacttccatatactgatttactttctttgggtatatacccagcagtgggattgctggatcataaggtagctcaatttttagttttttgaggaacctccaaactgttctccatagtggttgtactaatttacattcccactcacagtgtacaagggttccgttttctctgcatcctcaccagcatttgctgttgcctgtcttttggatataagccatttttaactggcttgagattatatctcattgcatatataaatgcaaatcattgtagttttgatttgcatttctctgatgatcaattgtgttgagcaccttttcatatgcctgtttgccatttgtatgtcttctttcaagaaatgtctattcaaatcttttgcctatttttgattggaatattagactttttcctatagaattgtttgagctccttatatatgctggtcattaggttggtgcaaaagtaattgcggtttttaccattgaaagtaacggtgaagaccgcaattacttttacaccaacctataaccccttgtcagatggatagtttggaaatactttatctcattctgtgggctggctcttcactttgttgattgtattctttgctctacagaaaatttttaacatgatgtgtgcatccttcttttaatgctcttgaatctgtcatgtcctggaagactaggtagccaggctcactggatgtgtgtgtaggatttgagaagagacttgagaggcagaaggtcatagtgattgaaaacaattatttggaatctaggtttaggtaaatgtgtccctggaaacacttttttttttttgagatggagtcttgttttgtcccccaggctggagtgcagtggcatgatctcggctcaccacaacttccatctcccaggttcaagcaattcttctgcctcagcctccctagtagttgggattacaggcgcatgctgccatatcaggctaattttttgtattttagtagagatggggtttcactgtgttgcccaggttggtatcgaactcctgagctcaggcaatctgcctgcctcagcctcccaaagtgctaagattacaggcgttggaaacacctttgtctgtaacatcctaataataattgtgcttctctctagggttgtaaggattaaataagttagtgtgttaaaacatttaaaacagccctggaacttatcagattttattattctagagcaatttctatgaactatgtaaatactagtgattatcagtttgagtgctgtttacaagctgcataaatattagctatcattattttttatgatgtctttgaattaagaattccctcaacttttttccccttattttttctctttctaaatcttggtctaattttatgacttttaataagatactgtcatgtttgttgcctcctgcctccaacttagaccctgtactttcttattaaatttatttctgagtattttgtaattttttaaaatttcatttctgcctgtaattggatatttctggttgaagaaaaacttgcttttgactatttactttttaatttattcatactaccaaactttcaaggtaattttaatgttgtttttagcaaactctggagttatttagttatactatcatatcatctacaaataaacataagttagtcttttcttttcaatatgtataatgattatttcatttccttgaattattgcataaatttgagcctccaaattaatgttgacaaacagcagtaaaagtaaaaatccctgtcttgtttccaaatttattggaatggcttcagtatagtctcatgtttgctattggtatttagtaaattattttcttcattcttaagtagttttttaaatccctttttttaattaaaaattttgttaatagtagctgcttaatttcattaaatgcctttttttcttttgctaatataattacatatttttcctttaatttttcatgcaatgaattattgacatccttagtacacagtttttataacatgtaattggactactcagattttgtaactgacatcctggttttaggttgtattttggatagattaggctgttagataatttctggatccatttaacatcttattatagaaaaatgagttggggtaagggagacacaagaccaagcactatcttaataatagtttcttgtcatattttaggccactaaaatggcaatataatttttttttgccctctagggatttaaatttcaaattagaggtagcacaagaacaataaacatacaaggcaaatgagcttatacctatttcatctggagtacagggaaagggaataacagttaattttcagatgaattttacatttgagccaaggaaggccaggggccagagaaagagaagggaagtaaagagagaacttgcttctcgacctgctgctcttgtaactattgtttttctgatgagccagtgacatgattcctgttttcagctgttatccctgtctgggctctatagttaacacatgtacacaacaaacacatttgtcactatgaaaggacaacaacgaatggccatgagtcagtctgtggcgggaggtgtggggagaaaggccttgataggctggggtcttaatttgccatttcccttgttttgagaagtcagtgaaatttgatcagtgaggttagggcagagggctgctggccctaggagcctgcacagaattcccaggatgtggggacagtcctccccgccagagagaaataagaaaaatccaaacagacaccctgtaggctggcagagtagtgcatagattgcccaaataaaaggctttggggtttgtggaaaggttgagaggatattgtggtgagtaaatgtaacatgacacagtcaagtaagagtgaagagacaatggtttccagatccttaaaaaacaccttctgaaggggttaaaagagtttcgaatgccgatagtgctgccgtaggatcactctgggccctgcgacagcctattaggggcccatgcacatgattggtgctcagtgagtattagctggatgaagggatgcatgactcagtgatgaactctgttaaggtgaagtccaaaacagctctgccaagtctgtgttccatagtaccctaaaggtgaagataaatgtgggtgaaaggaggtgaagtcaaaaattatagacaggaattgggggaatgcagcattggtcgtcaatggaggagctctttcctgtgtctaggagcgtggagatgttggctctttcccagtgctttttacatttcccccagagcagcagttccggatgttagaaaggtaggcagctgattcgtagattccaggtttaatgaagaatgtgattctttcacactaaatcatggtttggcctaactattcaaatcactctagggaaggacatgcacagaaggtcaggggtgaaagcggtacctgtcaccccttacacgttaactcacttacttttttccttaagttcacaatgacatacaacataataatagaaacaatattaaaaccagtctatgaccctcactggttttgggaattgatgtgttaatactttatctctacttaatgcttatccattcttaccaattccaggacattacttgaaatgtaaaaaaattggaaaccccaaatttccatatgtctactgtggctgatatttattgctatatctttattacttttctgctatctgtcctaagaaaatgcatttcctatttcactgatttttgagagcttctgttccatttggaaccgcagaagcagcattaagggcataaaatttgttgggaaatggtgcttcttgaagataaagagaccaagaaggagataaaactgcttgataaagacttttaatgcagccaatcagacaggcatcagctatttcatgattatgtttattttcaagatggagaatatatacttctagaaagatatcctaccattttcctttggcagatagaagtagacataactattattaacaggattgtcctacaagtgcaacattgacaaaacataaaatgggaatatgaatccagcttaaataatggctgctttagtaagtaacattcaaataggactttttgttttatatttataatgcaaactagtagtgtgtttaattgtaggttagaaaggtaaatgtgggtcaaggccagctattatagattttatttttcctgagaaaggaagtctctgccaagatatgataaaatatacacactggttccctgtaatttggtaacagataatttcccaggcttccgatctatactactttcaaccacttttaaagctgtgctttttaccaagttgaaataatgaagatagtttaaaacttaacatttgggtttgttttcaaatccttttaggagacagaaaatgatattatttatctttacctttttccttttggaactgacttgcaagaaaatctaacagacaggttgaaaagttgtcctgacagccttcagtaggagccataatgagaccacattattgtacttaagcatttatttccttaaagtttacatctttaaggaagaaactaaatgacttagcttattgaagcttcttagaggttaaaaataaagagcaccttttaaaaatacactctggtccaaaaataggtgtacccatgtataacttttaggcacacgttttattttatgctgagtattaggtcaattactccataacttttctaatggtttgttgagcagttgaaggttttacctgttaacaaatacacctgaagatgtctagaatctgtgaaactaaatttacatgagattcttttccttgtctccatcacattaaatatatgctagagccagaggtaaccagaaaagcatcgaaagggctggtccaagtggctcattcctataatcccaacattttgggaggctgaggcgggagcatcacttgagtctaggagtttgaaaccagcctgggtaacatagcaagacctcatctttacaaaaaatttaaaaattagcctgacatggtggcgagtgcctgtggtcctagctactcaggcggcagaggtgggagggtcaattgagcccaggagttcgaggttacagtgagctatgatggcaccactgcactccagtctgggtgatagaggcagaccctgtctcaaaaaaaagtatcaagatttgtcctctacactaaaatagaattcctcccaccctggtattgttacttgttgcaccctatcattaaaaatatgcaaagttttgtggaaacactatttctttgaagtatgtttcttttctgcttcttttaagtgtgcttgaatttgttattatgccttactgctcacatgatacagatctaaaaaatgcaaggctgacctacatttctgactctggttctggcctgacttgagagccacatgggaagtggctgccgagacaaagtgtacccttcttgcggcaagtgctcggctgggcaaagccctgtctccttcccttggcagaaagctccccttctgctgcagagagccagtcacctggcctagtcaaaaagaaacttggctagtctaagaactatttgtgctttccatggagcaatgagcgatcattttctcttttctatctcgattccctctagcaactcagctcccacctcattcgtcttacctagagcatatcctttctcttggacagagctccaatgccacttttaaaaagataatgaagtgaatttttgagggctgatctttactccttgccatttggcagcccttcttcccaacagagggcaataccccactagccaaacatttcgtgttagaaaactccaagccttcctactggcaggcacttcccatgttggaatcgaggacgtctgattttggtagctcagagtttcccagatctaaagaggacttggcttattagttaaagaactttctaactgaggaggaatgattaccattcagctttaagtaagagtaaaaacgtggctaagattaaaaattaatgtccacataaaagccaagagaattaaaatttagtttcaaatttgacacagagttttctctttggaattgggaaagtatgttttgaaatttcataattatggactaacatttgaaaatttttttcccattttcttagtatctactaaagtgctatgtaactttggcaagcactaagtgtaaacatgcctcatgtcctaagctcctatttttgttttggtttcattttgttgctgttgttatttgttttgtttttgttttctacaggtcatgctgctgttactacaatatgtagccagagtaatgtatcttaacgcttttcatccgtgtaatgggacaatcactaaataattgcaagagcaaaaagcagcttcgatttatgcataacaaagccattccaaattaactgtttattttcacatggcactaactaatctttcttcttgctcctgcctcttgcttggtaggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcataggtgagtgtcagcttcccctggaaggacgtgtcctgtgaaagttttaaccttggttttcaggatttggaaggagggattgatagagtgattctcaccccaagccccctcctgcctctaggctactctgggcaggaatcgccgagtaaaaggaagacattttaacttaatgtgtgatggtctacatttgaggtgctaaaattgttcaatggttactggtggatagcaaattctattctctattaatgaccactgataaaaacaaaatttgctgaggttagtagaactttcccttaagcaagggattctgtgacattcccttagaagcaaagatgcaatgagagacaaggagtttagccaaatttagtatgcaaaaatatcaaaaagtgattcttactgcagcatcttttattcgacagcacatctgtggaagaaaaaaaaaggctagagagaggaagtgaactggtggaagttttgtgaaagtgtttcacatgtggctgtcacatgtgaaatatctttttcgaattgattactctgacatagaactcacaagggacttttagctcaaaaacctctccaagaatttgagaacaggaaaccacgatcctacccaccctactgtaccttgtctgccctgaaaatgtcttcttacccctgtttcttctttccctcccccagggaccagatacacataacttagaattctgggcctcctttgcagactgctggaaaagctgagtttgacaaaaatgtagtgcgttatatagcagttcagatcttactagaattactttatttgcattcagcacagctgttacttcatttatacttctgaaagataactcatagccacatcaaatcccaaatgcatagaatttaaaagtaaacaaaagcgtgtggttggtctcttctttaaaccattgttagtaacaaaaatatagagtttgcactctgtgtgtgtgtgtgtgtgtgcgcgcatatgtgtgctgtaatacattttagtgggacatatgaaagaagtgtattctcaatatgattcaagtaactttgtaagccatattagtcaactttggttttcttcgttggaaaatattgcctttctttacttgacaagtttacgtaaatatttgggggaataaaaatgaataatctccacagggttttatttttcaactctctaatatttaaggagctggcaggattagggacaagtcatgaatttgggtccctttcctacagtataagtcttattgcagcaaaaagtaagcctcatgtagtgacaactaagaacattacaccagtgtgctgttccgttgtacatagagacaactgaaatcaaatggaataataaatctatgcaaaggaagagctctgctatgagaagaattggagaagcagagagcatgttggttttgttggaattggataccatattagtagtggcaaggtgcaaagtggagaattagttaattgatggcaatactgtggtaattttgacataggtcatatgtacctaagcatatatgtgttaacaaagaagtacatgacattttttgacaattacatagatcaataacactaaaatctgtctaatattgtataccaaataatccgaatattttaaaaaatcagtcttttcatgattttgtaaatcatgaaaggtatttttaaagattagcttttacgaatttctattaaaacaagtttaatgttgattatatgactctatcttgttgaattaatcattggagccatctatctagttcttatatcttaaacttctatgtgtaaaactcctggaagcccaaggtcccttcaaaccaaaaggcatagaatccttgtattaattgaaagtctagtttgttcacattagcatttatcaagcaagtggagccttgctgttacataatttatgatatactaaagccttccattataattaatgagataacaaatacagtgtaaattaataatgtacattgtctttaggtacatattgagttctatggatatacacattgacatatattttagccatatagttgggtaagggtttgtatcaggtagcttttgcagcattaaaaaacaaacaaacaaacaaacaaaaaaactactccaaacccaatgacgtaaaataacaattatttactaactgatgattttttgcttgactatgtgggctaggctcaacttggtggttcttctgctggtctccttgtgttcagctggcagatcaactggaggctaattggtcctggatatcctcactcacatgtctggcatttggctgggtgatggggctgactgagccacacatctccagtatctagcaggctagcctgggctttttcacatggtgactggtttctaaaacagaagacagtacagacccccaacatacactttttaagcctttggttatgtcatgttcgctaatacccctttagataagacaagtcatctaaccaagtccagattcaacataccccacctctcgatgggaggtgttgcaaagaatttgtagacatttttattttgcaatctatcatggagctgaaatgaatttaaatatatttataagtaatattagtatttcaaactttagcagtattattgagcctaaagatattcactgtgacctggacttttcaactgaaaactaactgttatggtggaaatgattttgaacaagaaaataaaatttgagatttaataatattccacatgcaatatagagagatagattaactgcttttggtaataaagacatttaatagccatggacaatccggatgtgcctatttgcaaatgtcatgtaattgtcattatatttgatcattaataacatctaaggaaatgaataaaaagaagttcaatgactctgtttcagccaatattatatagtattggacttttgttgtaattcaactattaaacagtttcctggaatatatgtatatagttatatgtgtttataaaatgacaactattcccatatgtgtataatcctattttcatatacacaaagcaatctgttctttagacagaaaacaggtaatgagtatatcacccttcaacctccaaactgctgcttctacaacaacatgtaaatctcattaccaattaagctgcctgcatgagaacccatcaaatgcctccaaagtgctctagcttcctacatctaattataaattgcagaatactaattttggtgtcaatcagtctgaaaaccagtgtgctgcactaacactcactggggggcattgaatatcaatttctcagcctgcctcttgctttgttgaattcattgtcatccaaattgtctattttctttaacattatgtctacaccatgaatactgttttctacttttcaatgtaaagtaatattttctaccaaaaatatcatttgttttacaatatgttaagataaggtaggctacttaaaccaatctatcacttgaaatatttcttttccctttatcaaatgtaaggacttactgaagtaaacttaaaaatttcccgttttttgtacaatatttgtttttactgatcctgttgacccctttatatgtgccaaattctaaatcttagcaattgtccttcatgtctggtcccctcagcaggctgttagcaaacctcccttttctttggtataaaagcaaacctgggttcaagtttgattctgcctcactacctgtgtgagactttgaataaataatttaccctttctaggcctctattttctcatttataaaatgggatcataccatctaggatggctgtgaggattgaactaaatggtgctcagcacattgctgagacttactcagtgcccagtaaatgctgactcctggtctgtgcgttcacttacaatatcatcacaaacatggtgacattcatgagttgttctctgtgattaatggctatttcctttaagccaagactttgacattttaaaaacgaattttagaggaaatcttcccctttgtatacatatatactgaggataatttaacattgttcagtgactctgagatgtcagggagaagcagattaatgtgggaaagctagatccctggagtcacatccgctgtgtatcacctgtggcattttcacttattcattcaatctgcatttactgtgggcctaccatgtgcccgtgaaaggtggcaaaacagatttaattctggccctcctggaactcacagtgtagaagagaaagaagacattaaaggactggaaaaataaacagaattatagattgtgaaaagtgagatgggaagaaggatcagggtggtaaggaagagtgtaagtggagagacctaccttcaatttgggtggacagggaaggtttctttgaggaagggatgtttaagctgagactggaaagacaaactggagagagataggcagagagtaaggaaactgcatcctaagaacatggaatagcccatgtggacgcccctaaattgaaaaaaaaaaatgatgcttttacaaactaggagaaatccaatgtggtcaagcatagcaataaagagagaataatgatgaaagaagaggttgaggagtaggcagtggccagatgatgaggccccacgggctgtatttagggtgattgtatatcaggtttcacaaggatagtctggtttaggcctgttgtcctagtataattattagcagctctctcttcactcttaaaaatgccctggtttagacaataaattgtatagtcactgtagctatattaaacagtctggatttttttctaagggtagtggggagcctttgcagagttttaagaaggagaatgatatgatttactctttaggtgataaggcatgagtggagatgggcagcacagttggaaggctgttcaggaggtgaggagatagatggcattggctggagcagaatgaggacagtaaagataaagggatgtgggtggattcaaaatatattttggagttagaatggttaaattctagtgatgaggcagaagaagttatcaagaataactcctaggccaggcatggtggctcacgcttataatcccagcactttgggaggctgagacgggcagatcacttgaggtcaggagttcaagatcagcctggccaaaatggtgaaattccatctctactaaaaatacaaaaattagctgggcatggggcacacgcctgtaatcccagctactcgggaggctgaggcagaagaatcacttgaatggtggagattgtagtgagctgagatcgtgccactgcactccagcctgggcgacagagaaagactccatctcaaaaaaaaaaaaaaaaaaaaagaataacttctagataaactaagtgactgatggtgctatttatggaaatttggacaattaggggtagatactgagggaaagaacaagggctcagtttttgtttttgtttttgtttttggttttgtttttgagacggagtctcgctctgtccccaggctggagtgcagtggcgtgatcttggctcactgcaagctccacctcccaggttcacaccattctcctgcctcagcctcctgagtagctgggactacagatgcccaccaccacgccccgctaattttttgtgttttttagtagagacgaggtttcaccgtgttagccaggatggtctagatctcctgacctcgtgatccgcccgcctcagcctcccaaagtgctgggattacaagtttgagccaccatgcctggcccaagggctcagtttttgacatgttaagtttgagatgccgtggagatgccatgtgactgctcaaggataagaaattggcccaaggataatagaagataagcagacttgagtagttctaagtagatctgagactcacgctctggtcctgtgaatctaaacctacactcaagaaaccaccttatatgtagagctgtacttaggtattcttcatgccatgttttctgagtgtttgatgaatttctaggcccttgcctgtgaacactaaggtgcagcagggttctaaaagtatatttaaataaaattccaaaaatgagcaccaaactgttcaacccacaggaattttctgaacaaggaggaggaggaatataggatataagattatggggcgtggctgagaccctcacttggcagactaggacatcaggcccaaggaagctgtatttcactgaggctacttaggtagtgggagaactgggattacatcctcagtcttcatccctcccaggttgtcattctttccaagagtagaaaatctatgaacagtcctctgatgggaggtcacttagcaaatgtatggatatgacacaggtgtttgtttttggccctagttaagggagggttttagctccatcaggcaaggaagaccatctttaaacagtcttcctcttgtcaggagaactagtttgattgttaagattttctagtggtgagaagcacatgtgttttgagccagcatgccacagagggccctattgtgtcaactcacttacgcgtgcatctcagcgcagctgatatgtccatttgctatggagcaacagctggttgcctggtgggtcaatgcggctgctgtttcaggtggagacagctgccagctaccaggtatagggaactgagaggagaaacaggctgacaaggtcactgcttttggtgttcctgggacatcatactagttaactggtttggtattgtccattggatggagtttttttagctcctctcatagagttgacctcttacaaaattagtgcattcaatttaagagaattaaaaagaatttcagacaaaaggatgtggttgtaatacatcctgctagagatgatgctgatgatgctgatttcatacaacattcctgtagtacccatcaggtttcagccaattaattaaatcataccaagcctgggaatgaagtttgaattattctgcatggaattacccacacatttagtgatcattgctaaagcaacatttgcacagaagttgggtgtcatgtttaccccaaagtgacttattcctttcatccatgtctctcagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaagtgagtgactagggctctggaggaaggagaagaggggtgcagtgtgaagcatctcaataccatgatttatatgacctccagtgaaatacagtgaatgtgctaaagtcatccacatcattaaagagagagagaaaatgaggggaaaaatgctaatagagatataaggaattaccttagaataatgactgcgaaaactggtaaaactataaatgtggcattaatttttaatataaacacatgtcagaaagcatattataattattccttaagtaatttattttattgtgttttataggtgacaaagaagttacttttccaagtagattattattgttgacagcttttgtttttaattccacaaaatttgaagacacatcgagttagcatttgtaatgtatttacattctgtagttggtagtacataagtttttaggtccctttgaaaatccagaccctataaatatgtctatattccatgcataatagagcagaattttgcttacagtttctaagatttcatagtgataggctaggaatctttgctttaaaggagaatgtgttgttcttgaattattccttcccattttaaagagcacattgaactatgaagaatgttgatgattattccagagcacataatgtagaactggtggatcataaggtcacagagctgagaggatctttaaagggttttctaacctatgtcataaccctttggttcagcccttgaattagctttgtcttaagagtcccttctgttttgaaaggagatgacctccagttgcctttggtagcttaattctgcctttaatgctccctgtcggataaagtgaatcatgttgctgaatgtgttctgttgttgctttgctttacctactaaaaatattacatatcatacaaggatatctaggaagggttgagatctaatgtatagtttatattgatgtttatttattgagagtaattttacagatacaatttatttttatatatctacttgtctgagcaatgaaaaagggtttttattgttgttttgttttagttctgctatgaaggcaaagctaatgtaggtgcaagcttttttggatcccatttaataatatatcctaaacatagaccagctagtgttgcccttaaatttctaaaatttgtatagtggtgacattatgacaaaattttaaaaatacagtgtgttaaaattagagaggaagtataattagcattgccaagatatatttttgtttatttgtgttggccttatttcagttggcaaaattgaatgcattttgctacttgtgcctgtctagggaattgactgctctaccccatgccctctgggaacctatgggataaactgttcctctcgctgtggctgtaaaaatgatgcagtctgctctcctgtggacgggtcttgtacttgcaaggcaggtaagaatgggtaaataagtctttaatttgatcctggtcacgttatctcctaaagacacaaaaaagaaaaaccttaaccagggttctagctccagttgcaccaaaattcagtgtctgacctccgcaagcccctcatccagtatgggctggaacgctttcctgagtgaagggaagaggctcacattagatgatctctgaagtcactgccagctccaaaagtctctgtgtctgtgcacttttgggaagagtaaacaagcagacatgtgttcatgcccctaaattgactggcttggaatcatgacaagaaacgcagccaagcaccaattttatatgagcactagaacgtgtccatccataggtgcagccaggatcctggatatacacagttgctggttaatggggtcctgctttaaagatggtgttgtgttttcaagcagaatcctttgtctcccttccatataaatatttcactttcctgatctgaacaaaactcagcattccacagtgtgcatcactgcccattaaaggtgctttgactctatatctctttttcagtagcccactagtatgcagtgctggcatcctcgacagatcacacaacacacatggctgtttgggtcgtcaggggtgccttctgttcatttctgatggaggcctaacttggcagaaccagtgttctctgctgctgtggctggggcttgcatctccaaggcgtttctaaagagaaacgtggtttggaaaggctcaacaaggctctctgctgcctttgttcgctcacgtgctctggcgttcttgtcgcacaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggtatgcacaaatcagcgccctgacggaaaacgcctatgaggaactgatgttgtaaagttggcttctttttgcatttttcctgacttcaagtggctcactgtgaacccaacttcggtaactactggaagaatccaggtatttggattcaaattggacgtaggattggaaaagagatagacatggaaactggttagataggctctgcgagaatttcttccttcttttccttcatcttgttcagtttcctcaacccccaccctttactttctgtttcttattcacccatctcttggtggcagccagtgaacagtactggtctccaaatattttgtttccactatcatggaaatctccctgcctttatggtagaaagtggcagggagttgaaaggagggtggtgactgatgtcatagaaatgctcatggaagtgttgaaagaaggtttggaaacaatgtcttttaacataagtatctctggagccacaaaaatttcttaagatgtccctatagctcactctattcccttgacctactttggagatacaggtcattagaaatctcatactgcatctacctcaagctgtcagggagtgcaaacgggaagtgcattctggagtaagctgctgatttcttttccatcactctttctttctatagcaattattttctcctgagccattaggcattctctctgtggtgtgtgttctctgcctccaggacatcatctgatggcgagttaacaatgtgaccccctgaactgggcccctcgagaagggccttccacaatgctcttgtctctctgggcttcctcctcattaagtacaacccacttcccaaaatagaaaggatcccactcatggatatcccatggacagagctgtcagctttgctgcctctcatcactctagtgaacaaattatcagtacttggagatgagcttgaagatcactttttactccctatctgattgtagacaaagcaaagcccctggcacaatctcgtcctttttcataccttagaggagttagtaaatcagtgaaggctgagggtttagtggttcatatcatgacaaaactaaatcctgtgtagctgtatcaaacattggtggggtctacaaaatgattgttttctttttcttattttaacaagttctagacaaataattattcatctagcacccactacctgtctatgctggttcccatgttcctcctctgtggtaattctgtacccctgtttctcttagttcttgggtggtgttgggaaggcttgtagtgcctccctcatttcccaggatctgtggtgaaagagctgaactttccattctttctccataaacaaaacaatcatgtctatgaggagtcttgtctccatcagaccatccaaactgacgtgcacatgaaagtataaaagatctggaaggggaggagcaaggaggtgtgtcaactcatacttaggactgtgagtcaggatattttgtgtggcttagacttcttcctgaaaagcaggataataatcagagaaaagtaacaaaatatcttcatttttctttatagtaccatgtatctcgttggcaacttatggcaatgaacttaattcaattaaaactataatttttaagattagtttataatttaaaatttttttaaattataaatttttttatattttataaaatataaataggcaggagaatggtgtgaacccgggaggcagagcttgcagtgagccgagatagcgccactgccgtccggcctgggtgaaagagtgagactccgtctcaaaaaaaaaaaaaaaaaaaatgaccctgacccacacaaaaaagctctaaaattatagttttaaaactataattttataatttaaaaaatttttaaagtgtgttggcatgattggcttcactatttatatgtcccaaccgttgtgtcaggcataaactagggtttgagtgactttaaaacactgacttcctggagcctatattttggggactaagaagacatagaaagaggtgattaagatgcatccctctggctgggtgcggtggctcacgcctgtaatccaaacactttgggaggctgaggcgagtggatcacctgaggtcaggagttcgagaccagcctgaccaacaaggtgaaaccctgtctctactaaaaatacaaaaattagcctggcaaggtggcaggtgcctatagtcccagctactcgggaggctgagaattccttcaacccgggaggccgaggttgcgctgagctgaaatcacaccactgcactccagtctgggcaacagagcgagactccatctcaaaaaaaaagaaaaaaataaataaagatacatccctgtaagaagcgtttgggacagcagggtactgtatgtgaaatggctgacagtggccttttcctcttctgttgtgggatttcccaggccctcattgctgcctttgatgctgttttccatgcaggatggcacgtacgggctgaactgtgctgagcgctgcgactgcagccacgcagatggctgccaccctaccacgggccattgccgctgcctccccggatggtcaggtgagagccaaggaccgctaattgaaaggtgaaacccgccaatttaacacctagtgctgttccttatcacttcacagaaacacacaccagtcaacttttcaaaaaaaatgaaaattcgataaggtttccagtaaactgaaacctttaatctataatccaggactgattttttgttgatttgtgtaggggcagttctcttgagctacaagtaaggtccagctgtcaaaattcaggccagcaagatggggaaaatgtgaattgctttgaagagttcagcaagaccactgtggtatattttgagcactgaagaaagaatgattgaaataaaccctaaaaatatgacaagggtcaccttagtgaggcaaaaaaatacagatattaatatggtgaatatgcatatgcatattattgtatggttaatatgcaaatattaaaatgttcattgctggaagtaaaagttttaaaactttctttttttacgataatgttctggtcatgacaaattcataatatgactgagtacaaattctgtaaccacagggtgggagtttctccttatttatatagcttcaccgtttcagccaggaagtttatcaagctaaaagtgatactgaaagaagaagtttctgctcatggtatacagacttgctaagatatttagtgccaccttccaagtatcatgagcaaaaacattgttcttcttctaggactactttacattcctaccagtaatgtacgagggttccatttttttcatttcctcaccaacactagttattatctgactttttgattctagccatcctagtcagtgttcagtggtatctcattgtggttttgctttccatttccatgatggctgatgatattgaacatctttctgtgcatttattggtcatctctattatcttctttatataaatccctgctcagactctttgttaattttttaactggattttctttttactatggcgttataatctttatattttttagatatatgtccttatcagatatataatttacaaatattttattccattctttgagttattttttcctttcttgatgatgacttttgcagcagaaaagtttttattttgatgaagtctagtttatcttttttatttcattgcttgtgcttttggtgttaaatgtaaaaaaacattgcctgatccaaggtcacaagatttatgtccatgtttctcctaaaaattttatagttttagcttctgtatttagatatttgatccattctgaggtaatttttacatacaatatgaggtaggggtccaacttaattcttttgcgtgtggctatccagttgtcccagcactatttgtgaaaaggctattctttcccccactgaattgtcttgataccctttttaaaattcagcattccataaatgtgagaggatttatttctggactccgtatttcatttcatttgtctatatatctctccttatgccagcaccatacagttttgattattgtagcttaggaggaagcattaaaactgagaaattgaaatccttttaaattggtttttctttttcaggattgttttgactattctgggtccttgaatttccatgtgaatggtaacatcaatatgttaatttccacaaagaagcaaggtggaaatttaatggagattgaatctatagatcaatttggggaatactgtccacttaacaatatgaagtcttcagattcataaacatgggatgtcaccagcaacctcttcagtagtgtctctcagccccttggaaaatgttgagagcttctttggtttctaaaggagtaaactgagatgaactgtcatgtgcttgatttctagtgtctgagagctaccttgggaaacaggctaaggctggtgcaatggactttattttctaccaataggagctacccacagacacgaggcctccccaaccctgtagttccatcttgacttgcaaaacctgagataacttgacttcacaataggaaattctgccttccaatgtttcagcttggctcttcatccccaaatgttaaaactgcatcaactagggattgaaccagattttgtgacttcactagggttcttgaagttctcaaatggagagatcgatactaatttctcaatgaccacggtgaagcaaaataacatttttaaccttctggcaaattcagaattttctaacagagagaccacatcatttgttttatacaacactccaccaaatctacttctgtcttataaagatagaaagaatgtgaggtgttcctgaacacaccagtcactgctcaagtgtccacctgctttgatgatttagaactatcctgtgaaaggcacactctagtatacatgagaagagcaagagataggatttggcctgaagccagccggaaaatgtgttagttgcattccacagtctgggtcatggggtaagacaaattatcccatctgaccttagacctatcaagctcctacgggaatgcagtggctttgtcacacaatgtaatcttgtaatcctctgtccatctgtggccggcctgcttctctaaacgggaagactactgcttcatgctgctctattgcttgttgcctaccatctctgcctcatggtctgtcagtcattattgctcctagaccagctaagttgccccagtgtctcatttctgggtcttctgtgtgggctgttggtctgtaagcatctgtcagtatctaagcctgctgtgaggtcatccctcacaattacagaatacacttggtatacaaaaacacatgtagaggaaaagaaaattactgaagttccaaaaaacacctacaattggaccaagaattggcttatttttttttttaaagaaagagcagcttctgtatattatttacaaaggtcatcatttcattgtctgcactggacagactaataattttttacccataaaattgtttagggttagtaccctgttaggacctttttgaacgtaaagaaggttttactttccatttaagacaccaggtttgaggtcaaaagataaacataagcccagagaagcaagcaattctatttcttctcatccctgttgctgagattgctgtaggtgaaatattaagtatccctggacagggcagaagtatgtaggataggaggcttgtgtgtagtgaggcttttatgaataaatcagtgaaatctgacacagaagccagggctcttcccctgatcaaatcaacaagatggccttaagtgctccgtcaactgtggacactgtggggagaggctgatcagttggatttggagccagagataagagtcaggagggccttgttcctctttacaaaggaattgacatgactaaattgaggaagtctcaccctaaggtgagatgccaaggaagatggcttgctgtcttactgtgtacccacatccaccatttcttataacttcaacccactatctagcatttgactgttctctcaaaggaactgaggcttttttatttctattataattgatagtcctattttacctagtcataaaataagtcctcaaaatatactgttatgaaaagtaaacaaaataaaagttgtgtttgacattttagatcctatttccaaaaaaagtaccattttattgtagtatgtggttatttaaaaccttaatttattgtcatttttagccaatacactattttatcaaaaagaggcagattgcagtagaagaatgaggaaaatgaaataccattcaggatttaggctgtgtcctatgctgcttctcctacacctctggacctctggtacacacacacactctctctctctctctgctataaaatgaggctcgcttttcaaaatgattatactgaaatttcagatgtcaatgaaatataattatgagtgtttgtgtatacttatgtatgtgtgtttccagagtagtggagtgatatactttataaaagcattttcccaaaattacagaaacaggctgaagtttatgtcttcttttctgctctgacttcagtcagccagaacacccatttgctgagcattacagctaatcaagatttcattccagctgactgggaacatgtgcagtgtccggcctcattcccagccctggctaagatcactgtcacctgggaactcttcgaacttgcatattcccagtccccacctcacacctactaaatgagaatttggaaagtggctgaggaggaggaagattatggagcctctgcccatccagaaagcaactttgatacaaatttggaaaagatttggaaatccctcaggatgtactccttggcacatgaagtgcaagccggatttctgccccaacttagccccttgggcaggggctcttgcatagtgcacaacttgcaaaaccttacttggtggctttgtctgccctggtgacccaggcaggcagtggcagttacggtctgcatagtggcatctgctgtgtcatattactctagttattgaagaacttggggtctggggtgcatttctttgacagaaaccacataatcaatggcaaatgagaagaggtggttcaaggatgtgtttataccagaataaaaaagttaaacactaaacagataaaaaggagaataggacacccaatgaaactctaggggtcttgagaaagagaggagagactatcaaggcatggtataattgtaaggggaggggtaggagaataagaggagaggttgggggctcatctgagcccagccaggaagggtgtaatcggaaggaggatcacctgtgggcaagttgatgtgaagagcccacttctccgctcttcccagcaagcagaactaggcctagagtggccgcagcctccctccacaaggaaagctctcctttccatgttttaccaaacagcaagtttgaccagctgagtgagtgagctgctacttcagggactaatctgtcgtgaggtgatgtctcatgcagctaagggatgcctgaactgttaaaataaggggagacctaccttcctttgtccagtgacatataagtgcaaatccaagttggaggtaataactttagtcaaatgagtttaattaacatgcctgcacccaatcagccacaagtacaaatgactcactatctgacccttttgggtattgagggctggagagtgtgtctgcaggttcatatgtatatgtctgtctgtttggtcttgggagaggggatcatataaaagcagaaggctgggcccctgctgtgagggtgaagggaggtgctcatttcccccaacaagaaaaggccacagaaaaaaccaaagctccaagatctgcctagcaatcctttctacttgcttttatctgggtccagactgaggcaggccatggtgtctggtatttttttttttttttttttttttgtcttgcaagtgcaaaggcaaacacctctgatttatatgacttattaagacttttttcaactttgttgaactatataaagcagattcttttttactgggtctttaaaatccatagtatccaaatagaaagatttggtttaacaaccatttgttgagtgtctccaggttctatgcaaccataatgcttgggtgctgggaacacagagaggaagtgaagccaactcccatcctgcagaagctcacattgcatcaggacagtcgctctatcagcagagatggatataccagtgaataacttctctatactacaccacactatgctgtactacactacactacgctacactacactacactacactatgccactgctttgttggtcaaaggattagaaaagcagaaaaagtgttgtgactaaatactatagttcctccatcttataattaccaagcccaattattattaacaaatatctctctttgctctaatatatgtttaatagcttgttgcccaggaactagacatagaatcaaaataatttccttcattcactaacgctccaaatattggaatactggcataaggaatataagcaattaagtaagacaaggatttggggttatatctatgagaggggaaagaatgacaccccagatgatttatttactgcattcatgcaatcacaaatgcccagtgaatgctgatttcacattgaggccgctggcataatgcatcaggcattaattgcacgaacatttctttagagctgcttagctgaagtttatcacgatcattcagccattgcctagcaacttgtggaggctatcaaagagctctttgttctcagtcgtggcaaaaacagtcccttacagatctccttatcagcattagaacatttatcagaaaagaaatgctcccattgaaccagagatggctgcagatttaaacctacccccttcccacgttgccccttcttcccaatattttagaagttatttcctgaactattaaagtttctatctgttttttgctaaaacttctgaaggaatttccttaagatgtcatataattcctttatggcctaataatctgggcttacatgtaaaaacacagacctgagcccctaaatgtgtatctgctcaagaataagcaaggcagacatctccacctccttagcagggaagggtcaccatttttgatatacaacctataaatatgttgggcttcctggtttgagtgaagacttattcaggaaagcaaagaatgctgtggttgctccatcccattggaaagtggtcctgaatatcatacaggaaataggaattatgtgtatcgattcattcaacaaataaatttatttaacacctcccatgtgctaggtgctatggtgagcaaaaacaggcattgtctctccctcagggagctgccagaattaattacctttggtggagaattggaggggagtcttcatctgcattttcttctatatctctccagaattcctcttccccgcatctctgctgacattgacttagtttcatgccttgtcactttgatcattttttttatttggggaaccccaaatgggggttctgcaggtaaaagagcacctgacaggttttctttcttcccaggctcaacatcttctggccatcttctgccctcctataaagcacaaatttagttgtgccccttccttcttaaaattgttcatttggtccctgttaacaccagggggaggttcacactctatagcatggcgctcttggctcaactcaacttggccactgcttggctgcccagatgtctcacctgctctccccagcccctgagttttagctgtacccaacacttgcaattcccaaaggacagacacttctttgggcctctgagccttgccaccactgttcccttagcctgcagtcctcttcccccttcacaagctacctcccttcctgatcatgatccccaggcagagcagggtgtgcctgttctgtggtcattatcaccctggggttacatttttaagaaaacttctcacagcaaaccagtagctggccagatcccttgaatgtttgctgagttgggtttccttttctgcctttgacaaacaaagaaacaaaaagatgttttgtaggaccctagcaaagctggcaaaaaataagaggagataaatataaataatacacatgtacccacacagagccagaaataatggttaaagcaaaacttacaactcttcatcctggagaatatttcattgcagggttatccttacatggaagtcacatcagcagtcatatacctggtgcgacttagagaaacacttacccaacactctcttagtgatacttactgcctgaaattccacaattagatatttatttcttaggctcttagaatgcatgctctcttagaatatcaatattctccagagaaggtactactcagcaataataaatgtatcttgtccttttctgactgtaagatgaagggaaaaataactaggagggcacagagggccagaaggggagaagcagcaataggagaagagggtacagcaagaggaggaaagacaactccacacctttccctggaattgccccctaactgagacatacttgatatttatcttcacatagattaggcattagtatctgcaaaatgctgactcattttttactgatgacagagtaaataaaagggcttgaatttttaagagggtgttggtaatagaatttttataatttatattcaaaggaaacatttctttgcaattctaaactaaaagttattttcaagtaagcttgggtctgttgaaagatgcttatatgattggacacagaaggtttgatcaatgatctatagaatttgctatgattctctggaaatgaaatgatgggtaaaccatatgaaacaagcttatctctgcagtggatcttcttgctatagggtgggccttgttacttatacaaacattaccaggatatagttgattatgactgatggctaggctaatcagctgaacaaacctcttaagggaagaagaataagttatgaaagagaggatctctttattcagatttgcctatctggcctgtagtcatttttcttaccatgctctgattgagaataggctaagctatacataaatcatgataacctatgatataaaaaagcagcaaatacttttgacctaaagtgtactccattccatcttaactgaatttattaagtgcaatttgaagtagtgatttggcaagtagttgataaactaagtcatcataaatggctaaatcttacctgtcccccaagtccccaccctaacaaaaaagcataaaaaatcgggactgctttttcaggatgatgatcagtcagattaacaggataattactcagtttccacttcttcaaaatcttcgttgggatttgtcttgatggcatcagaccaaaatgccctgggttgattgtctaagtctctgtgataagcaggtgtccccatcttagctgttgttaagcaggagtcttggctcacggtcagagtctaggacctgaatttgaactgagagcgaagtgtttagcaggttacccttgttggtactttctttaaattctcaaaacaaagtttaggtttgcagcctcattttgaagtggtttactgcttaatatgtttgatgcttctgcccagtataggtgtggatataaattccaggtaagattctgtggctgatgtatcacatctggtgagggtagagtttgcaatttcatctcagattttcaaaagagatttgaaaaaaaaataatatatttatgattgcaagaaaaaaatcaacatagtaggcccagatttcatactttattctatgggaaacatttaaaccccaattggtttatgaacagacctggtctcctttcttcagcccatggtccgaatgaaataaaagtctattgttgggtcaagctagacacaatgaggtctgcatgctttcttgcctatttaatggcctttaccacgtgggagactttcagaaggaaaaaaacaggaacagtaaaaagtggatcttcttgctattccagtgttcaccggaaatggtgtaccaattaacaacattcacattatagtttgggactgcttccatgttaaggttcagactgtggtgactttttgcctgattactttagaagccaaaactgtaacacaagacatgaccgtctcagcatcgtggtactgggtggttgttagtattctggaatcctggagggtctgcgtgcttgctcttaatgtgttttcatttggtctgaggccagcaactgccagttcactactaattataacttattgcctttcaatgtgaagaacatttctttgagttgtgaggaattctggcaagaaagaggcccctgttgtatttccaatacgaatgtacagaagagacttttatttatctcaaataaaacctggttttagttttatttttgcaaacttagctttcctttctgtttccttttgtcattttttttaattctaaagtttctcagtatttaaaattagagttaaacaactgcatacagtttcataataatcgatagcatagacaacagctacaaataatgtcagttgtgatattctgccaatatctctccaatgtcaggtaagatttttaaggaggaatttggtggcacgtgtcagtgcatctttctgttctgcacaatgcaccatcaagttattttaagattatgtttatttgtttcatccaggggagggttttctttatgtaaaacattttatggaactgttcattgccttatccttttacactttatttctctgtgaaaacaaagaatgggaggaggaggaggaagtcaccaagggctaaaagatatcgtattgttgataaattttacttgcaatagacagagcccttgggcttccactttattgcctcctcctgaagaagaaaaatcaatataacaaaagtttgttattcgttcttcatgactccatagaaaatcggtctgggtattattttaatgttatgatactgtgtattgatgtttataagatggtaactctccattcattgctgctggtgatcctcaggtttaacactgtgagcttagtcctcatctatgaattagcatctgcggaaactccgcactgcctctcactcagccttgccccatgtgcattatttcaggtgtccactgtgacagcgtgtgtgctgagggacgctggggccccaactgctccctgccctgctactgtaaaaatggggcttcatgctcccctgatgatggcatctgcgagtgtgcaccaggcttccgaggcaccacttgtcagaggagtaagtgtctcattaggcagtaatttccaccttcccttccctgggcaccatgtatcgaataatgatctctgtcccacctctcagtttatagtgatgtcctgttgcagttgaaggcaaaagagagtgtaatggttcacttgtcctttgcagaactgtgttccctaagagcttcattctttccagccttcagaactaacctaacagatggggatttaaccatttcttctcaataattacttcattgcctcattggcacaaccatcaggatatatttcttcacccttcctgaaagctttggaatggtgttctagaaattcactgacctgtaaatatgttattcagcagtttggcattggccttacctcaattaccagacgtcaacatcagccaaaccttgaggcaaatcattcatcctgctagtagtcttaaaatcagtgctatggggaaaatggaattgcaaagttgaaaaaggagactgttgacattggtccttaagacttctgagttagaagattaagtaatcttttagtaaatgcaatcaaaaaagaatatgtaactaattataagttatactattctaattttttaaattgcctttccccccataagaattctatgcagttatcatatatttaaatctgaatagtatcttggcaagaacttaagtatatagcattttggttaatcacttttcgattacagtcattaacctggaccattttgaggaggaaaaatcttcaaattttgactgttgatcgatttttattgccagaaacgactcttaaagaataaagaatcaacaaatggtttgagagtacttatttgagacttattagtatttcaatttttttatctctttatttattcaatgaaaattcctggagccctgctttatgccaagacttgagctaactggggccttaaatgggaaaataaagaagactaagacatttgcttgctctcaagaaactcagagtttagtggcttcttttcctcattaaagggttcctttgttcctttgttgttcttgttttctacttggaaaattctccgtatcttttttacttttttttaaggttttgctttttaacctctaaaactttaactagatcccgatctggaatgcgagacaaacgcatctcagaaggataactgctgatttcccttctgttttcagtctgctcccctggtttttatgggcatcgctgcagccagacatgcccacagtgcgttcacagcagcgggccctgccaccacatcaccggcctgtgtgactgcttgcctggcttcacaggcgccctctgcaatgaaggtaaggcacgaagcatcccggacagctgggtggtgatgagcacgccccggagagtctgtcctcaggcctccccttggccttcctgaaggccatgttttcagctgtctgctgggaatgtcttctgctgtgctgtgtctgcagcttctcagataggactttgagctttggaaaagctggcttgccactccagcaaaacctttttatttcctgagatgtgctactcttcagttttagctggacatgtcctcccataaaaaatcaatatgcggaagaattttagactcccagagcaagaagtcgtgaagtcatatttctagaagtgcaatgatgtcccctggtttgtgatgccttaatgcaaatctttggcttcatggatttgtaaaaatgagcccattcaagatgaaggatgctgttgagcagagatagctaccaatgagcagctgggcctgtgacctttaaagttatttcctgtgctaagattctagggttctgcgagaggggttttgattgtgagttactgacctatagcttattcacagtgtgtcccagtggcagatttgggaaaaactgtgcaggaatttgtacctgcaccaacaacggaacctgtaaccccattgacagatcttgtcagtgttaccccggttggattggcagtgactgctctcaacgtaagtcttgtttgagaacaattaataaactgttcttatttgtttgttttcagattctttaggattgaagtatgagtgtttttatataatcaagaaagaatatatgactaattaaaagacacattctactttaaattctttttttaaaattctttttttttttcccattacgacctctatgcaatggtcctatgtttaaatccaaataatgtcttggaaagaacctaaatatgtaacattttccttatccccttttcagtgattcatcgtccattgaaataaagcaaaaacagctgtattgagaaatctatctcttcattttgtgtttatctggagagttaattacagagaaagaaaaaatggaattaaatgatgtgagccttagaaacctattgggaacctgagcgaactgcccacctaatatgcttagcttcaccttggcatcacccaagtgccttccacaccactggatttcagacaggaattgtgtgaccctataagggactatatagatgactcttagagcacccatgtcatgaaaaaaatgacatcgactataagtcattcatgaatgttttgaaagggtcagtgcaatgtctaaaagtattcaacttttgaccaaaaaatagcatatgtatggagtaatctggtttcattcattttaaattttatgaaacactctcagtttatattgaattcccccatcatgcacataagagaaatcaaagaatgactgtgtgcagtcattttacatggtgctttattgataatttaattcaaacttcacagttacaagcaacctgcaaatactaattgatgagcaatatattttttgctggaagatttttttctgaatgttaattttttccataagtagtccaggctgtaccccattttttaggaataagggaagagagctaataaatctcagaagtgtagctctttggtgaaagaagtgttatgcgatatgatttcactccattctgggggcatcacttcagaagaaatcagtctgtttaaatctacatgtgttgcaagggctctgactgatggttgggcgtatgggtttgggaagagtaaaaggtccaatatcattgtcacaaaatgattgatttatattgctcctttaaaaagtagtctttattttggaaatttgtcccttcctcatttggaggaggaatgtgctgaaaggaataaaaatagaaacacaactatgaatggagactatagtgttgcctgtcccaataatcactccacaggaagctgacttatttggcaaaagcctttgcttctcctggggatcattgatttcattgattcccttatggactctgtggaaccatcttcatatttcttcttagctgattgtgagcctgtctaaagagagcaaagtccttcacagtgaaaacacagactttgaaaacttaaaggggtacatttaaaggggcaggtgtccttgggaaaatgattttttaaagcactatctctacgtttaccttttgggaatataaagttgagtgatgcttattcccattctctgatcataacaaatatagggagaaaaacctaatggcagtgggttacctcagaaaaatatattgtgaacataaatgggtttacagaagctggttaaatatcatctaaggaataggttgttttaggtaaagagtgcttcactgagcatcaaatgggctagacgcttcaacagttttcactgagtctcactgtggctttgggaaagctgtatttgtctaacaaataacaaatattattattaatctatgtgaccttgtacgagtcactattaaccttttgtgtgctcagtttcttcatctgtaaaattaaggtgttgtatttagaaaatttgttccaatgctcactcgagacctcaagtgtcagctagtattttccccttgctcttggacatggtgcacacaattatggaagaatttttttcatttaaaaagttacttcatatgtattattgattgtctttataggtccacattccctatggggtagccgtatagaaattacaggtggtcctccttttatgcaattatgttcctaaagtattaatatgaataaaaagtattttttgtcaatgaaattattttaccccctgatcttatgctattatttcacagatactttatctgactttctgatgtctcttcaatcggcagtgacccctaatgatttaattgtattattttctggatcttccagttaagagtttttacaaggaaaccaatttttacataccgctgggaacctcaatatttaaaaggagcctgaagtggcaactctagagtagactgaagggtacaggatttagaaattgtgaacatgagctacatggccttgggtcctttaacctctcttgagtcaagtcattttccacaccttatctctgctcaaatgtcctctcctcacagaggccttcctcagaggagtagctcccaaaattattgtcttccttatcctccttatgttttttcataatacctaccaccattgatttttcattttgttggttggttggttggtttgcctgcctcccctaccaaaatagaagcttccagaggatggtttggactttgtcttatactctgctatctcccttgggcctggaacagtgttgggtacataataggtgttgaatatgtgtttgtttaataactgaatctgtaaacttgaggtgatttttgccccagccacctcactctgcagttgtaaatgaatacatatgtcaataatgacagtcgttgttgaagttgccatggccatctgggatttagtgcagaattcagagcagtgtgctttcttagtcctgatgtacactgctaacctctcacatgcagggagatgtgtagaggtggatggaattctccctacttagtattggcctcagaactctgatggacttctccatacctgtaatttcagcatgtccacctgcccactggggcccaaactgcatccacacgtgcaactgccataatggagctttctgcagcgcctacgatggggaatgtaaatgcactcctggctggacagggctctactgcactcagagtaagtgacaagccttctgaggctcaccaaggggagccttgtccaaggaggaaacagccttaccctccgcatgcgtgactggagctcaacaaaggtccctgaggttggagtacttccctctcctaatgacctgtagacatataaatttctctaagtgattaagagctacttcattccaagtattctgtctctaggttctatctccactgaggtagagcaatgctgtgtgatggtatgcagtttatttctcttctctcctttaaccaaatcatatttatatggatcaaattctcaatcctttaacagcacaaaagttaggataagtatagagattagaaaggtagagaagacaacaagcctcactgcctgatttaatgtgcgctcttggaaaaggtggagttccgtgtttttcgaatggtagcaagcttcagaatcacctggaggacacaacaaacacagaagctagttccatccccagaaagccggaagcagcgagtctgggctggcacctgagaattgccatttttatcaactggtagtaatgccaggctgggaccatgctttgagagccactgccctagttcttttccccattttgtaattcatagcatcctaaccattttttcttccattaggcttttagcatgataggatatagtgtgcaaagtacttactccaaagctgagcatcattggggaaggaagatcattctctgacctcttaccttcggttgaataaaggagacaagaaaggaaggcatgtgttatggttaagtactaataatagcgtatattttaaaataatagcaagaagctgaggaggacagatgggtctgaaattgagcaattcttatttaatactaattagagtacataattaaagaataggctgaaaaagtcttagaaactttctagaagataatgtagaccttgaaccaagagttgaaaaggataattggcaaggaaggtagctggcccaagcatattcttcagagttcgtatatctataaatattgtttaacttcttagagaaaggtacttgtaagatattatttataattctaaaattagaacgtgcttcaaagagagaaccctttttcaagtgcaagtaacatgatatagtgggaacaacatggggtccagagccagacctccctgtgtttgaatcatggccctgccgtcctgccagttgccagctgtgtgacttagggtacttggggcttagttcctgtctacaagacgggaatatccatccctgcatttctggcctgctgtaaagattaaacaagagaacgcatgaaaagaatctggcacagagtaggtgctaaataaatgcatgacagcagggagtcatcggtgcatactggcatctgggcactgcctctgcttcttgaaagttccataagaaaatgagaaaatgaaaagcatatgtaatatttggaaacaatcattgaatcagcctgcattgaatctttcatcacgccagagatccccaagacactcttgcagggcagctgccagcccatgtaagccaacagaatttgtgggtgtctttagctcaagagactcgccggtctaagcattgaaaatcatgcagcagtgtgaagggttattgctttttacaaagcacctgtgaagtacaattgttttttaaggtaagcattctagtacacctcttcagggaagttgatattatctaagataataacagatacagtggacaaggctagtagcaacaatagagatgttctgtactacaagtaaaagcatacaggtaattttaatataaagtacccgtctcagtccattggaatttgagtccaggattctagtagaaatgtgaaagaatgaaaggaaatgtcctattcttccaggattgaagggatattttgttagaaggcactagtcttgcctccaggggtaccagtgatggttacactgacaggaatggaactcttctgcctcctgcttatgaattacaacctccttgcaagagccctgtcttgggacttcaaagaagctcttgtggcaagctcagatatgtactattcactgtattctctgatggctcagtgtcattcaagtttaaacacaaatatgttggaggcacgagcctccaagtgtttctcttcagcagcctcttgactcctactgtcctccctcctcccacaggatgtcctctagggttttatggaaaagattgtgcactgatatgccaatgtcaaaacggagctgactgcgaccacatttctgggcagtgtacttgccgcactggattcatgggacggcactgtgagcagagtaagtatgagagtgtggcatcactgggtggtatttttttcctctagaatcacatttcctagatgccaggaaatattaaggcagaattcaccactccgaggttgtttgagctgatggctggttacttctcagcatgactgacttcccctcccagaggtcaggcctccctgggatcatcgctggttactcactgctctgggcggaggaggtgtgactacaagaatgaagacagaattcaagttttccattctgttcttttgggctctcccttcctctccttcttatttttggaatgtggctgctcagagccttaaaagatccagtcgagctttcttcatggcagaggcagaacccgggtctcacattggaggacagtacattcggtggggaggagggctggtggcccagggccaatccctgttgctggtgagggaacacatccatgcaaacattgccaccctttcaacaaccttctctagatcgtacttttatactgcttccattaacaacttctcatcttagtcttaacaaccttccagacaacatactgccttaaaattttgtttaagtcccactgggggagaatatgccgttggaattactcatccttatttttttatttccaccccactagctatgcatcccctcacagagttataaaaacattagtcttaataaaattgaatattgcaaattagtttattattcctttcctctatgactttctttcagtattcacgataaataaataagggcttagggctgtatcagacccactttcttatgataaaaccttttgggcgggaaaaggtgaagaacaattcctgttcaccagaggttgtactcttgggaaggatctgccaagattatggccataggagtggtgtggcctggaaagattgatcaggatagcaggactctgacaataaagcacccctccccaccccactccactggcacctcacagagccactctgaacctggttgcctcaattttatgtgctaaaccctagggtatttttgcatatcctctttctagcaaatataacaaaagtgacgtccaggaatcagctcacaacagagacagcccaattttagttttgcatcactgtttcattgagtcatgaaaacagatcctgactgagtgacacagttgcatacataactctattgtgcatataaatattgtgtgtttgtgtataaatgtctaaatatgcatggaaaccagaataggctcaaaattttacttgaatgccagatgactggttaaggtcttattaaataagaaaacctcttaagtgcttccatgattactctcaacagcaaattaaagtgtccctatttttggagacttctcccaatgcttatttgtaaacagaaaccctgtgtttgacagagagttctaataataatagcacattgccccctgctgctcactttatgaaaaatatcaatattttgtcacgaagatttttagatttaacatgcttacactatcctttgaaattcatgcctaactcttattaagaccgcatagtaagaatcctattactttcgtcttcaagacttcaacaaaatccagagtttgaatcactccatagcaaatgaagttcttacctagaaaatcagcaaaacttgttgtttgcatcttcccctattcctggctaattcaattgagaatgtgcgtttatgaagatccctgagcctacagtaaaatatatatgttctcaagaaagcatctttagtgctcttcagtctaggccccttccagcctacagttttgcctggtggacttgtatcaaattgcccttagtgattatcttcatctgttccatgggaattccacagactctccatatacacatcatagaggtaagtatgtagcagctgaaagtgtcaggagctctaatgttgagcagccctgtctctagccctgtgcagtctggactgtgagtgccaccatgattccaggaatgctgtccagttctgggacactcttgggggtacaagtcagcctcaataggaatcccctgaaaggactcagctctagatgtgcagggcttgcagtcagagacagccttgctccaaattcccaaggttggaaagctacatttgactttccttctctagagtgcccttcaggaacatatggctatggctgtcgccagatatgtgattgtctgaacaactccacctgcgaccacatcactgggacctgttactgcagccccggatggaagggagcgagatgtgatcaaggtaaatatactagctaatgtttgtagcactgcagtattgtgtgaacaccatgtaccaggcaatgtgaagtattttcacttatgttatccagcagaatcttcaccacaactctaaatggcataattggttacttatttaattgccagatgaatgccttattgttgctgtcctgcagataaagaaacaaaagcttagagaggctgagtaattttcccaaagtcacatagctaatactagaatatgtcacagcttttgtgccagatttttgttattccaaaactcatgaactttctactgggtctatgattttttttcagctttattgaggtgtaattgatacacaaaaaacacacctatttaatgtgtacaatttaataaaatctcgactatctatatacctatgaaaccatcaccataataaatgaaatatccatcaccatgtgtttcctcatgcccctccctacttctaccaccccttaagccccaggtaatcactcatctcttttctgtcagtatagattagttttcattttctagaattttatataaatgaaatcatactgtactcttttgggtctggctttgtttactcagcataattattttgaaatggaaccatgttgtagcacatatcaacaattcagttcttttcattgctgaatactattccattgtatggatatactataatttgtttacctgttcatgtgctgatggacaggtggattgtttccagtttggggctattacagataaagctgctatgaacaagagtgaatccagtttttgcatggacatgtgctttcatttctcttgggtaaatacctaggagtagaataattggggtatatagtagacatatgtttaactttttgtaaaacttgtgcccctggttttcaattggggtgtatgtcataacgacctgggaatagttgtcaggtacatggtcctatttgggaaattccgattccagggttggggactttgagaaagtgcttctgatggttctgaagcatgccctccagagagccacagctcttactgcatgtggtactccctggtaggcaataagcagttgggctataaaaggctttagaaaattgatacactgttgtagatggagtaatcttaaactgcagaccatgtaaatatttacaacatttaatttctttggtaaaatgacttttacatgcttatgatttacatttgactgtcataacaatagaatgtgatctttcattatcacgtcataattacaaatactctgtaatctcactacattatccttggtggtctgtgtttcagggcagattgttttgtaaaaaggtccttcagcatttagaatcataaaatcataggaacatttacttgagctggaagcagtgacatggaggcctcttttctcatttatagatgataaaactgcagcctgaaagcttaagtgaaagttcagaatatctaggtcaatttttttagatgccagatttcttgaatctcaacccatgcctttagcgttatcacttgacggaccataaggaagaactatgtaatgcccaattttgaatttaatgagtaaggtattagggtaatgctatcaggtattatcaggacaaatctttctgtcatggaaaataactttgcacagaacaatatcttctgaggtaaaagacccattgaaattagcaaaaggtagatcctgttcttagactagatttataatggtgttatgcttgcttggaaggaaaattactcttagaaatgctaaggatagacataaaatttggttaagcagttgggacatttagcatttaactctgcataagctcagtattgaataataaataaagcaaaataaaaattagataaattgttaccccaaattaattgccagtctaagtatttaatcggaaatatataagaagctctcaaatcctactgttgaatctctttgggttcagaaaatcctgtctctttctttatatttttttagggacagggtcttgctatgttggccaggctggtctctaactgctaggctagatcagttctcccgcctcagtctcctgagtagctggaactccgggcacgcatcactgtgcccagcttctgtctctttttgaggcttacagcagcctttctctgggcatggataggccgacaacatctgacaatgaggaatgtttgctttttcttcctgctctgtttccaaattaatgttttatgaactgaaaatatgcaggcattagcacagaaggaggtttttgtaagtagagatcaaacgtttatccagcacattgtcatcctttctcaagtctctcttctttttctagctggtgttatcatagttggaaatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggtaagagcagaggcaggagaggcattttgcttcttgaaaagttaaatttcattcgggttctttaaaactgggtgtttggctgtgctgtccattgtttctgtcaattctcattgagagaattctatgtttggaaaaggtatacattgctagagatgagttttttatttcaacaatagtaaattgtcattctgtggtttgctataagggttttaaaattgagctcattgtgtttgtggtttagatttagggaatttcaatccataaggagctttgtatccagcctcaagcttttgtcatatgtgaggggggtgaggaggaagagaggatgataagtttaccaaggtcatggatcagattagggaccagttctcctgtctctgaatgagggtactttctatgtgcttcccagcctctccctaggcctacccgaatcgttaactgaagggaacaaagttatatcagaaacagctttttggtattagcaagaaccaaggcagccctttaagaaaactcttgattttttctgttctgtcacaatgcctcataaaaggaaaaataaaattataatcaatcatcagtagaagcaaccatttacatggaggaatttaaaagtttaaaatctttattactttttgggtgattattgaaggccttctggttggttacatgtttaaaactacaaaattccgtggaaatatgagaagtagctgatttacatagtagtgcattttcagtgcagaattattgtgtcaagaactcaagtgtttaaaaaaaggaaagttgcagagtagcttcaaatgataccttcccagctgtaccagccccaaagcaaagagcagttatctgtggatactgtgaacaaaagttctctgaaaaggaatttgggggaaagagattttattccagtgaacggtttgcaaacccaggagttgcagccagtgtaaaatgaaagtgcagttcagagaacaaagggaaggcttgggttttatagcaaaagtccccacccagcttccaatcaggcccttttaggaaagtgaaggattgaaactggtttaattctaattgatcagtgcagctgagttctggttggttgacacagcggaaccctgatcctttgataaagctaagccctgattagctaaggcaggtaagctctgattggttggttcagctgagctctgaaagacccaaagataaaaagctgggttttcagggaactcagagtacaggtgtgatccttagtcagcaaaggcctgcttgactcgattttaaatttaggcctaggcagccactcctatggatcttaaataattggttctttcagtttcacatttgttcacaagctttcatacttttccaaggaggcagttaggaaggtagaggcctgttgcttctagaagctttgctgagtaggctgggcaggaggagattctgcccagcttgtgatatggaaggagtccggacatttgttcagttatttatttatttgtttttttatttagagatggagtctcgctctgtcaccagactggagtgcagtggtgcgatctcggctcactgtaacctctacctccggggttcaagcgattcttctgcctcagcctcccgagtagctgggactacaggcgcatgctaccgtgcccggctaattttttttgtacttttagtagagatggggttttactgtgttagccaggatggtctcgatctcctgacctcgtcatctgcccgccttggcctcccaaagtgctgggattacaggcgtgagccacctcgctgggcctgttttgttattttgattcccttttttcacacacatttatgggagcctgctgccttaaccatttccttcccttcttgcaggaacccttcctcacagcaatggtggaaacgctaatagccactacttcaccaatcccagttaccacacgctcacccagtgtgccacatcccctcacgtcaacaacagggacaggatgactgtcacgaaggtgagaggaattggttcaagtctttggaagtgggctggggagagaggaagggaaccagcatttattgagggccgctgttcaccagaggctgttctaggtactttacatatattatctaatttattcctctaaacagtcctctgagtgtgctttgggaatctcaagtttactgatgaaaacctgagtagtagggagtttaagttacttccagacatagctgcccgataatgagtgaggcagctgctgtgtgagtcaaagtctctctgtctctacaatctgtactgtttccattacaccgctttagaaaaacgtttctaattttacatgagattttaaaataatgactcataatgacattaacaaaaacataaagacctatagcagaatcagccgtgggcaaaatctccaagtgtgtctcttctgaccgcccgtcctccagtacccgttcctggccacctgtgctttagtaacaacaacagtaataggcactgatttgggttgaaccacatgaaattgctatttttgtaggtcaacagtggtcacatagcaacaacctaatattatgtgccaagcatttctaatcacttaaaaatataaactcatttaatcttcacaccagtcctataaatcaagagtgattattatgccgattttacagatgaggaaactgagtcacagagaggttggagacagagtgtctagaacccagagctgctactccaatagcacccaactcaccccaggtcttccccacaatgctctgaagtctcaaacatttctttcttccagtcatacccaaattatatttctaatctctgttgtctaattccagtgctctattagaaaaaaaatcaagctaattaagttaatccagttgtaatttaattaatgcagctatagattttaattatagtgcttcatggttaaatatcactccacataccccagagactttcacattcatcaatttattctcatacaaattcagggaaggaggcaaagcagataatcttatcctcatgtttacgcctaggataactgctaagagtcacctgtgattcacacaaacatacaatttttgatggaagaacttagaccaagagttctttttttttttttttttccaaatcaaagttacatgtgtataaatccaaataaggtctaattggcacaggatgacagagtgaaatgaagatcttgaggtggtggagggagtagctaggactgaaggacatgaactcctgccagcttgcaagtcccaccaggttacaagcagtcacctcggcccctgagctcaggtcactctaaggactggtcctcaatatgtgccctggacttttccccaggtccataacgctgtgctgtgccgcattgtattttgtttttaatctttcgttgtttatatttttaacagtcaaaaaacaatcaactgtttgtgaatcttaaaaatgtgaaccctgggaagagaggccctgtgggggactgcactgggacattgccggctgactggaaacatggcggctacctcaacgagctcggtgagttctcccaacgcacgtccccagaagcaccttgacctgtcagtccctgaaacagtcacggatctctgtttgtgccaaggtgttctattgaaaacttgcatcaaaaagcacaatagcagaattatgcctaacacctgtacagggctatctactgtcctaagggctttatctattcaacaaacatttattgagttcctactatgtgccaggaattgatcaaaagagattgggatctctgcctgctcgtagcttacattcttgctctatgcctgttaacttaattctcacaagtactctaataggtgggtactattgttatcaccatctgcatgttacagttgagaaactgagtcataacaaggttatgttacttgcacaggacctcatcgcctgttaaatgttagagctagtattggaccctgtcagcttggctcacagctgtgtgctcttccttgttctcttttgatatagggtatctgtacttgagatccccttccctttcaggtgaggaatcagagataccaacaggaatacagtggatcagtggttcgggcaactttttgaaattaggactcctttgcattcttaaaatttattgaggacccaaaagagcttctgttgataggggctatatctatttatatttaccatactaaatgaaatttaatatgtaaataaaaactggaaaaaatagaatgttaatttatttaaattaataataatcacatttcatggtaacataaattgtgtttttattaaaaaaaactacattttccaaaacccttcaaaattagcgagaagagcaatgctattttacatttttataaaaaaatctctttaatgtccagcttaatagaagatagctggattatcatgtctgcttttacgttcagttggttttgatctcatactttatgtagcttctgaaaaactccactgtacacttgaaagagaattagagtgaaaacggcaaatattgttgttgtattgttatggaaatagttttgcagctgggcacaatggcacaggcctatagccccagctacttgggagcctgaggcaggaggattgcttgagcccaggagtttgagtctgatctggatgacatagcgagactcacctcttaaaatatatatgtgtatatatagttttgatctcataggcctcctgaaaagggggcaggaatgcttggtccatacttaaagaacttctgtgatataccattaattatgcagtgcagtttccaagcctgtaacccatattttcagacaggagtttgatgatgtagtaacttacaggtgtgcagtgtcttacggatagcaaatcctttcacgtacatttatttggaggtaggtgccagaaatcccagttaaatttgaatttcagatagataagcaacacatttttttgtataaacatatcacagatattacatgggatgtacactaaagattattttttgtttcttttaaattttaatataactgacctttgtgtattttcatttgctaatgttttgttttgttttgttttgtttttgtttttgtttttgagacagagtctcgctctgtcgtctaggctgtagtgcagtggcgcgatctcggctcactgcaagatctgccttctggattcaagtgattctcctgccttagcctcccaagcagctgggattacagatgtgcaccaccatgcctggctgatttttgcattttcagtagagacagggtttctccatgttggccaggctggtctcaaactcctgacctcaagtgatcttcttgcctcagcctcccaaagtgctgggattacaggcatgagccaccacacttggcccatttgctaaattggatgatcctcctgggtggactctctcctgtgaatcttgttttgtagaggagtagactgggaggcacagagaggttaaccctcttgtctgaaatttcaaagaaggaaaggggtaaagccagatttcaaagttgatcttctgactgctccccttaaacactgcttctcctgtaagcagtgtcaagttctctgagccagtcataggaactgatccctgtgggaatgcctctttctatggaaataaaaatgttttactggtgaatacaaattcttagtcatttccatagtgtagtcgttatcacgctcgctgtacaaattcctaacttttatctgtattctataccatttttatcaataggatgagtatttctaaccacagtaaaattatttacatacgagactcacaatatgcttattggtaacatcatctaacattaaaggagactttttaggagtcttaattacatttataatttagctcaaaggaatatatgaattgatattcagcaaaataccaaccagcgctagtgaaagaaaagtcatcttgttctatcttagaccactgtgaagactccagaagatacggcatcactgtactggtcacatgtaaatgtctctgctttctggctcaatgagacccaagggactgagtgttaggaacctaggatcttcattggaaattctggatcttcttggtttgttctcactcaggaataattctgcatttaacatccctttaaagttgttgcacagaaaaagttcttcacaaaggacagagtcaggcatgttatggatgataaagcttacaggtgctttaaatgatggaatagttgtcgtcatggtatctgaaagagccttgaactagacacaaaagaccctgagatatagcactgggccagtcacttaccctcacttacccttgattcgttcatttgtgaaatgggagtaataagcatgtactggctcgttttgtgaattaaattaaaccaagcatttgaaagccctgctccagggatgggtgtatataggagtttatagggaatcctgactgctccctcattaaaacagctccctgatcctccaaggcaatgaagacagaatctggcaggggtgtctggcctcatagccccagctcttattccctaacttactatctgctccatgctggttctctctttcacaccttggtggaaggctagccactgcacagctaagattaaaatgggcatttaataagactttgctacagtctggagatggccaagagtatttggcaaagaggagcatagacagagctccttgataaagctgttctcagaggccacagactgtgccccatcttcatgggtcctctttataaagtctgggaattcccaagaccaccctgacttctgacatcagctacaagttgaaagatcaccaagacgaccctcaggatcaacattttgctacaaggagtcactgaactcactgaatgggcattctcatggttacagtttatggggggctcagtcatatagacatgattgactcccatcatgtagacatgattgacctttagtctttccccttccagaggtggagatgataccatatggcccaaaccccccaccataaatcacttggttacactatccggtgtatccctgggcctccgggtgaacaaaagcactcctattgggcaggacagtccaaggacttcaagatcacctcccaggagctgagggcaaaggccacccctttctttgataaggttaattcttcactacacacccatttatgctgcctccctgcataaccgtgtgcccttccccccagctatgggcttggttagactcttcacaacccagatgcaagagagtgtgcctgagagaggaaaatattcccatttcctgtcccacgatgattgatatctgacagaccctctccctttaggagaggctgcttccttctccacaacagtgtgtgcttactcagtgatccccatgggacaccaacatcagaacttgagcttaacatctctctaagagatgcatgcacagtggcaaggatatcgtttccttaacattctcaaatacttacctggaatgttcattgctagttgttactttactctctgcttttaacctaagtctgtaacattcttattgtattgtatttcaaaagattagtgatgaagttttgccatattgcccaggctggtcttgaactcctgggctcaagcaatccacccaccttggcctcccaaagtcctgggattacaggcatgagccaccgcacccggcctgtaatattcttttgaaaggcaattgaaaatgccttggagtgcttaaggaaagactgaagcagagggtagtataatgcactgagcgttagagtaattgacacacttcatttgtatggtgcttcagagtttacaaagccttttcatatgctctgtttcacttaatgatgacaaaaaccctggaaggctggaaggcaaattttgttttccccattttagagatgagaaaattgacactcagagggtggaacatcttgcccaaagtcctatggccaataagttataacatgtaattcctttgtctcctaatctatagttttctccttttttgtcacaacacagctccaatagaataattgactcccatgcagtattaacaatgcaattttgcacgtatacaccagatagtataaaatgggctaggtaatgtcgtcttattttgtttttagtagtgcgaatttgtgattaaatgcttatattttatacaacatgcttgtgacctgattgatttctgtaagtggttgcacgttctcttgcctacatgctcaatttttccagcatgagccggaacactcctatttccctccccacacccacgaaataaaggctggccattttccaatgagaaagcaggtttttttgtgtgtatctaggctcatacacaattatgtccccatacctggaaaagtcaaattatgaaaagctgaataaagaagggcaagagctagtatcacctgtaaagtattagtcaacagtgttcgaagcttccagtctccagaaaacatgcttatagtgaagacaataatataaccgaataatgattattgggaaaactatttgaaaaccatcagagccttgaaagagctgcacgtaggtatgaaatgtcaactctggtcttggctgtatcctttcttttcactgtgcaaccttgaatcaagtatactgatttatctctgggcctcagtttctatcctgttttgactagcttttcctgagtcactgtaaatgactaggtgaatgaccaaatgtgtgtgtgtttaattctaggcactggggacatctgggacaactgatctggtgtaaaggcttgaagagcagcagcctggttgtttgctgcagtgggagatcctcttccaggaccttgggatattggatggggtttttcttcctttcagttctcactgggtgttttttttcttcctttattacaggtgcttttggacttgacagaagctatatgggaaaatccttaaaaggtatcatgtaaatttgaagaagaaatcagaagcacaattaaattttttttaacctcaaagactgaaatagtttttaaacaagctagaatggcaagagaaaatgtagaatttttagtgtggtcagttactacagcaaacacacaaacatgtgtgactgacatcaagaaagtgaccagaggtggtccttggtagagcttaagtctttggggaacaaaagattcagtttgctgaggaaacactcatatttcatttaaaagaaatatggcttatggggagacggaaacatataaagggaaatagccgggacaataagaaaagatccacatggttacatgttgaccaagttctgctgttcaggatgggtgtgcatgattagatgcctagtacagagcttttactaggagtcctcccagcacaaatgccttcttgtcatgataatagagccctcttggtgctcctggggccatcaacagctggtttcttgattgaacttctgtaaattttctattaataaaacaaaacgtaattgattatattctaatgtgatcataaaaatgaaatcagttaatgatattgatgtcagtactcatcttggagaggagctaaaactactttagggatgggtcattttatagcagattctctccaaaacaagtggaaaaggtacagtattattttcagtgtgtagaattatggaaacctagctataaagaaaaacagtaaaatatcaccaagaaatgatgttgccagtgacacagcattagctttctcttctcatttctcttcacagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcagagatcaataactcaacttcagccaacaggaatgtctatgaagttggtgagttcccttaaccatagaaagaaccgagtgcttaagtttttaaaaacaattttaaagtctttacgaatataatagttgcaggtcatagaaatcttattgaaaataatggtccgtattttattttattttattttattttatgtattttttgagatggggtctctctgtcacccaggtggtgtgcagtggcacagtcttggctcactgcaacctctacctcccgggctcaagccatcctcccacttcagcctcccaagtagctgggaccacaggcacgcactaccacgcccagctaattttttgtattttgggtagagacggggttttgtcaccatattttattaatagatgcgacctgtgtttttagcgatcatattaattggtgccaaaggaattttccagggaaaatattatttagaaaaatttaaggtaaagtttctttatttttcacctaatcatccatcttttgttttgtaaccatagtgaatattttggcacacatgtggatagcatatgtatcatattagctaatatatctacttagccgaaacaaatggttcaagtggattaaacaggtgattccatttcctggttcattatattaatataatgcatttagcaagattgaaacattttacttttaaacttgtccaaaagagcagtaatattctctgatgtgaatgtgatgcaaattaatatgaattcaatttaaaattggagttattttgattgtcttttgcagataccacttgggaaatgataaaacattccaccactactcttggctaaacaatagggctatatattttcatttctctctctctctctgtctctatttctatgtctctctgagtatttatgattttaactttaaaatattctctactacttgtaaatgaagtgcctactttactactagtaatttattttatgccagatacatccctgggaaaaaatatacaaaataatttatttttaaagtattaagacagctttttaaaatgcaagtcaaagtgaactaaatttatttttggaaagtcagtaacaattctcctttaaactgtcccacaaacctgccacagtaggatgggaactcaaatgagagcctgagtcttgagtcctaaagttctgaacatgttgagtgttttcatgaactgaattaacgtttgagaatgtcagtcttctcacctgtggaataaggggcttggcctaccttatccccaaggtgtttttcagaccatgatttatttccaggattctgtatattcccttaatatcttcatcccgattatgtggtcctccttttgttctgaacaccatttgtgtttgccagttgatccaactacacagagttgccacctgtatgtgatgatttttaaaatcatgtttttaaaaccagcatttccttatatttttttaaaagtccctttggtgtgtttgacatttgcaagaaatgccatattctttttaaaaacatttcctttgctgataaattaatatgtccttggttatcacagaacctacagtgagtgttgtccaaggagtattcagcaataatgggcgtctctcccaggatccatatgacctcccaaagaacagtcacatcccttgtcattatgacctgctgccagtccgagacagttcatcctcccctaagcaagaggacagtggtggtagcagcagcaacagcagcagcagcagtgaatgacaccaaaggaccgcttggtagccactggaaccctttccagaactgctgtttggttcttctccatcctcaattttgccactttcatgtgaatgttagtcaattcggtgggcaatttttggacatgaaccagaaagctgaaagctgaggctgacacggactgtaggtgctttttgttcaggtggattcgaaggagttagagatgtgatttcccattgctgttagttttagaactatacccgtgaagcatgacttattgtaagatgttggctgaaagcatgaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctttttggtgagaagaaataagacattttctcccttttaaagatcatctcttcagagctgcatggtaaatttgaatttccccattgttctctagagctaggtcaaaaaaacaactgtttcttttcttattccactattaataaattgaaagcttgctgtacaaaggcaacagcaacttaaaaaagaaaatctggacaatagatgtggactccaaggggccactgccatcccttcctgtgtgctctttttgacaagtaaatcactccagttagctgatgtcctgaaatgacatttgtacctgaggcaattcttattagagcttactcaggacttttcaaacatcaggacacacatagcaatttggatgttgtaaaactacgtgttacatttggagaggtcttgttgagaaggcaaaattttctaaatattttgatatcaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcagaaaatttataagttatttgtatttatatataagtacatcagaacttgcccacatgataactcatgtttgctttaataaggaaaatatgttatttgaggttaattatatgatagtgaggaacattttacaattatttacagtgtttgacattaattgctgtcctatgatacagtagtaatgttaacagagagtttaatatgtttagcattatctttatggaatttatattcaccaatttcaggaaaaccaaccatagaactttataataggacagttataacctgactgaaccaaatccatcagcataatgactgtgtgttctgagaaatgcaaacaactttatgaaagtgtggtcatcttgacccccaaagagccacagtagctgtcaattattgagatttttaaatggtaaatattgcaaaagttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcacatcatgaaagtgtacatgcatatgcaagtgtgaattacgtggtatggatgtttgcttgtttattaactaaagatgtacagcaaactgcccgtttagagtcctgttaatattgatgtcctaacactgggtctgcttatgctagttcagtatttggtctaggcttcattttgatatgactgaattgcaatctatatttttaaaaagaaaaatcaaaatacattagggtttacttggttgtggcaaacaaacaaaaaatgctttcagtgttgaaatatctctattttccaaagatgataaactttcatcgttcttagcctacattgtcatttatatcaccaaatgagtttatagattaatgcaataaactttctaataa

SEQ ID NO: 563 - DNA, 170456 bp, Homo sapiens; identical to SEQ ID NO: 562

SEQ ID NO: 564 - DNA, 23037 bp, Homo sapiens
cgagaattggaaggcggcagtgaagcggaagccattactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtgtaagccctgctttccttaacccttctccccctcagttccaggggtcacgggaggcctatctggcggtgaggactaagagggtacgagggtcgggggctaaagagctaggcatccagacgaggggtgcgtttagatctcgcgatcagcgatatgaaaagctggggacgcgaaggataaaattggaccattgcagctagtgatgagagaagcattggtcacctgatcctgaaaagccctaagtctctggtgggggcggaaaagcccggctgaagtgaattcaagagtttgggggcagttcaggagattggggggcgtcaggatttggacatcgcgaggagaaatcaccttctttctgcgctgtagtcaattttatctcgtgaatgtcagcacattggtgttcttattagcacttaccttgagtaccttttatatttttaatttaagaccttctggttgcacttttttatttattttaattttagtggactcttgtaaatagcctatatgtatatttactattcagttcaacattttgttaattaacttgagttagtccagttatacttatcgtgattattaatattttccattgaattttaccgtcttattttgtggtgtgtcctttcctatgcacatattttaacactggaaaataggacatacatgcaaaaaaagtatgattacacacacacgcagacttacacacacttaaaaggacaacagtaaagcgaatttacaaaccaggccaagaaagagattattaaatctcagaaagctgtgtgcctcttctaaactgcatcctcctctcccaccaatactgtctccgtggatttgactgcgtatacatcttttccagaaaatatatttcctaaattttggtaattatttgtgaatgaactcaggcgcttcagtatttttggaaacaatctttttctgtattgattcaagcacacctttgtaatttagagatttctaaatatcttgtagatgaagtacttacacctagccattctttttcaggaatgtcatggcttaaattctagtcagttcaccaaattccacatactggacttttgttttcaagttgtggtgaatctatatttgaactttgggaatattgtcgtttttatgccattgagttgcagttaattgatttacatcatttatttacatcttctttaatgcctttcaataaagtgttttttgttgttgttgttgttttttcctttttgagatggagtctcacccttgtagcccagactggagtgcaatgacaatctcggctcactgcaacctctgtctccctggttcaagcggttctcctgcctcagcctcccgagtagctgggaatacaggcacccaccaccacacccagctaaattttgtatttttagtggagatggggtttcaacatgttggccaggctggtctcgatctcctgacctcaggtgatccaccggccttggcctcccaaagtgctgggattgcaggagagagccacgatgtccggctcagtaaagttttataagtacctgcaaaaaggatttaggttgtttttgttatatttattcttgggaactttgttttttggtgctcagaaaagtctaacttttgtgtagtttgttggatgttcttcgtagacaaggaaaatgtgtacaattcaaaaggaaaatacaaatatttattttatacagacgataaattgtcttttttgtttgtttgtttgtttgtttgttttttgtgctggactgggtggggacttcccttgtcattgactggagtttggatggcacactctaggcaagcctgtttgttttctgatcttaaagggaattgtcatttgtgtctgccgaaggcttttctgtcgaatagtttttattaggtcaaggaagctcccctcttttcctacttgagtttttcttgtgaattgctgcaggcttttaacaagtgattttttttttttttttgccattatgtatctgtttattgatacattttgtatctgtttgatacaaaatctatattgatagttttgtatctgtttattgatacatttctagtaccttaaattatggcactcagtactgctgtgtaacaaattaatgagtgaataatataattttttttctatcctgtagtgtggcaaattaaaccaattgattttctcttgttacattgaatttgtattggtaaataatttggaaaggacatgttactatttgttacttttggcttcggtttgctaatactttgtttggtgtttttggatctatgcttgagtgaaatgttccttttctgtttcagatttatgccagcctcataaaatgggatgagaagtgttctgttttctaaactctggaatgttttgcataagaatagaatattttgttccttagaacgggagtggtacctggaaaaaccatttgggtctggagttttctttgtggaaagttttaaagctattgtttctgttcttttaaggtttgtggggcattcaggttttctgtgttgttatgatgagtaaaatttctttaggaatttatttattccatctgaggtttaaatcgtatagtcagggttgttcataacatactcaaatttttaatgcttgctgcatttgtaatgttatccacttttttatttataataattatatgttgctttttacaaaaataaattccatcagaatgttgtcagttttcttcttaaagaacttctggcttgattgaaccactttatgatatatatgttttctattttataactttctgattgttatcattttcttcctttttgggatgtttctttccagtttcttatgttgaatgcctgtcacatcccaaagaattgcagtatcatactttattgtattttaattataaatatcaaatatcatggcttctttggcatgcagatttagaatttttttcttttaattttcatttctgtgactttttttctggttatcttttggtcattgtttgccaactgcattgctctgtggtcaagcattttctgagacaaacatggccccatgagtgctgtctcatcatgttcaatctgcacatagttattgaactgcctgcttaaactggatttgtgagagctctggtggtggcttcatccatttctccttagaattctgtccccccttttttttttttaatttttgtgttttccttttttttgaggctgtgttttatacacacaggcacacacacacacctctttttggatttataactttttattatgtaatacttcatttttctctatgagcctttttgccttaatctattctgtctgatactaacattcaaaccagctttctttttttttttttttacttgccttatatatccttttatttccattcttattgtactcttttttctttctttctttctttctttctttcttttttttgagacggagtttcactctttttgcccaggctggagtgcaatggcgcgatcttggctcactgcaacctccacctcctggaatcaagtgattctcctgtctcagcctcccaagtagctggaagtacaggcgcatggcaccacacccagctaatttttttattttcagtagagatggggtttcatcatattggtcaggctggtctcgaactcccaacctcaggtgatccacctgccttggcctcccaaagcattgggattacaggcatgagccaccgcgcccggctcttattgtattcttatattttagatatctcttgtacgtagcatataattggattaatctattctgtgaatattagtattttagttaaagcatttattctgttagcatcttctgtattaatatatttgaatgttacatttgtcttctgttttttctctagcttcttttgtgtatttttgtcattctccttttttattttctgtacattttgaatttatttactctattatttcagtggttgttctaaataattcttacccatgctcattcactaaatctagatttgcatatgttactctcctgatttacatggttttcttatgcattttcattctttctttattgatatatcatagttgcacatattgagttctttttttaaacctcagaagaaattattattgctattgcataccatcatttcttgtttcattatactcacatgtttatcactttgagcactttacttggttcttacactttttggtgtaattcttccactgtttgctttggttctttaattacttctttctccctgaggtatgtctttgatgatgtctcttttctgtgggttgcaagcccacaggaactttgttttttggtgctcagaaaacacctctttctctctttctcagtggacatttttggtggtaatagaattttatatttcagaactatgaagatgttccattatcttctggcttccactgttaatgatgagaagtcagctgtcagtctaatgtttgtttgtttgttttctgagacagagtctcactcttgttgcccaggctggagtgcaatggcgtaatctcgtctcactgcaacttctgcctcctgggttccagcaattctcctgcctcagcctactgagtcgctgggattacaggcatgggccatgacacccagctaatttttgtatttttagtaaagacaaggtttcaccatgttggccaggcagcggttttaggagcctagaaatgtgagtttttcgttttgttttgttttgagacagggtcttggtatgttgcccaggctggtctcgaactcctgcgtgcaagtgatccacctgccttggcctcccagcatgctgggattacaggtgtgggccaccatgcccaggcttactttgtttcttaatggagagatatttacggtgtgttttaacaagacctccaggtgactcccatgtaacttaaagtttgagaactattgcttaaaaggtaacctgtctttttctcctctggctgctgttcagatattctttttaccgttggtattatctggttcattgtgcttaagattttatctctcttcaatctgtttatattttccttcaaaatgaaaaatctacagccactatattttgcagtgattgcctaggctccttctctgtctctcatcagtaactccagttagaaatggttcaattccttatcttctgcccccacgtggttcttagctgtatttatgttcctcaactctttttctgtgcttcccttgcatttattgctacaactggctttgaaacttcagccttcataaaaatttcatgtagagtttattaaaatactgattcatcagcccaccccaaagagaattgaactgagatatgatctgggtgtcagagttacttaaagtgttccaggggacgcttatgcagcagactatatttaagaaacaaattattattattattattattattggctgtgtataatctaaaagctatttacttagggcttttgttgtgggtttccattttgctttttttttagcaattgtaattgccctttagaaatcataaatttttaattttctgaatgttaatttcttgccagcacatgaatttgaaacctatcatctgtctgtactttgtgttgcatttgaaatagttatgcatggaaggtttaattggggcacctaggttgcttgttggaaacagaattcctaccctgctccccaccccctgggacatctcatctagctggttgaaaggagggtatattgatttactaatgtaatgcatttctggaccaagaaaatggcatatgatgttctcacaacctttgttgccttctctgtctctcgctatatatatattgtatatattatttatatactttttttcttttttttttttttgaggcagtgtctcatttctgtcacccaggctggaagtgcagtggcatgatcttggcttactgcaacctccgcctctcaggttcaagcaatcttcccacctcagcctcccaagtaactgggactacaggcatgtgccaccatgcctggctaatttttttgtatttttagtagaaacggggtttcaccatgttggccaggccagtcttgaactcctgacttcaaatgatctgcccgcctcagcctcccaaagtgctgagattacaggcatgagccaccatgctgggcctatatttacgtgaataacagtggtagaaatggttctagcaagggcagaaataccagtcagtaaaagtaacaaaataattattctctctacagtatttacatctgcaaattctgaatatcctgggatactgtgattaagttgaatatggggataaaatcaaatattgggagaattatggtcctgagaaagctcataatggaacagttttgggcaacatttgttttggaccacaaacttgatggaggaggcagatcttctaaaactgaggagcagggctggagcaagggtgaggtttgtgagtgcagagccagggagccactcgctctgagccaaccttgtgcttgtctgacaccagaagtgcttccttaaataccacactcttgtctagcagccttggttgcctcatcccagtcctggccctggtgaggagaaaaacagatcccaatgagaatagagtaagatgtgtagaaatagaaaaatagaactgctttcaccatgctgtaaagaaaattaaaagagaaattaagcaaccccaacagctctgaaaaattaacctgtccgttctaactcatccatggtgacagcattccaatgacactggtttttttttttttttttttttttttttgagatggagtctcgctctgtcgcccaggctggagtgcagtggcacagtctcagctcactgcaagctctgcctcctgggtttcacaccattctcctgcctcagcctcctgagtagctgggactacaggcgcccgccaccgcgcccggctaattttttgtatttttagtagagatggggtttcaccattcacaggatggtctcaatctcctgacctcatgatccgcctgcctcagcctcccaaagtgctgggattacaggcgtgagccaccacgcccggctgatcctggttttgtttcatgtatcatgtagaaacggggcagaacgtctctgagttcatagatcctacagctgttctagacaccctgctccacatcctgctggggtcgcttagatgctgaaatcttcctgctttatttgtattcatggccaccagttctttgagactctctgatacagtttggatgtgtatccgccccctccccccctccaaatctcatatggaaatgtaattcccaatattggaggtggggcctggtggggggcgattggatcaggggggcagatttctcatgaatggcttagcaccatcccccttggcactgtcctcgtgatggcgggtgagttctcctgagatccggtcatttacacgtgtgtggcacctcctcccaaccctgctgtcttgctcctgcttcaccatatgctttgcctgcttcccttttgccttctgctatgattggaagcttcctgaggcctccccagaagcagatagcactgtgcttcctgtagagcctacagaactgtgagccaattaaacctcttttcttataaattacccagtctcaggtatttctttatagcagtgcgagaatggactaatacaccatcacccagcactgacaacccctgaaagtgatagaatcactcaggtgagaacttggccagaagctccactctgagctctggtttgcatcgttgcaaaacatcgacaaggttccacagactgaattgatgtgggtgcgctctctaagctccagccctctggacactttgtccttcatggagggtggtggtggatgttggccccagggtgttgggctaagccatagggctgtgtcctagtacctggattactgtttaatttcacaggaccttctgaggagatcccagaccccctacattccataggcccctcctttatggtctcccaaggtctgggtggctgtctcagtatgaaggcaaatgtagatcagcttgctcatcatccattcattctttcattccctacttattgtcttatttatatcaggcactggaatggtgaatgaaatatcatcaaagtaaaaagtctctactcacctggaatgtattttctagttgggcatacaggaaatcaaaacaagtaaactacatagtgtgcatggaggagacagcagagagataataatgcttacccggtgttctgtgtcctgtcctacatttcccaggatccttggagctggcaggggcatgtgactagttctggccaatgggctgcaagtgcttcagggtcaaaatatagacgacagaatgcatagttgtccagcttcctgctcatcatctatgaccaacatggccaagggtatcagttggttcagagacaagtggcatccttgaacaacaggaaaacttttgacatcagcctgggttgaacaagtgacatgagcaaggcgtaaactttccattttattgagtcattgagatttgggtttgtctgtttttgcagtaaaaaatagagcctaatcttacacagaacattacttggaaattagtgctttagggaaaaagaaaaggagtggagaattgggattgaaagaagcaggggtttgcattttaaaaagtggccaaggcgggtggatcagctgaggtcaggagctcaggaccagcctggccaacatggtgaaaccctgtctctactaaaagtacaaaaattagccggacacagtggcacacctatagtcccagctacttgggagcctgaggcgggagaatcacttgaacccgggaggcgcaggttgcagtgagctgagatcacactactgcactccagcctgggtgacagagcgagactccatctcaaaagaaaagaaaagagtggccagtgaatgccagatcaggacaggtaaagttgaataaagatctgaaggatgagagggggccaggcacactgagaatgtgggggaaacatttcaagcagaggagcagcaggtgcacagaccctgaggtgggagcatggctggcggggcctgatgcacagcagtgaggcttctgtggcttgggtgagggaccagtggcagagcgagttgtgggtgaggcggcagggacctgggcccttggtctgagtgagatgggacaccatcagaggatcttgaacagaggagcggtgtgatcttcattttacccataaagttacggctgtcatggaagctaagggaagtcagggacagcagctgggagaccagttaggaagcagttggaatgttctagaagagaagcgatgccttatgccaaggcagtagcagtgtaggtggtgagaagcaaccagatttttgtattaagttttaaagttaaggctggcaggatttgctggtgatgcaggtgtggtttatggaaaagaaagaggagagttgaaggtgatgacgagcaaggcttttgacttgagcccctgggaggctggagctgccatcaacgtggggaggctggtggcagcacagttgtaggtgtttaatgtgggatcctgttggctgttgcagtagggatactaagtagccacctggctgccactcactctgagtcattctgggtggggcaggtgccagggagcggagagtggcacccactataaatgaacaattctgttaagtaattgtgaaatcgtcagtggtcattttattttaatgataatggcattttagagtgaatgtttgtttactgagcctatagagttccatacataacccagtgttaaagtcttcagtttccagatgagaaaactgagttttgatgaactgactcttgggaggggaatgagcagaactgtgggcttgcattaaaggggagtctactgaggcctcagggacagggagaccttcacagaagtgcaatcagaacctgggtgtcagcacctccaaatggtgggggtgtttcacaatgtggacctgtgggagatgggggagaggggcccaggggaaccctgacctttaggggctgggcagaggagggatctcaagccagagtcttcaaaagagcaaccagagatgtgagcacagactgggatgagtgggctatggctgcaagagcagtggcattcccaggaagagggagatagattcatagtgagcaagatgatgtgtcaggaggtcaggcaaaggaagggtcaagatgtagtgtcaaggagttcccacataggggacagtacaggtgacataggtcactttgagaggcaacaagatgtggctccgcagtcacgtcagctgggctcacaacttccacctatgaccttgaccaagtgtctcggacccttggtgccttattctctgggtacttgagaataattccgggaggttgtgaggattaaataggagtggccctggaaagactcaggagaatgtctcataccttgtaaacactacacatgtcgttatttgtagaattggcattaatgttggtggggaaaggtggaatgggacctgcagaagcttgttagttgagcatgaatgaatgaatggtaggtgaggatggagatactgtgcctcaggaactgagcctctgtcaccctctctccccttcctcagcagtgacttaatgtcagaacccaaaggcacaatgactagaaaagggctttgtaaaaagaatgaaagcgtcatgcatctttgagttggcccaagatcaaatttggtgttgaataatgaatccccaaggcagagtttatacgttaaaacacacttcctatattattgttttgaaatgtttctgaatatctaaaacaattccaatagcagaaatactaattgatgttgaaaaagattgttataaccctggtaatgtttaaaagtggtaatattgattattgatctgagtcagatgttaaagtagcagcgtcacggttcttacatcagtgctgtcatgagagtcgcggtggaagccagagagaggaggcatgttcatacaaagcaaattaaatcccctcccgaggtgtgggccaccatacctcaccaatgtattgtggttttgatgttatttccttaatgactgatgttgttaatcatcttttcatgtgtttacagttcatttctgtaaatttggagaaatgtctgttctgttcaagtctcctgcccacttttttactgggttgtctttgttgttgagtttataatgatattaaatccctatcacatacatgatttgcaaatattttccaccattctgtgtctcattcactttcttgataatgtccttgatgttaattctaaatgtttggtagggttcaccagtgaagccccttggtcctggactttttttttttttttttgagacggagtcttgctctgtcgcccaggctggagtgcagtggcgcaatctcggctcactgcaagctccgcctcccaggttcacaccattctcctgcctcagcctcccgagtagctgggactacaggcactcatcaccacgcctggctaattttttgtatttttagtagagatggggttttaccgtgttagccaggatggtctcgatctcctgacctcctgatccacccgcctcggcctcccaaaatgctgggattacaggcgtgagccaccgtgcccagctggtcctggactttttatttaatggcttttgatgactgcctcagtctcttgttataggtctctcaattttctttttcttctagagcctgtttgggtatgtttcaaggaatttgatacatctagagcattgatccccaagccctgggccacagacaggtaccggtccctggccttttaggaacaaggccctgccgcaggaggtgagcggagggcaagtgagtgaagcttcatctgtatttacagcggctccccatcactcacattacccctgaactccacctcctgtcagatcatcagcagcattagattctcataggggcgcagaccctattgtgcactgcacatgcaagggatctagattgcacactccttatgaaaatctaatgcctgatgatctgtcagtgtctcccatcacctccagatgggaccatctagtttcaggaaaacactctcagggcttccactaattctatattatggtgagttgtataattattttaccatatattacaatgtaataataatagaaataaagtgcacaataaatgtaatgcactcaagtcatcccaaaaccatcccccctcacctcaccatccatggaaaaattgtcttccatgacaccagtctctgatgccaaattgggtggggactgctagtgtagatgatctaatgtgttggtgcataattgttcatggcattctcttacagccctttgaatttccgtaaggtcggtagtaatgtcccacttccactgatgattttagttacttgcatctttttttgttagtaattctagctgtagttttgtcacctttgttgatctttttgaaagaaccaacttttgttttcattaattctcctattctctatttcatttgtctctgctttaatctttatttcttcacttttgctttccctaggtttagtgtgtcaaggtagttgtttttgtttgtttgtttgtttgtttgtttgtttgagactgagtctcgctctctcacccaggctagagtgtgatggcacgatctcagcttacctcaacctccgcctcccgggttcaagcgattctcctgcctcagcctcccgagtagctgggattacaggcatgcaccaccatgcccagctaattctttgtatttttagtagagacggggtttctccatgttggtcaggctggtctcgaactctcgacctcaggtgatccacccaccttggtctcccaaagtgctgggattacaggtgggagccactgcacctggctggaactggtttttgtatgagatgtcttactggtggcttttcctaggcaaagggaataagatctcgagttcctactggaacctaagtgttagagatggggattcaggttaaatgagtggatgtgattacctgggcaaagcatgaggcatgcgaaggaatgggtaaagaatggctcttgagcagaatcagcctttagtggtgaaagaggacctctggatggtccagatgatccagagaagcagggaaagaaccaggagacagttgtagaggagccgagaatagagaatgattctcaaagaaaatagacaccacattttcgtgagactctaagactgaagtgcatttactggattcactgacacgggagtaaattgtattttctgtgaggatggggatgatggtagtggatgctgggtgtactgaattgggagatggtgaatgtagactgctcctaagtttttgctcggaagggggcactaaggggagccagggcaggcattggtttcaagatgggatagacctgagcatgtgtccatgcataggaaattgtctagcagggcgagaaatgaggctgaaagtaaaggagagccaggtagtgcgagggtccagagacggggatgggcctggagcagatttgaaaggattgccttgagaagggagggcagacatctctttgtcatagaaggaaaggaggaggtcatagatcagttgtgagaagactgtttaaataactagaagcaagaaggtaagaaagcctcattttttttctttcttttaagcagggtttaatatatgttcaagaaaatgcataggtcttacttaggtgatcagtttgaatttttgacaattgtgtacactgtacatctgaaaataggtaagtttctatcatcctagaaagttccctttgcttctttcagtctatccctgtcttatcctccattgaagaaacccccttttttttttcaattctatcaacttaattacgttttgcctattcatggacattatattgttggaatcagagcgtttcttgtgtgtccagtttcttttggccagcatcgtagggatttctccatgtagtgtgtctgcatagtttctttttattgctgagtagtattccattctgtaaacattgcaatttgtatatccattctctggttgatagatgtttagattgtttacagtatttggctattaggaatcagactactacagacatttttgtacgagtctttgtggatataaattgtttacagtttctcttatataaatatctaggagcagaattgttggatcagatagtcagtgtgcttgttaaaaactgccaaagtgttttccaaagtagttgaactatttcacactcctaccatcaggatatgagaggtgccagtgtgccccaaactcagcagcatttagtattggtagtcttttttattttggctgttctagttttaatttgcatttctctaatgactatgatattcaacaccattcgatgtgattcttactggttttgtgaaatgtctgtttattaattaaagtcttttaccctttttgttgggttgattttctttctttctttctgttttgaaggagttctttttattttttccaataagccttttgcactcctatctaggagttctttaatctgaatacgaattctttttcaggtgtatgcattgcagatatttttttcccaatccgtggttcactgttcattttccttttttctttttctttttttgtttttagagacagaatcttactctattgcccaggctggagtgcatgatggtagctcactgcagctgttctctatgaatttttaagtttctgattcatctcaaaagatgtttaaattcaaattcagtgagtggaggaggtggcagaagcataggtggccgcgaatctctaaagtgagagttgatgtgagaaggttgcacaggagactttgcccagagagcagatttccaaatcattgcctgtgaggtgaggctgattctagtgatgatgcagtccaggccatggcccaagggtgtatatgttggtgtggagtgtgggtgcaaagggcattggagtttggaactcatggttgatcctgggtggaccatcttcatggatagagccatcctaaatgatcgcaggcctcgaaggtgaaggaagagcagaagtctaggaccagagtgtttaatgagtgagggggtttaacagagttgtacttggtggaaaatcacttaggaagagtaattctgaacccacttatagcagatcaggggctgtccccccaccacatcaccacattgctgagagagtttacctaagtaagataaaagtccaggatcaggcagatcttgctgctcaaaagaggaaatgccaaaaaacaaaactcagagttttctttggtgagcaggagagacagatagcctttcactactcccgatgttctttcatttgctacagatgccagcttggagagtcacgtgagagcaagagagtagctttctggttgtcctggtgccctgctcaggcaaactgactgccattctctgaggatggcagctctgtcccccacatttggtaagttcttgggtcagtgcgtgccctgagaaagtgagtgcaagtggcccctgccacttgatggggtgaaagatacgtacaccatagagggctgctgggagaggatgggcaagtggaaaaggggtgggaacagagccccagcagccaccccagtgactgtgtctgctgagggtcttggtgggtctgggagcaggccagtgtccttatcattcatgcatgaagagggtgcaggtaatgggtaaccctgagttatctcatttattattttgatcactttcagcaaggtcacaactctagctctcagaacttgcatttcttcactcctaggttggaactatgtcacttcttatgagtatgtagcccaccaccctctttatgtttttggtggaacagggctgctctgacttgttatgaaactgatgtgtgcaagagaggtggggggaggaagagagagagaggattgaggatgtgaacactcagaatcagtgtggagcagtttcctggtttacaagtgttgtattatgagacagggcaggctctgattctcatgaaccctgttttctcctccagccacgtccacccaggattccacctgtctccaggactcagaatttcctgtttcttcaaaagaccattcctgtccccagaatttggacctgttcgtgtgcagtggtctggagcctcacacacccagtgttggttcccaggtgcactaagatctctgggtccctagagcaggagaggcacttcctggaagaccccaccagtgcatgctggaattcttgcagagcttcatctcagccagtggatgccagaacagggcccaagagagagccaaggaatattggggctgtcctggtgttggggaagttaggggaagtgatttatgtagcatctgtttccctcatgcttgcaaaatctcaggcccttgctcagccccagagacggggggaaataaagggcaaagctctcggagtgggctagaactggagggagattagtcccttgtcagggttgcatctgaagtgacggcacaggacaagatggcctcaatggggagagaggatgtctgaggactgatgcctggaggaaatgttgagccccgtagcaggccatctggaaatcctgtgttgggtctctcatgcccggtcttcaacctcagccatcttaccatgaacatcgttaggctggttcctcgctgaccccaagtttgtgtggcgttccaggaatcggtgactttccaagatgtcgctgtggactttaccgagaaggagtggcccttgctggattcttctcagagaaaactgtacaaagatgtaatgctggagaactacagcaacctcacttcactgggtaaggccagtgccatttctccacttattcatccatgaattagatgtttttgtttgagtatgttctgtgacccaggaactatgcagcggttcagaacgcagctgtgaacaagcagccccagcacccatgcttaatggggcctctcctgggtatcgaggcccatctattgcagggaccatggtggttctccggtgtgtgtctgagcttggcatgggcttctgaaatacgaaatccccattcttttggagggtcagtgtgtgggtacttgtgatcttatttcctatttctttttttttttttttttttttatttttggtgatgaagggttctcactatgttgcccagactgatcttgaactcctggctacaggcacgagccaccatgctttgcctgtggttttgttttctatcagtcaaaaacttttactgtgttccttagaaattttggcaccaccattttgctgctcctaagtcagacttgtccaccctcagaacactgaagacccaagtgttgagcccaggctactggaaggggttgtcctctgcatggccctccctcaacctgtgtctttcccgtgagtgtagggtatcaggtcggcaaacccagcctcatctcacacttggagcaggaggaggagccgaggacagaggagaggggcgctcaccagggcgcttgtgcaggtgagcgagccccaggcaaagagcggtgctgtgactctacctctattcagtgactggggtggagggaggtaggttagggagtgtcacccagggaaattgagagatgctccttccctctttttgcccatccattctctgacaaatcttttggtccacacactccttcatctttgactttcacattcccattattgggctctttgtcccattctttcatatttgatgtttctgatcatccgctttctgtcattatcaacatcatctgaattgccttaaatttcttttttcttttttttttttttttttttttttttttgacggagtctcactctgttgccaggctggagtgcagtggcatgatctcggctcactgcaacctctgcctcccaagtagctgggactacaggcatgatgccgccatgcctacctaattttagtattattagtagacatgggtttcaccatgttgtccaggctggtctcgaacacctgacctcaggtgatccacccacctcggcctcccagagtgctgggattacaggcgtgagccactgcaccaggcctgaattgacttaaatttctacccctggcattgccaaatatctcacatgaccagattttttaacaattgcttttgcaccacttttccttacatagccttaggatctgccaagaaatccacctgtcattgtcaccatcatcccaccattttccttttccaacaattaatacttttccaatttgtttcagattgggagactccatctaaaaccaagtggtcacttcttatggaagatatttttgggaaggaaacgcccagtggtgtgacgatggtaagatttccgtgggataattctggatcttccttccacgtctgaggagactggggcagcctaggttagaaaagcagttcaacaccagggcaagcagcttccctcagaggagactgtgtttcagagacactgggtattaccaagatggagacaaccctaaagctaacctcaagctactttacctagagtgtctctgagtgaagatttttatagctgtgtctcagatattgagtgttggggctcaatgcagtttttgttttattttatatttatgctgtacacttacttatcaatttagttttggtggtgtttattttttggggggcagacagtcttgctcttgttgcccagtgcagtgggcaacatcttggctcactgcaacctctgcctcccaggctcaagccatcctcccacctcagcctcctgagcagctgggactataggcgtgtgccaccacacttggctgatttttctattttttgcagagacaggatttcaccatgttgcccaggctggtcttgaactcctggagatccatcagcctcggtctcccaaagtgctgggattataggcttgagccaccatgcccagcctcaattcagtggtttttgtttgtttgtttttgttgttgtttttgttttttgtttttttttttgaggcacagtcttgctcttgtcacccaggctggagtgcaatggcacgatctcagctcactgcagcctccacctttcaggctcaagtgattctcctgtcccaccctcccgagtagctgggattacaggtgtgcaccaccatgcccagctaatttttgtatttttagtagagacagcgtttcaccatgttagccaggctggtctcgaactcctgacctcaggtggtccacccgccttggccttccagagtgctgggatgacaggcgtgagccaccttgcccagcctcaattcagttttaagcagtgaagaaatgctatatgcaaaaagctttgaaaaagtaacacatgtggagccttgtggcctggcattcacctattgtccttgatggagctcaaatggggcagggacagcacgtttgcacggcagatggttacagctctagtcatagtaatgtgcttctatctgttcatagcagtgtatgtggggatgacgcttagggttgcaatgaatatgagaattgcctttgtcagcacttacgtcttaaccaacaggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgcta

SEQ ID NO: 565 - DNA, 23037 bp, Homo sapiens; identical to SEQ ID NO: 564

SEQ ID NO: 566 - DNA, 82616 bp, Homo sapiens
gttgattgatattgtgatttttaagttttattgattaaattcaaacttttttatcatttacacaaagaaactgtgacagactctgagaggactaaaaggcatcaacttaaattttaacatgcatttattaaatttatatgcagatgactacactactgcaattacagaaatgagtaagaacatactctcaagatcttacagtcattggttggggtgaaagtatttcttctgtcttcatgaaaaattaaaaagatagaaaatcttgaagtattttgctaccttaaaacaactacccaccctacatttgtactaaaataggcttttgcttgttttaaaagcaattctagatgaggttatatttttacaatactgtatctcatctcaaataaatttatacattctttaccctgtctaaacttgcatgcaaaataagaaccagcaagccttcaaacttcaatcacagtattccataggctatattttaagtctattgcattagttgaaatttattttgcagagtatgttaacaaacatattctaacacttaaaaaatcattacaattttttctgtttttgtcttctaaattactctgagcagtgaattactggagggaagatacccatgtctaaaatttgtgtctggtgccagtctcagatttctgccaaacaccagtaggtattcaaaagtgtggtccctttaaaacagcaggccggatatcacctttctgtcttcaaagattcaaaccagactcccaatctgggatttctctacagagggttggctgcttcccagttaatgtgagttttgcaaagtttgcatttcatgaaaacagtgttgtgtaaacatatattgtgtcactttacctactatttactaaaatcagagagtttagcctttgaaatttatggttctctggagctatcataaatcaatcagtcatacgaatggactagctgtagactcaggatatcaataaaactaggcagtgaaatttgcctataattatactatatttagattaatagttatcaaaaacatttttccccaaaaaatacctcaagggtaaaacagaatggtaaagtttttttcaggataatgaattttcaaacatttccaagaccataaccagccattttaagtactgtaaactctgttatatttcatttggataagtatctaataagcaattattacatatcctctcatttaaattaccactgaaaactagaaataatctttatttaatacgactgttttaacaccatatggaacgggaaataactaaatgaaaattgttcacgtaaatgtgatgggagtgggggggtggggagcagtatttcttgacatgtggcatgtcactcaggaaagtaaaaggcccatcatatccaaaatgccagcttggatattcccttgccacccacttgacgaacagacataccacatggcattaaatgctgcaacctttcctaaaaatgccacttggattggtccgctgtggtgagtatataagaactcttggtctgtctcttgagtctgtgagttcaaagggaagaatctagtaaataacaccggctaaattttgccctcagatgtttggcataaatgatttgtgaggatattggaacctttggctgttttcacaccaatgaaataaattatgctacttgaaaaaaattctacagaacataatgctacacagtcacagtcgactttttgcaaaagtaccagagaatatcttttagaaacagtgcttataaagccccatatactccttagatatttcccaaggatttcttctcttggctagcaggaaaacaatcttaatattttatttattcttcataaatacaatgtatataatataaaacactttgtgcacatgtttccaacaatttcattttctatgcatctttacataaggtagtagctaataactctttctgtggacacgtattttccagttttctaaggtttatgtgttcaagcattgtaaaaacatatttaaaaattgaattaccagtaaaaatattgaatgtacaggtcattatgctcccacaaatacaaaatacattgaaaaattatatcaacagataattacatatgaaatatgaggcatatattttcttctattatttattttctccctaaagagttctaattgattaaatctcaagagacaaaatgtaattttataaaacaactgtattgttcagatttaggagacaacctaagaagatgattctgagtaggtaggatttttgctattactgttatgtgaaaaagactgctcaattaaatgacagattgttacatatctccctaacaagaggggcgaactgatactacaagcagccagaacaacataattagaatagaattccaaggttatattaatagagtaataagttaattaaaaccaagatcaactgagcttctatttacaccagttcagacagcccaagaggaaaagaactctattttagagacatatgtgactctttgagcttctgtcatccaggtgccatttctgatgcagcacatgtgcactgaacagttggcaaagaaggaaaaagattatggtagatgtatgtgcagatagtctctctaatgatgtaaaatacgtccagaaagaaagcagggctttgttgtaaaataaaaaatttcccatgactttttgttctttctgaatgtgatttgagcatgtttctgtaaataagaatatatactaacttatgatgtatatagaacaaaaatagacttactcatcaggaagtgatggaattatacacataaattggcaatgacatttgaaaaatttaggatctggttcccatttcatctaaatgtaccatgtatagggtggctgtcaaagcagaaagatatataaaagtatccagtagcacatactatactgcattgctaggtaaggttcttttcctgacatcctatgcaactatcaaaaatcatatgtctgcaaactgaaaatattagcagaaagaattaaagatgttacagtttcagtattgaaagttttggtcccaaaaggtgctttcgtaaagttatttctctttcatgcattgattgttgcttagctaatcttcatcttggtccagatcagggtcaacatccgtggtgagtctgagataaaagaaagcatagaaagccagtagtagtgccaatatagctgcaagtacaaggccaacttcctgggaagaaaaaaaaagtagacttgaaattgatgaaaaaagattggttaacattattagtttcaccagataaaataaccatattgttccacagtctagaatgaataatttgaacctaataatcatatcctttttgtttaccattttttgccgttaagaaactgttttgtactggcaagtcccaatgaaatggcaaatacaccagtgggtgagtcattagtattattatttctagctaatttgttttttccttatagtaatattaaaaatgtatcattttaatatatttttatagtttggatatcaggatgttcgatacaagcaatgcagtttgtatctacacagttgatctgttttctatttgagtgtgtttaactttatttgtggcttcaatacattcagtattaatgatagcatttgggcacagttttttttttaattatcattccttttcattgtaaagaaacagttgtaactggtctctagattatatatagatgtatacatactcattaaatgtgactttgttgaaactctaatttttaaatcctaaagtctatagtttacactgcagaggaacaaaacaaagtactcttcactcatgaagcataatacaatacatttatcacagttttgaaggatgggcccagatttttcatttgtgatgtgatgtggattaaattaatcaactatattgtaataatgataaaaaatttactcatatattatgataaaaatcatattatctctcaaaaagtatgtatatgtatatatctctgtgtgtataccttccagaactttcttaacattaacatatcatttgactaaatcaaaaaagaaaaaaaaagcaaatagaatgccagttcagtatcctaaagggcttacatactatattctaatttctactgtatattatgccctttacctagcactgctttacagagaagcaatgcattagcatttacatgaatatagtttacatttcacaagaaggtaagtcagtaataataaactttaaaaacattaaaatgaatttggcttataatcaacatggaatttttacatgaatgttgaatttataaatagatcttttatacagatttttagcttcataattacatttatttagatgtccaaactatgaaaataaatattaataaaaaccaagaggttgaaaaactcaagtgtcaaagatctttgtaaggtttcattttttaaatctaatataccaatataatgtcaaaggaaagtgaattttttctttgttgcagtagaaacactttggcatctcaaaagggcatggcagcatcagacaggtttcatttattttcttatatccacagctgtgttcccagacccatctggttacacagctactaattttaagaggatgtaataaacaagtgacacacaactgcaaactccatctgttctgtatagtggacaacaaaactgttcaacagcagtccccattcgcccaagcttaatgcaagaattaagtttgtactcttgattggaggccatgattcatatcttattgataatcagttctaattgctgcttttcaactccttgtccttaaaacaactctgtatcatttcactatatattttcagaacatccagaggcatgaaaaggcatttaagggataggaagcagagaatattcatagaacataacttcagaagacccattaattcattacatctgttcaatgtacagtgtgggtgtggcttaaaggtactaggtggaaaggtatagcaaataattttctccaaaaattatctcttcattgaggagaaaagcattgtagaggctgaatgtcgggagagttgaaacgatggtaaaatttgaaaataatgcttgcaggatgctggtgaaactaaccataacttagagacctataggcatttatgactcccttgccccctttggctatttttagctttaaatcaaaaagaacaaaaaagaacaaacataacatttcaagctggctcatcccaaggggttgtgggcaggatctggttggcacttgaatattttatttatgtaacaaaactaaacttgtgatccttattctttcactataattatgcttttcatataaaccttttaaataaaaaagcaactcattaacaaatgtaaatcttttccttctaaatgctagaaaaccggtatttgcattctgaaaaaaaagttggtgatgctgtaattcttgaaaaaataatcttttaattgagcagcaactaaatagcaaacttagttgtgcaaacattttttaggcggcactcattgcattactgggccataaattatggcattttctttgtatttctaaaacacaaaaaataaaaagtacctcctcagtagaaatcaagtctaggtttcagaacaatgtattaatatcttatatggaaattgctaactgttcccttaaaacgctattactaaacatacatttacaaaaagcactagaagcctctgagggttaagcccctattgtataattctgcatatctctagcccatgatttctcaatcagtactgttgatttgatatggtaattaaatctataagtgatttcttgtataagctcttccaagatgatcatgtcttattcatctttcttttcacaggtgctatactattataatatttatggtaatttataaataatgaaagattgagtaaaatttatataatcgttatacagggatatcaaaattagtaatgtttttaaaactttataacactaatatccataatactacctccaaagccaatctaagaacattttgtaatatataatatggcaacacgatgcacactttaggagggtatcttaaggccgatgacaaacactgaaggagagacttacttacacaaactgggaatggctaattcaaacaaatgttttctcaatcagctaataattcataagtgacttctacacattcaattcaatgttcaatgtttctagtgtattattgaactctcctgacaacattatgaggtaaatggcaaaatttccattttataaatgtgccagcttagacttagatggatcatggcaaaaggaagaggcaaaggggataggattctaggcctccttatcctgagctcagtgctattctcattgctgttatttttctatccatgcatctgttcatattttctatagatatgaattaaatgaagagtatatctatgattcattcaaaagactatgtagtaaagtgataagatatcacaatattatggtcattctatatcaactaggtaagagtacaatatgcttgttgttcattagtccttagttgcttctctgacattatcaatatggataaaatcactcactggggaaattaaaaagcattaaatggcaattgctgaaagaaactttgttatttaaaatcctatgccaaaatgacaaggcaatcaaagtttgacagggcaaattaattagtatgccagatttgaaatgtaaaacaccttcaaggttctgattctaaaaagtttcatatcatcttaataggctctccacataaattgtcaagcaaagtaagtaatatttaaggttaaagtttttgttttccacaggtttacaaatcaaaatgatgtgctagcttattaaaaaggagctatgttctgctgtcagtttgaaagttttctgttgatactttaaatattaaataaaatctaagaaaaatgttttctcatagaaagattagcaaattctacagtgtttttaaaaagacactagataactgcactataaggtagaccttatctcatactaggaacattattatttcttcaaatttaaagactaacaacaattataagagcaaatgtataaaaaagatgtgtgtgtataaaactggtatataaataaataaatagctgcactatttctcaaatcctgatatttaacttctcatcatattgtgccacaagaggattttgttaccccatatttttctaagaaacaaacaaactaattaaaacaacaaaaatcccactgtattgtgaaagataaaagtaaatgacatattgcctttgagggcaatgacagacaatgttctcgctttaagaaatgatcaccaagtagccaaatgtaaaatttaaaaaaatctcaacactgctttttaaaaagtcacgtcataaagaatttttttaatgaatgagatttcacatgaaattagaaaaatacttcaaaagatgaatcttctctcttttaaacaaaaaggcaatttacttttttttcaataaaaactgacacacagcatggaagagatggtgttgtgcaaacatactgcatcacacggcaatgcttgatcaaaatcagcaatcaggagcgaaaagaaggcagtgtttcgtgatcataatagcaaattctggaagacaaccaaatatatcatctggcagttcaacagctgttacagcttggtagtaataccttggcatttgctgtaagctataacttagaaaaattgatttttcatctgccagataaaacccaaaatctccttttaacatgttaatatttaaataaaatatatgtactggtcatttttattttacacctttgatagtagagttgccaaattaattcttctattaatagtttaattcaactctaaatacctggcaaaagattgacatgggcaataatgtaaatgcaatttgttgagcttcattgtgttagcacattaaattaatatctgctaacatcattctcagttgcatttatccctcttaagcagataaaacactggtattctgaaagaacaagtttaggaatgtcattataatttcatcagagagtactgacaacaataagataagcagagtaaaattacataattaatgatctcagtatatataattacaactacaatttaaacaactataaaatgagatttattgaaaaacgaaagaaatttctgacgaaggccacatatatcactgaaatgtctgaataatacacatagtagctagagagaaaataaattgcacctttaagtataactgattctcttaagtgacactgttttaagacccttcaaaatctcagaataggaaggatgttttccattaagtaaattctttacaaaaacctttaagtctggcattctatttagattgtgaaatgtcataaaacatttagaattcaacatttatgcaatccagttttagaaaatgaaatggcatgcacatatcaaattttaaagttatcaaatagaggtttacctttatgcctattgctgttttctttgcttctgcttttaatttggttgctcgtaaaataggtttagtttttttataatcctgtttacctagaaagaaatagtttcagacaatgagttatgctcatatataattaagtttaacaatcatttgaaatgtcaaagaatgtttaaatacagtgaaacagggacacggagttgcaaagtagttcccagttgtggtaaccataaacttgtcaccaaaaggtcaacttttccttctctcttactttttcaggaagaggatactgacggacatcttcaatttgctgtatagtgaatgtcaaaaaagataaaaacttgttttagagaacacaaaatttaaagtaaagaaaataaaacttttggaagcatttggaaacagatgcataagtaaatgagtatatgtaagatcctattaacagctaaagttaactttgtcttcctaagagtaacagctaattataaatgtattttattatggatacgttaagcattcaaaacataagtgagaaatatccccaagtttcctttaagtaaaagactaaagaagaaatctataaatatttaacttttagccccaccctgaattcattagaaaaatatttcttttatttcctcttttatttcctcttaatagagaacaaaattaacatggctagatagaagttatagaatagctacatttagatattagtttcaataatttcttccacatttcatagccaaaaatgtgcgaaactgagttagtgccacaaaatttcctttgtgtatcatctagtgactccagcaaagagtaacaaaagtggattacacagcctggggagaatataggtttaacaacaagaacaagaacagtgaaagcattcattacaatgatatactttttgttagccaactcttaactaggaactgagtcaaaatgagcctcaaacataacaatataatattttattctcaggaggagttaatacatgatcgtataatctctctggctattttatattcttattttgttttattttcatcttttccccttcctttcgatgaccagttcctttacaaaactcatcgctacattcccttcatctaaataatacaaattctaacattaatttccacatcttcttcacattgaaataaattgaaaagcaattggtctaaactcaagtatatcataaaaatttaatgtgcaatatatcttaatgtgtctgctaatgattcaaaagtatctttaaaatttcatacagagttttagaactagaaatggtagtcaaatggatgggcgtagtgaagaaacattatatttatgtccattagacacataaaagtgtttgtttggctggaaagcaaggtattttgtttttaaaggattgtcttctctttccttaactgctattgtatagcaataactctggatcaatgagcatgcagaagcttaataaatattatttgatgatggggtctgatgatctagaaatgagacaattgtcataatatgtatcaaatgatctaaatttaaataatggaatgaacaaaatacatgagaaaaatgttactctgacccattttaaattagcaatatttaattctgatgaaaaaaatcttgacaagtgttcactctaatttcacatctctacagtcaaactattcatgtcattattcctgctgagctataaacagttcagaacaatgaaaatggtgacacatcaaaggcctccggtcagggttaccaagcaagtttctaacaagaattctgaaagatatttgaagattgtagatttatcacaaagtaacttcttgttttatcctgtatatgccctataataatctcttgatgctatggcggggggtggggggtgagcagcaggaataaacagatgcaagaggattatcttaattcatattttttatacagatatgaaatattttggataatgtatctgtcataaaacacatgcaaatatctaagagtcaatactaaaatgagaatttttcactctacttcaactgccatataaccattggttaaataatgtattctatttcaattcaactctcatattcttagagaataatacttccagatttgtattcaagttgatattaacatttgaaactgtatttataataaaaagacagtattaaaagttattgtatacctggtacttttccaagcagtgcatctgtcataaatttagcattctccttgtcgactatgatatccaaaagtgtatattgcaaaatgtggttttagtttactaagtgacaacatttacaggagtgtctggtaggttctttataactaaagccagatcattccattgtacccaaagaggttttcaacatttaaatatttatggcttcaagaaagatacctatgcccacatgattgtaaaaaatataaaatatagaagtccctgacttctgcgtacttacacctaagggaaaaaaaaaacacagttacataatctagattttatatgtagactgtttcttgaacacaactgattctgattttggttgtatcagtgatgcaataaccaaagtagctatttgacagttgctcattaaatcttatgtggagagaaaaacttggtaattcaagcctatgaagccaatctggggcctcaatcaagcccaatgtctgagcttccttaggaacaggttctactgcatttttctgtgtatgaactaacctattagttctttatgtgtttcataattttaaattgaaaatcaaacatatttgataatgtaatgtggaaactctgcaaactagatcgtccctgaggtttgttgttactgttatttgctctttgttgttgttgttagaatccctttgtttagtaactttactgaactaattctatagagactgtattcaatagtatatggtcactgaagtctctgcacagttaccttattggtcatctgctgtggtttaatgtgtcccccaaaattcatgttggaaacttaatttccagtgcaacagttttgagaggtgggatctgtaagaggagagtggatcataaggactctgccctcatgaataacttaatgccattattgtgagagtgggttagttatcatagaagttagttcataatacaaagataaattcagtttacttcctcattctctcttgtgcatgctctttggcccttctgccttccaccatgggataatgcattcacaaggcccttgccagaggcaggcccctccagcttagacttcccagtctccacaatcataagaaataaatatctgttctttacacattttctaatctcaaaggttttgttatagcagcaccaaatagactaagacagaaaactggtaccaagaagtaggggtgctgctataacaaacacctggaaatgtggaagtggctttggaaatgtgcaatggggaggggctggatgaatttgaaagagcaggctagaaaaaccctgtattgccatgaaggaagcattaaaggtgattctggggggtgctcagaagaaatggtgagatgtaaggaaagtctgaatcttcttagggattatttgagtagtcataatcagaatgtttgtagaaacatgaaaagtaaaggccattttgatgaggtctcagatggaaatgggagacatcttattgggacctggagtaaaggctatccttgttataaattggcaaagaacgtggctgaattgcttccatgtcaaatactttatatggaagacagaatgtacaagcaatggactaaagtatctgccagaataaatttctaagcaaattactgaaggagttgtatgactgccttttacctcatatagtgagatgtgcaaaaaaagaaatgactaaaaggtaaaatttacaattaaaagagaaacaggaggaaaagatttataaaactctcagcctggccatgtaaagaataaaaaaaaagtgtgctgaggagagaatactaaaggtgtgaccaagcaaccctttgctaaagagattactagggagagaaggggaccaggtgctattcatcaggacaatgagagaaagacctcaaagacatttcagagatctctgagaatgcccctcccaaaatagatccagaagatcttaagggcaacatctccagagaggcttccaggggacctctgtattcactgcctggagttgccttgggactctgtttctcacattccagcacagcacccctcagccatgccagctgtggcttaagcaggcccaggtgaagtttgtgctgcagctccggggacacaagggataagtcttagcagggttcatgtagtgctgattctgcagacttactgatttcatgagctgtggggccatggaggcccccaactagacttcaaaagatgttctggacagcctggggacccaggcagaaacttgttgcagggatgaagccactgcagagagccctgactagggcaatgcctagtgaagccacaggagaaaagccacctcagagactcaagaattatagagctaccagtgtgcaattacagtctgggaaagaaccagtcaagagactccaacctgtgagagctgctgggtggtttgaacccaacaaagccatatggggagggttgcctgaggccttaggggcccaatgcctgccccaatgtgaccaggatgtgggacatggagtcaaaggatattatgtccagctttaagatttaatgttgttttccctgttgggttttggacttgcttggaatctgttactacttttttcttgcctaattctcccttttggaatgggaatgtctgtggtaggcttgtgtcaacattgcattttctttttctttcttttttttttttttagatgttgtttcactcctgtctcccaggctggagtgcaatggcatgatcctggctcactgcaacctctgcctcccaggttcaagtgattctcctgcctcagcctcccaagtagctgggattacaggcatgcaccaccacgcctggctaatttttgtatttttagtagagatggggtttcgcaatactggccatgctggtcttgaactcctgacctcaggtgatccacccacctcggcgtcccaaagtgctgggattacaggcatgagccaccatgccaggccccagcattgtactttggaagtagataatttgattaatttcacaggctcacagatggagaggaatttgcctcgagacgaatgatgccttgagtcttacccacatgtgattttaaatgagactttggattttgaaattttgagtcgatactggaaggaggtaagacttttgggactattgagatggaatgaatgtattttgcattgtaagaaggacatgaactttgaaggccagggctagaatgctataatttgaatgtgtcctgaaaagttcatgttttggaaacttaatctccaattcaacaacattgagaggtgggacttttaagagattattaggtcataagggctctgccctcatgaatgaattagttatcacaggagtgggctcatgataaaagaatgagcttggtccctttcctcttgctttcttgtatgtgctcttttgtcctttattcttccccattaggatgatgcgttgacctttgactttccagactccagaactttaaaaaatagatttcttttctttataaattacccagtctcaggtattctgttatagcagcaccaaatggactaagacatcatgtaatgactggacagatatttccttaaatgctttgaaccactaagtctcttaattttgctgaggagctatgtgactatttgtgtgtgtgtctgtatatgtgcatgcaggtatatgtgtatgtttttgtgttggggtacatctccatgctacaacagaggtttatagttatgccttagccttcacttctgcttgtgaagagccttaagtccaccaagaggtaagagattataggttcctcacatctttaatgggcatgatatagccctgctcgtgcacatgaccttctagattctcaggaatctgtcagaccttttaaaaaattctatgggcatgttgttcccctgtttttgcttttattctttggtcagtctcatgtttaaccccactagtaatgatgcttcaggcaactacaatgttaaacacttgttgttcattgtttttgtcaaatgccacagagaaagggctcttcacacagagttagctctaagtaaagtcaaataaagacaagttttgagaaaggggcttttcagtgagtttccagactggtcaaattgtgacaagtcttgaggatgggggctttgcatatctccaaatgaattttgccttctccagtggctgctacgctaacgttttccgtaactactgtagttgaaaggctaaagaaaagaaaatggcattaaggcaagttaaaacaccacaaagattgcagatattactgagattcacctgtttttctgaaataaacactccttagatggttttaagattttagttaattttcaggtttctggaaaacattgattttgatagttttcaccagtgttctcactggctttatataaaagcagattttcagaggtttttactttccactcaagaagtacttctcctccatagctttaattttactatcatcacatttaaagttagtatgttggatttttacattaattttcattcatttacaatttttataaccataaaataggatacaatggctgagtcaaacagaggttgctgcttaaaagctcagtgttggtaatctatcagttatttcaggctgaatgtttcaaattctctttttgttttttacttaatttttgcaggtacataataggtgtgtgtgtgtatatatatatatatatatatatatatatatatatatatagatgggggtacatgagctattttgatacaagcatataatgcatgataatcacatcagggtaaatgcggtatctatctcctccagaattttcctttctttgtgttgcaaacaatctgattatactacttttttttttttttctggagtctcactctgtcatcaggccagagtgcagtggcacaatctcgtctcattgtaacctctgactcctctgattctcctgcctcagcctcccaagtaactgggtttacaggcacatgacaccatggccagctaatttttgtatttttagtagagatggggtttcaccatgttagccaggatggtctcaatctcttgacctcgtgatctgcccaccttagcctcccaaatcacacctgggattacaggcatgagccactgcacttggcctttttcattatttttaaatgtacaataagttttatcaaatactagatcttattcattcttactaactatatttctgtgcccattaaccattcccactccttccaccccctccccaatactcttcccagtctctggttaccatccttttattctctatttccatgagttcaattgtttaaatttttttagctcccacaaataagtgagaagatgcccactttttctttctgtacctggcttatttcacttgacataatgacctccagttacatccatgttgtcgcaaatgacaggatctcattcttttttcatggatgaacagtacttcattgtgtataagtaacactttctatagccattcatctattgatggacacttaggttgcttctgaatcttggctactgtgaatagtgctgcaataaacgtaggagtgtagatatctttttggtatcctgatttcctttcttttgcatatatacttagcagtagggttgctggatcatctggtagctctatttttaggtttttgggggaacctccaaaccgttttcaatagtggttgtactaatttacattcccaccaacagtgtatgagggtttcctttcctccacatcctcaccagcattcgttcttgcaccttttggataaaagccatttttaactgaggtgagatgatatttcattgtatttttgattttcatttctctaatgattaatgattttgagcatgttttcatacacctgtttgctacttgtatgctccttttgagaaatgcctattcagatattttgcccattcaaaactcagattattaaattttttcctattgggttgtctgagctcttcatgtattccagttattaatcctttgttagatagtttgcaaatattttctcccattctgtgggttgtccctttcactttactgatggtttcctttgctgttcaggagctttttaatatgatgtaatcccacttctccatttttgctttggttgtctgagcttgtgaactatgattcaagaaatctttacccaatccaatttcctggagagtttccccaatgatttcctttagtagtttcatagtttgaggtttaagtctaatgcattttgatttgatttttgtatatggtaaaagatagggttctagttgcagtcttctgaatatagatatccagtttccacagtaccattttttgaagagactgtccatatcttaatgtatgttcttagcacctttatcaaaaatgagctcactgtagatgtaagaatttgtttctgagttctctattctattccattggtgtatgtgtctggttttatgtgagtaccatgctgttttggttactacagttctgcagtataatttgaagtcagttaatgtgattcttccagttttgttctttttgctcaggatggcttttgcaattctgaggcttttttggtttaatataaatgttaggattactttttctatttctgtaaagaatttcattggtattttgatagagattgcattgaatttatagtttgctctgggtaggataaacaatttagcaatattgatttttccaatccatgaacatggaatattttcccatttttttgtgttctcttcaaatttttatcattgttttatagttttcattatagaaatctttaacttatttgcttaagtttattcctaggtgttttgttttatttgcagctattgcaaatgggattactttcttgattttttttcagactctttgctattgtcatatggaaatcctactgatttttgtaggttgattttgtacaaaaatcaactccagcaactatactgaaattgcttattaattttaatagtttctcataaagtcttttgttttttccaaatataagaccatatcatctgcaaacaaggataatttgatttcttcctttccaatttggatgtcctttctttcttttgtctgattgctctagctatgacttccagtaccatgttgaataacgggggtggaaagtgagcagtcttgtcttgttccagatcttagagaaagggctttcactttttcctcattcagtatgatactagctgtgggtctgtcatatatggcttttattacgttgaggtatgttccttctatacccagtttttttgaggggtttttatcatgaaggatgttaaattttatcaaatgctttttcaccattaattgaaatgatcatagggtttttgtccttcattctattgatatgatgtatcacattgtttgatttgtgtatgttgaatcatccttgcacccctgggataaatcccacttgctcatgatgaataatattttaatgtgttgttggactttggtttaccagaatttggttgaggatttttgcatcaatgttcattaggagtggcctgtagttttcttttttttaatgtgttcttgtctgtttttggtattacagtaatactggccttgtaaaatgagtttgaaagtattcctttctcccctattttttgaaagtttgagtaagattggtattatttcttcctcgaatgtttggtagaatctagcagtgaagccatcaggttctgggcttttccttgttgaaagatgtattatggatttgatctcattgtttgttattgttctgttcaggttttggatttcttcatggttcaatcttagtgagttgtatgagtctaggaatttatccatttcctctaggttaactaatttattggcattcagttacccaaagtagcttgtattttttatttctgaaatatcacttgtaatgcctcctttttcatctctgatgacatacaccccaagtccactggttccgagcccagcagagtaccaggacttgccaaggaattgcagtccttgtggcctagactgcctttcacgtttatctaggatcccagagtattttagtccgtggtgatgacgcttgctgaaactcaggttcgtaccaccaggatagaagacttgcctctggctaggactagtctaaatgctccctctgtgggcaccagctaagttcttccctgtgtggctttccactgtgacagggcagcactgagttccaaggcaaattcccacaatcactgcactctccctcatgcaagtgcacagattgtctcttaacaccacatggccaaaggtgaagtacgggaaaggggtggtataggtgactcaagattgtctttcaaatcctcttcagtgcctctttccttaatacgatgttaaagccaggtaccggttcacctgttttttgcttcttatgaaggtgcttgttttgtgtgaatagttgttcagtttggtgttcctgtggggggatgatcgctagaggattctgttcagccattttgctcatcaggttaatttcttatatatagcctatatttaagtaattttataaaatttcaatgtgaaaatctgtcctttaattagtatgtttaggtgtttacatttaataaaactattgatatgttttcattaaggtctaacttttttgtttctctttgttccctttgatttttgttgctctttcattttccttcttattgtattacttgaacaatttttagtgttccatttaaattatgtattgtgattttgactctagattaatgttttaatggttgccctagaaattataaaatatatacctaactttccagactaaatcaaatcaatttttattcaatttcttatttttaaatatattctaaattatgtttaaaattttaacattttaaaaactttagtaatccaatacatttcatattttaactttccagactaactcaaatcaatttttattcaatttcttatttttaaatatattctaaattatgtttaaaattttaacattttaaaaactttagtaacccaatacatttcacattttaatgtaatggaaataagaagtgcatttatttttagtgttgactttgctagttattgtttatatcatttgactttgctgtgctcatttaagagcagctttgacatttgtcattggttatggaagttttatccagacagtagattttttaaataattcaagcacttaaatgtctacatataaagaattatacacgtgaatatactattgtagcacaggtgtttttgataattaaatgccaggcaagatattggtgtccctgcttgatgcatgttcttattatagcctaatagttttgcaataaaatgtgaaaggtacatgcatagttaggaggattattatactctggttgctgacattttatattaataataaaaactgcaggctataggtgcctgtgattctgttgcagaataaaatttcctattactcttttctcatgttgtgatcagtttaattgaagagtatcctgaaattgctagatctatactattaataagatagttatcatatttaactatttatttgtatcaataaatttttctcaatagtatgtcatcaaaacaaagtacagaaatgagtattacgttcagggtgataactaatgtgtaaatgaaacaggtcaagtgcctgttatcccaaaccttgtgtaaaagacaaataataaacaaacaaaaattgttcaatttatcaggtgataaaaagcactaaaaagaagaatacagttggcaatgggcagacaatcaaagcgagatatgtattgttttagatatggcagtcaaaggagtcctccttaataagatttcatttgagcctatactcaaatgaagttagcaaagaagccatgtgggtagatgatagaagcaatttcaaatattggaaatattgaagtgcaaagattcaaaaaacactaactcctagaaggagtttaacagataagttgattaaaaaaaaatcaattcctaatggcagactcagtgatccagaacagaccctatgttcattttccagtttttgaatacatgggctcaaatgataatggaaataggcaggatctccagcatggttccccaatatgtgctctaacagctattttgttaatgagtgtgaagtagaactattactccctttctttactaaaatgataaagaaaaggaaatgtatactcctgggggaatttcagaggttgactatatgatgaataactttgtatgtgcagtcacactgattattttcactggcctgtttatttcctcactgtgattaattatatcatggaaaccaactgagtactactgaaaatttaaaattatagtagaattttcttactgtagcagaataatgaagtccctagcacatggtcataactagctaattaaccaagccaatgcatttttctcaggcctgatcacagatactgcaagaggctgtctgtccttactggaaaggacagcagtatacttacagtcctactgcaggagtagataaactccacatctcagtgttaaaaatatgattcccagagattttaactgcttcacaaccccacagtatatcacaatgacaatgatatgatgtaagtcttggagaagccatggaaagtgtctgagacatctcattcagatatatacataaaagagacaataataaacattcttttaaaagaggtttgctacctaagtctaatttatggaggtctgcatgttggaattgtctcccagaattaaaggttaacttgccacaccttacttaccattaccatcaccagcaagcatggtgcaaaggctcaacttcttaaaaaataaaaacaacactcacaacttgattattacacatccatacttatgacacaacactcttctactaggtatatgttgcagggaaacttgtacatgtaaatcgatgaacagacacgtctaaaaatattcatagaagcatcgttcgtaatagcattcatagaaaaaaaaactgagaataatttataactgtccaaaatcaggagactagaagaaaaataccagtatatagaaataatggaaagccataaagcacagaaaatgaatgaactatatcaacagccatgaacaaaaataaaactctaaaacatgatgttcagtagaagcaaattttataacaatatatacaacatgatttcatttatataaagatcacctatataaactgacaaaactaaatgatagattactggcacaaatttaagtggcaaatccttaaagagaattaatacaaaattaatattgtggtaatccctcggaaagatggaggacattgcaattgcgatggagtatataaaaggcttcttagctactggtgtattttcaatttttaacttggatggcggatccatggttgttcatgttcttgttttttaaacctatagtacttattttatctatgtaggggacctgaaaagttcctagagttgagtagagcatgggacaataaaaggttctccagtagattgctgtgacagatactctatctcttggagtctatgacatggtagattcaatggaatctgaagtactgttagctaactgagacatagaagcaacccttcagcaggtatgaataaaagaaaagtgtcagtctctagggttttggaacagtgccatacccccttcagcaagtagcatctgctaagaaacaactcctggattgctaccaaatggatagagaactgactaccttgtcatgagactcagggatcatctggcctgagcttccagtcatgaactggaggttatctagttcaataaactataagattaggtattttagcattaaaaacatttgtacatagatctttatcatattctcacaccagctagaaatagactgctatggtattatagctatcattgaagatgaacccaaagggcaatgaaaaagggaaattgtcccagtggccaaaatttgagtagtatattttgttcagtttacctggaaacagaggtaacctaaagaaaagatacgatactagttctcctgaattgaaagctgagccagccacctaggcagtttgaattctacatacctataggcaaactagtaaaatggtcaatcatagtgttggctgaggtaatttatgctggttatcaaggtccgttgaaatggtttgttcatacatagcgcatgcctaaaggagtatgggaagaggtaaggaaattcctgggacaactcaagtactattttgaccaatcataaaatttaatacaatttttaaatttttaaaggcaaagaccctcagtaaactaaggttcttgaattaagaagggaagtcataagttacaactactatgaccaactagagaactgagaatgatagcctgaacctatatttctttgcttgctcctagaatgtaacactcatcttccccatacaaacaatttccctataaagtcaccattatcaaaattttaaaaacatttcttcctcttcctttatgccaaatcacaatagaataaagggaagactgctaacacggtgaaatcccgtctctatcaaaaaaaaaaaaaaaaaaaatttagccgggcgtggtggcaggcgcctgtggtcccagctactcaggagactgaggcaggagaatggcgtgaacctgggaggcggagtttgcagtgagctgagatagcgccactacactccagcctgggagacagagcgagactccgtctcaaaaagaaaaaaaaaaaaatactggacttagtgaacagcagctcaagcttgattgggatatatgtttgggtagctgtggaggatgctggagatatccttagatcattttcagaattattctcattatcaatgacagaaatccatcttgaaataacatgaaaatgggagagaaagagattgagattgattcattgattccaaaaaataagggaaaaggaaaaatttttgtagggattgacataagttgaagttttgacactgaaggactttctctttctaccatcatttctatttcttgtttttctctggaatcatggctatttccatctgtggctcacatcctataaaactaagaccaaagtggaatggatacttctgcctgggatcattttaaacatcgttctcatgccctaaaagattacctttgtgaatggtttcttccaattacataagactaagattcacttaacagtgtgtgtatagctaccaattcaagcaaatttaacaaaccaaactagttcttctctgtgtcctcctgttaaatatggattaaaaatatatacttgaaaactcaaggtacataatcaacagaatttccagtttcaagtcttaaacagagattatgagtattaactaaaagcaaagtcgttattaaaaagtaaacattaatataaaagaattttcaaattatttctggagtttttgatagcaaagatggtagcacacaaattcataatttttacttgcatatacaatacagacaatctgtagtgtcagctttttaaacaaaatactttaaaagccattttaagttataatttctaattagtagatattatctgtgttaaaagttcctttgcttatatattcagtatgaataaaacaggtttaactctggcattagtgctgtccctataaaaaaaacacacatttatgtacatacaaagatagctactaaaacaaatattaatattgagagatataaaaacatatttaataaaaataataactatttaaataccttattgtcatcatttaccattcctcatattacactattttagggatggacacagtcatttatatgttctaaaaagttatctatgccagaaattatttcatatttaaagcaatcattttaactgtgacatgactttttcatgggagcttccttagtttaaattaaaaaaacaaaatagattactttactgcttttggctttttgttgttcaattccttacccttgcccagaaacaagactacatctttgccctttgttgatattgctgctcaagctcattatcacgtgaatatctggttattgttttataaatgttcattttctagaagctcactgtttctttctttctcaacagtcgactttacactagccacactcattatcatcatgtggcagtactgctcttcctctgcctttgctgctttaaaaattaatgcactgttattttctgaatactgcataagctgcttatgagtacattatgctatcaagcaagcacatgcagaaaagcttcctaaactgttattctttcaatgaaaatacagctggttctgcttcaaaggcacatcttttcacctgcaaatggacttgctcctgcacttattcctcaattcattgtcttttatttgtgtctagaaatctttaattgcctttaattagaaaaaagtaaattcagtgctttaatcttgcaaatacattcaatcataattctgtctgggataaataccaagttctattcactgtctgatctctgtaacaaagatatataatttattgtccatttatatagaccacaccaattaagatacaatagaaaagcagagagataagagtcaaaatatttgaaaagaaaaatttgcaatctaaatttaattactcaaatgaattattggaagatgagttatttacagcatgccaaaaatactggcaaataatatttggtaatcaacaataaagacttttatatttccttcaacatttttagaataaatctcaccaaatgcttccaatccctcctcccttcgtcaaaaagcaatatactacttggaatcttacttttcttgtattacctaagttacatataaaagtaacacaatttgtcatataaagtaaatctgcagctgccatatgaacacaatgtttagttattatattgcaaactacaaatatctaaagaagactcattacaaaactaggggtcaatagtctttcgtatggaatcttgttaaaaaaactctagtaactatgtcagtaaacaaatggcctgcattttaacaccttcaagatgaataaaattacaaatgctcacaggaaaataactaggtaaaacattaaccaatcaaattgataaaatgaaaataactacaaagccagaaataatccaggagattaccatcagcataacgtacctttacatttaataaatcgtgcaaaggataacaatttccttaaagacaaaaagcaagtattacctacaaaggtaaactacgcaaaaagtaaaacttctctcaaaattatttggagatatccagaatatagagagcaggctggtaaattcatcattgaaaataaacatctcgggcaaatttttcattttaattttgttatagaaacaattcaaaccaatgataatttttcaatgcttggacataacagcttgtcatgcattaccattacagaaaacacatcatcatttaacaccacattaagtactaagaaacaagcactaagcttagagctgctaaagataaaccaagttgctcataaaatacaaattaatttccaagaaaattcatattaaaaatgctaaccaagcaaaaatttatacatggaggagaattatagttaaatagaagatgttataaataatatcaatcttgagtttgcaattagtactcaaaaaagtccacaaacatttaagaagtggttgtatccaaggtacccatggggatgtagagaagtaaaagaaagacaaacaacaaaaagaataacagggaacctaaaacgcaaaattaagaaaaattaaacaacgacatgtttcagtaagtattcaatttagttaaacatactgcttactatttcaagaaaaatgataaaatactcaaattaatgtaaacaggttaggttaaacaaagggtatataaaattgtaatcacctaagaattaggacagttgctttattgattatttaaatatttattaagtaccttctgtgaacatcattagagatgccaaaaaaaattagatggagcttctgtcttcaagactatttaaattctagtaagtacaattaaaaaaatatgtgaaagataggagaaagtaatcacatttagaagtttaaaaatccttattgtctaagttaaataaggatattaatatactttattaagtcaactatgaaaacttgagaatctcctctccctttcccaaaacaaggaaagaaaagaaaagaaaaaaaaggaatggaaaatgttgaaaatttgaagaatgaaaaaggaaacatagtcaaaaagtttcaagaaaaaaggttagagcggagattagcaaaggaaaaatcactacaaatgaaaaatataaataaaaatgtgaaaatatatcaagatttttaattcatagtaaattatatagaattaaatttgcttgcttgaaaacaaagattctccacctatattaaaaaatcaattatatcattaatttatagattaaaataaagggataagaaaaatacaagagtacttaacaaaataacaaaaagtattttaccaatattaatataaaacaaaaagaagtctaaacagacacttcataagtactttataaataaaaaggtcattatataatagaaaaggggaaattatcataaatatataccaatttacaaatgctaagcaacgaaaacatagcttcaaatatataaagcaaaaactgatagcattacaagaattgaaaactatagtcttggggtattttaattctcatttttcactaaatgacagctaaaatatataaaaagtacacaatagagttgaaaactataattaatataagtagtactgaatcctaatattagagaatacctattcctttcaagcacagggaatgttaacaaaattgactgcatactaattcagacaggaaatactaatatcaaaaactgatatcatacacaaaacactgtcggtacaagaaacaaggctaaaaatcaatttgagaaaaagtaagagtggagcttttgaatgttattaaagttaagctattattagcttaaaatagactgttaaacattttatggaagcctcatgataaccacaaagaaaaaaaactaataatagatacagaaaagataaaaaaaactaatattagattcagaagagataaatagaaagaatcaaagtatatcacaacaaaaattatcaaattgcaaagatgataccaagcgaggaagagaggaacaaaagaaatacaaaacagacaggaaacgattaacaaaaaatgacaataaaaagcccttactatcaaaaattactctaagtgcaaatatattaaactcaccaatcaaaatatatagagtgtctcaatggataaaaaaaggttcagttatatgctgtctataaaagactagctttagatttaatgacacacacaggccgaaagtaaagagatggaaaaagatattccatgcaaatcgtaacccaaaaagagcaggagtagctatacttatatctgactaagtagaatttaaaccaaaaactgttacaagagatgaagaaggtcattacataatgataaatgaattaacttaacaggaagatataatgattataaatttaaaaatacacatatatgcatatgtgtacataaataaatatacatatatacatatatatgtgtatatatgtacatacatgtatatgtatatatacatatctacatacacaagtatatatgtatatatgagtgtacatatatatgtatatgtgtgtgtagacatatatatatatatatatatgcacccaacatcaaagaatctaaatacataaaacagccatggaactgaagaaatagaaagcaataccataatagtagtcaaaaatggatagattattgagacaaaaaactcaagaaaaaaacacagatttaaacaatactacagaacaaatggacttaacaaatgtatacagaacattccaagcaaaagtaacagcatacatattcttctcaagtgtacactaacattctccaggataaatcacatgctaggtcacaaagtaagttttaacagatttaagaagactgaaattactccaagtatcttttatgagcacaatagaataaaactagaaatcaataacaaaaggaaaatgggaaattcacgaatacatgaaaagtaaacaaggaacccatgaacaatcattcagtaaaagaaatcaaatggaaaataagaaaatgttttgaaaggaatgaaaatgaaaacacaatataacaaaattaatgggatacagcaaaggtagtactgagaaaaaagtttattaacaataaacaactagatttaaaaagaaatatctcaaataacctaactttatacctcaaaaaattagaaaaagaacaaccctaagcacaaagttgccaggaaaaagcaaaatagtaaagattctggcagaaataaatgaaatagagaatagaaaaacaatgtggaaaaaatcaataaaactcatcacacacgaaatagcagacattacaactgatgccacagaaatgaaaaagatcataaggggcatttataaacaattatacaccaacaaattgaataaactagaagaaatgggtaagttcctaaaaatatgcaaccaagcaagaatgaatcaagaagaaatagaaagcctgaaaactagtaacaaatgagactgaatcaatagtcagaaacttcccaataaagaaaagcccagtactagatgacttcaattctatgaaacattaaaaaaaaatccttcttaaagtctcccaaaatatggaaaaagagggaacaccttcaaactcattttataaagctagccagcattaccttgatttgaaagccaaagacaccacaccgaagaaaactactgaccactattctcttatgaacataaaacaaaaatcctcaagaaaatattagcaaacaaaattcaacagcacataaaacagatcatatacaatgaccaagtgggatttatccctgggctataaggatggttcaacacatgaaaatcaattcatatgataaagtacattaacaaaatgaagaataaaaatcacatgatgatctcaacaaatgcagaagaagcatttaacacaaagttcaccaggaacttaaacaaatttacaagaaaaaaaccccatcaaaaagtgggcaaaggatatgaacagacacttctcaaaagaagacatttatgtggccaacaaacatatgaaaaaaagctcagcctcactggtcattagagaaatgcaaatcaaaaccacagtgagacaccatctcatgacagtcagaatggcaatcattaaaaagtcaggaaacaacacatgctggagaggatgtggagaaataggaacgcttttacactgttggtgggagtgccaattagttcaaccattgtagaagacattgtggtgattcctcaaggatctagaaccaaaaataccatttgaccaagcaattccattactgggtatatacccaaaggattataaatcattctactataaagacacatccacacttatgtttactgaagcactatttaaaatagcaaagacttggaaccaaccccaatgcccatcaatgatagactggataatgaaaatgtggcacatatacaccatggaatactatgcagccataaaaaataatgagttcatgtcctttgcagggacatggatgaagctggaaaccatctttctcagcaaactaacacaggaacagaaaaccaaacaccgcatgttctcatgcataagtgggggttgaacattgagaacatacgagcacagggaagggaacatcacacaacagggcctgtcagggggtggggtgtaagggaaaggatagcattaggagaaatacctaatatagatgacgggttgatgggtgcagcaaaccaccatgggacatgtatacctacgtaacaaacctgcacgttctgcacatgtatcctagaacttaaggtataacaaaaaataaaattcagcaccatttcatgataaaaattctcaataaattaggtatagaatgaatatctcccttctttttttctagtacttttatgtcttatatttgccttttaggtatagaatgaatgtcccccttctttttttctagtagttttatgtcttatatttgcctttaattcatttttatttcttgacattggtcttggctatgatttcttggatgtaacactaaagaacatgcaactgaagcaaaaacaaacaaaggagactaaattaaactaaaaatcttctgcatggcataaggagcaatgaacaaaataaaaaggtaatctacaaaatgggagaaaatatttgtacaccatgtacttgagaaacagttaagtcaaattatataaggaacttatattttacaatagtaaaaaagacaacttgattgaacatacctgactagaaaatggtcaaaaggtctgaatagacatttctccaaagaaaatggagaaaatgacaaacaggtacatggaaaagtcctcaacctccctaattatcagagaagtgctaatccaaccacaataagataatgtctcacacgtgttaggatgactatgttaaaaaaacgtaataaatgttagtgaggatacagaaaagacagaatccttgtatattcttagtagaaatggaaaaaaatagtatggagattcctctaaaaatcagaaatataactactatatgacccagcaatctctctcctaggtatatacccaaagaaaataaaatctccacattttagagataccatgttcactgcagcattattcacaatagccaagatatggaaacaacctaagtgtccacagacagatgacggaatcaagaaattattttatacatatataaaaatatatttcaccctttaaaaaggaggtcctgccatttgggaaaacatggatgaaattggaggacattatgctaagtgaagtaggccagacaaagaaagaaaaatactgcatgatctctcttatcttttcaatcttaaaaaacggatgtcaaatatgtagaaaaggagagtggaatggtgttagcagagttggagggaaggggaaatgcagagatgtaggtcaagggtataaagttgcaattatgtaggatgaataaactatagatctaatataccacatgagaactacagttaataatattgtattgtacactggatatttgctgagagtagattttaggactcttaccacacacagaaaaggtactatgtgagatgatgcatattttaattggtttgactgtagtaatcatttactctgtgtgtgtatagcaaaaagtgatgttgtacaccttaaatacgtactataaacattctttttttttttttgagatggagtcccactctgtcacccaggctgtagtgcagtaacatgatctctgctcactgcaagctctgcctcccgggttcccgggttcacgccattctcctggctcagcctcccaggtagctgggactacaggcgcccatcacgacgcccggctaattttttttttttttgtatttttagtagagacagggtttcaccatgttagccaggatggtctcgatctcctgaccttgtgatccacctgcctcggcctcccaaagtgctgggattactggcgttaagtcaccgcgcccggcctgtactatacaaattcttaattggctatatgtattccaaatattttttactttgtttgcatgtcttttgtttttcagaaatatattttgctttatagagcgtactttttgtgtcttatttatgaaatagatatatactatattttggtatcaattatttatatttattttctgacttctaatgtaacttctttgtttatcctttagttatttagaagtgttatttttattaatttattttgtatttccaaagcaatggtacagatggaaaaaagtgcactaaaggagagggttgggtgaagaaggggaagttacctttttgcttctaactaatttctaatttactacatttgatttaaaaatgcagttataggatattgattgtttataacttgggatactttctttgtgacttagtatgtaggtaggtaattttttagaaatactccatgtatccttgaaaagaaaatcctgcacctagagcctaatttaaaatagataagcttcctgttatcttcctgtgctaagtgagcttttctagtccaccgttctactagggtagtatctccttgagggtccaagtatatttgggagtctcaattccatctacaaatccttatttccagtcttccttaatccttctttcacatatgacctctggagaattctctttctttttttctgaactcaggtttccatataaaagaacatttgttctactttatttagcatattttacaggagaattttgaagttatcaaattattgccaataagagtcaacagaattaaaagttataatatgtatacaaaggaatgatttaatggattataaaatcaaaaatgctgattatataaaagcattcagcctaaagaataatatttattttttgttttattaaattaattaaaattataagagcactgaaaaatcgtaagtacatgaagttcatatctttactggtaagcaggactgcatttaattttgcttccataaaactctataaagtcctttttcactcacatatttctgtgtatcatatgtattagagaaaatttattttcttaatatgcataattgtgtttttatctcaattaataggagtgtatcaaagataattcattgcttaccaatttgttttctgtactgatcaacaggaagttttatagtagcagcatcttttctacccatctttgatctccaaaatgcctgctgaaaagaaaacaattataatgaaaatttttttaaaaaggagtgtctataaaatccagaaatagtttattctataaaattcatttttaaagcaatgggtacaaatactttgacttatttccattaaatattcataaagaaaacaaaattcttttaaataaattatcaatgatacaattgctggtaattaaatttctcaatcatttgtttttgataacattcatcttatcaagtactatcagtgttccattaaaccatattgttaaataacattatctgtaaatatgaaaatcatgtagtatttacttagataggttggggcttttggcatacttttggcaacatgcttatttccaagtatatatagtttggatatatacttactatgttacattaaaagtaaggctaaagtttgaatctcaagtattttgtattttattttaaaaagcataacatatacatacaaagcagatgaatttcagttctagttctgcccctcttaatgtaaacaataaaaactactaccatttattaatattttcatgcttattaccttatatgcactgttcgatttaatctacctatttttattgatatacaatagttgtacctactttgggtggatatatgtaatattttgatacctgtatacaatgagtaatgaccagttcagaataattgggatatccatcaccttatttacatgttctttgtgttgggagcaaaacaaaacttctcttctaagtatttagaaatacataataaattattgttaatcataattttcctactgtactattgaatactagaaattattccttctactctaactgtatttttgtatcccttaaccaacttctctaccctctacccacttcccatccctggctctggtagccattattctactctctacctccatgagatccactttttcagctctcacaaatgagtgagaaaaagcaatatttgtctttctgtgcctggcttatttctcttaacataatgaccttcagttccatccatgttgctgcaaatggcagcgtttcatttataaggctgaataatattccactgtgtatagagacaacatttttgctatccattcatctactgatggatgctaaggttgattccatatcttcgttattgtgaataatgctgcaataaacatgagagttcagatatgtcttccatatactgatttcctttttttggatatatacccaggagtaggatatctggatcatatggtagttctatttttagtttattgaggaacctccatattgttttccataatggtgtaccaatttacattttcacccacagtgtatgaccatttccttttttctccacatccccaccaacacttgttattttttgcctttctgatagcagccactgtaactaggatgagatgatatctcactgtgctttcaatttggatttccctaatgattagtgatgttgagaatgtttttcaaatacctgttggccatttgtatcttcttttgaaaaatgtctattcagatcttttgcccatttttaattgaattgtgttttgctattgagttgtttgagctccttatatattctgggtattaatcctttgttggatgaatattttgcaaatactttctcatattttgtaagttgtctcttcactttgttgattgttttctttgctgtgaagaagctctctagcttgatgtaatcctatgtgtctatttttgattttgttgcctgggcttttgagatcttacccccccccacaatttttgccagaccaatgtcctgtagtgttttcccaatgtttttttccagtcatttcatagttttatgtcttacatttaagtctttaatccattttgagttgatttttgtatatgatgaaagatagagaatctactttcattcttctgcatatagaaaccagttttcccaggaccatttattaaagagacaatcgtttcccacattgtaacttcatagtacttttataaaaaatgagtagactctaagtgtgtggatttagttccgggttctctgttctattctattgatctatgtgtctatttttatgccagtacccaattgtttcgttactataaatttgtagtataatttgaaatcagatagtgtgattctctggcttttttctttttgctcagaactgcttcagctattggggatcttctggggttccatgtgaattttaggattgttctttaggatttttgtggagaatgtcattggtattttgatagagattgcattaaatcagtagatcactttgggtagtagagaaattttaacaagattaattttatcatgaaggaatgttaaattttgttgaatactttttcagcatctactgaaataatcgtatggtgtttattcttgattctgctgttgtgatacatcatgtttattgatatgtgtatgttgaaccatccctgcatcactggcgtgatccaacttgatcatgatgcattatcttttgaacgtgttgctgaatttggtttgtagtgttttgttgagatttttacatctatgttcatcagcgatattaccttgtagtattccttttttttattgtgttcttgtctagttttggtatcagagtaatgccagccttgtaaaatgagtttggcagtattccctcctcttcaatgttttgaaatagttttagtagaaatgggattagttctttaactgtttggtagaagtcagcaatgaatctatcaggtcctggacttttctttgatggaagattttttattcctgcttcaaactcatgattcatttttggtctgttcaactattctgtcttgtcatgtttaatcttgataggttttatatgcccaggaatgtattcttttcttctagattttgcaatttgttggtatatagttgttcttagtagtcgctaatgatcttttgcatttctgtggtatcagttgtaatgtttcttttttgtttcccattttatttgagttttctcctttttttccttgggcaagcaaaggtttgttaattctacttatcttttcaaaaaacaactttttgttttgttgattttttttgtatttttttgtcacaattaaaatttatttctgctctataagttttatgatttttattgaatttaaatattgcagcagagagtacaacctgattaccacattcatattctccttttcttcctagcacagactctatttcctagcctcaattacaatatgtcattattcatagaatacaatgttacagtcgtaagtattcttcaaactggtgtctgcaagttgttcctcattccttctagtaaggcattacaagatgaagatgaagtcagacaagaactagtcatgtcacaagcaaaaatatagagaatagaaagtccagtaatttggggctaaaaatgttggaaaagccaacttcttctgagaaccaacaggagaaaaatgaaaacaggctttgaagaacaaagacccatgaaaacttatcagcttaaaaaaaaagaaaaaaaaaagagagagagagacaaagagcagattaggggttttcactgtctcacctgagcctattatttcagattacttcaaagcagacactattgggtagaaaaagagaagtcaaggagttctaaagcacagaaagaaagtggacatgagaattaggtctaggaaagaaattgcactgtgtttattggcacatgcaactgagtagaaatggtaagaaggttactaaaatgtgagggaactatatttactaagaaaccagaaacataatctaaaaaagtctttgaatgaaagccaacttttgggcctctacatttaaaccaatatacagcagtacccaaggaaggcaaactctatagagtttataacatccacttcacacatgactagaaaggaataaccatccagaggggagagccatgaagaatggacaaaaagaccataaactgaaacttctatttcagtatagtggatcttctcagtggtctcgtgagcagaggttttatcatcacaatggaccaatgactcctgtggctgttttccattcttccctttataaatgggaatgattattgcaggtataaagcagttatccactgcttaatcattatttcttaggggttttgtgatgctggggaggagtagaaaaatgtcacaggcaaattgagagaggactgtgtgttagcttgagatccttggcttggagctagaagcaataaatgctagatgtttaggttctctctattggggagacagaaaaaaataatgtgcatagttatttccgtgccagaaagataaattattaaaaaaactgttggctactcactaaaatacatgttctcctttttttttcctctgggtactcttgactaatttcccagcctcctttgatgttagttgtggacacatcacttattttcaaccaacagaatgtgagtaaattaatgtttcctacttctagaactgacctataaaaacgttccttgcatactcatttatctggatgaaatggagatgacctctagggtaactctgaacatgagtgatgaagatgatgacagcctggatcatgaatgactgcatggaggacagctatccaaccaacttgtttttctgtttcatattgctgtgataagaaaaaataaatttgcagcatttgcagtactatacatttttcgcatttatttgttacaatagttgtcatcactgaaactaaaacaaacaagtatagatgtttccatataaactgatgcaattatcaaactgtaatttttctaaagagctttattaaggttctaaaacactaaatgcatttgaaatctgtccagacaaaattgtattgtttatctatatatattgtcacacagatagttaacagtgatcccacccaatacagtgaaagccatctccaacttaataatttttatccatatgtgacaaagttataagttcagctaaaaacctatttttctaatcataataatcttcatattcatggtattattgcaatatctaggaatattcaaattatgacaaagtcaaataagttaaattttcatctctaataaaccatgtagttattacatctaagaaaacattttaaaattctagcaataaaatcaagacagcacctaattctatagtcttacttcttataattcaaaacattaaaaataattctgtcaagacaagcaccataaaaattgtcaatagatacattataatttattcatatagcaatcctatttgcatagtattttgcatttattaattgtaaataggaatcaagttattttaatcttaattgtgtgtggctagggaagataccactccattttaggagagaagttggattaaatgaataaacactcaagatattattcccttttcaatttagttttgttttttgcctttacagactatgcttaattttttcttaaagcaaatcactgaggctatctgccaaaatggttactcattatgcttcccccaattcctttctagtcatttaagccaacatcccagcagagataacacttcagaagtcaatactttattcattcactacctacagaaaataaaaaagtaagaggtttatcaaaaatatatttttaccaaagtagctgaattttacttatatgttaatatactttacattaaaaattatgccacggaaaaatctaaagaatctaaattttcagaggggcctatgctttatgaacagacattttataggtataataatcactgaatataaaagctataaaagaatttcaaccaagatacattagagaaaaactggtttaaaatttttgttctagttatttttagtggtttggtattatttaatcaaaatttcaaaatttaaactttctcattgtctttgaaattattatattctatacagtaagtaaaataacgttttaccaaatgataaaacaaaaaatgcttatagaacacattcttacataaattacttacattttattagctgcaagaaacacacaaaaaaatagaaagcattttgccttactaataaacacattgaggctattttaaatgacctaaagagatacctattcatctgtatgatgcaaactgtcaatgactcagacatgtagaacctttaaaatgttctgacttttctttgttcttcaaagccttgcagtaatcatcattcatttctattgctttgatggttagatagcaaactcccaagaaatccagggagacattagcacatacagccgcaatttctaataagacagctacttgcatacaagatcagccacaatttaaaatgtgttgtgatagatgcggaaagggaataacagacttatattagcatgtacaataccaagattgttttcacaatttaattccttggagattatgtctcatcaccttcttttgtaaagaacactgcattccctgaggaactaacttgctctgagacctagctaaactgaaatatggattaataagataatatttattatttatgaattttgctgtaggaatgatttcagattaaatcatcacagaagtttccaacattcttgaaacttgataacacatatttaaagaagaaaaatgctgattttatttaatacttaaattggatattaaaataattcagttaatttttatctaattaaactttacactcattaggacttttaagattaaacatagcattcttgtttttagtatgctttcttaacctgaattttccagagcaattttgcgaactgtattttaaagcataatatgtgacctttaaaaacaaaagtagtattatattcaatcaccttccgaccaagttattttattgctcatttataccttttttatgaaatccagaaagaacaagtaaagaaataagaaatctgaagccttcacatatgtctctgcttccagaaaaagcactaaatccagactgtgacatttaaatacatatcaaaacacaggttattaaaaaaagttcaacccatgtccacagaaaaaataattatcttagtttttaaggctaaaagaaatacacttactaagaaaactcttcgctaaacgtgaagctatagttaggcagaaaaggtatttggttatggctgcatcaaagttgagaaccaatcatgaaaatacaacctcatgctagatgctgaggatataataaacacagaagatatttgtccctgatcttatcacacattaaccatttccagagtattacaaatttaaagttgttcattcacttaacatatttaagtcattgaaatgatgacacatttcctagataaagcaaaaatccttaatattaagaactattaatgatctgaatttgtcatgtgttcctttctcatgttccagtgcactaggaaattcagcttttacttccttgactttgacaagctcattcgtgtttccaggaatttactatgttctgcaatttgctttaaatgtcttttcaatacatccccacttgtgaaacctatatattgtaatattgcacacaagagtcatctctgagtaatcattcagatcttgcctaacaggcatcattcatgattcagatattcagagatagttctccacacttaaggaaatgaaaaaaaaagtcttttgaaagactatcaagtgtgaagtggacaaggtatacacaattataatattaaaatgcagtattataagtaatattaattatttcaatattataagtcatattaattatttcaattaattatatgtattactcatattaatagtattatcatattgtcattgagacaagttattacactgaggaacaaattcgtactgtataaaactggagagctaaacagttgttattctaaagttttcagagatcgaagtgcccagttcacctatactttgacaaactaatgtcctttatagcctcagaaaaagtatctaaaaactgaaatatgcaaaaagatgatttctaaaatcctgatcacttgccaacattgatatgaaaatttatacaaaaagtaagtacaggacacttatctgtgtaaacctaaaaagtcatgttccagaaaagaaatcttagtcgttgggactcaccttccagccaaactacggaactaaaatacagtattaggaaatagtgctagaacaaatatatttcttcatgaaaaacaaaacaaacaaccaaaaatatttaacccctatctcatatcatacacaaaaattaattgaagatagatcatacaactgaacgaagtagctaagacaacaaagttactagggaaaatattatattcatgactttgtagaggcaaatatttattgaagaaaacatagtaggatatatcataaaagagaaaaaaaggatgaactggattacatcaaaattaatatttgcttatcaagacaccaataagaaaataggttattacagatagatagtattcataacatatgtatctgacaaaataatttgcatccagaatgcattaaaaaactatttaataatgtaaggtatacaacctaataatttaaaaaggggtcaaaaacttgaacaggaactagaaacttcagcaaataagatatataaatgacaagcacatgaaaaagttcttaacaacagtagtaatcagcaaagtgcaaattaaaattagaactgagattctactacatatctactagaatggctcaaataaaaaatatttcatatacaaaatattgaagagaatgtggagcaactgaaatttctggtacaacttctttataaaattgactgttcctacaaagttaactaccagcaatttttgcacttctattctcagatatttatgtaagagagataaatgtatatggttacaaaaatactttctacaaaaatggtcatggctgctttgttcataatagttgaaaattgggggcatggtggcgggtgcctgtggtcccagctactagggaggctgaggcaggagaatggtgtgaacccgggaggcagagcttgcagtgagccaagatcgcgccactgcactccagctggggaacagagcaagactacatccccaaaaaaaaaattggaagcagccccaatattgatcaacagaagagttgataaactgtggtttattcatacagtgtaatactaccaagccaaaaaaaaaaaatactgaacataggcaatagagataaatctcaacaatgttatgcagagaaaaagaaaccatgatgtctctgtacttaaatggtcattcatcagtgttatttgttcttgtagcatcacttgacaatggtgacctctactcccttgaaaatacttgaaaaaaatatttcctatgggctaaagaataagtgagaggtaagaaagcagaaatgaaaattacagaccaatccattataaaataaatacaaggaaggagacagatagcatagtaagtagaaaggaactgaggttgaggaagagattttttttgttatactttgtttttactctttagggcttgtttctgattaaagatgaaaatttgagttggtctaaataataattgggaggaacaaccagaaagtgagagggtgaaaatacagaaaaaaaaagtatgaaagcatagaatccagtattcatttcaagtaataatcatagcacactacgtccatgagtcactttaacaagaaaaagagaaaataacaggcaaaattatacataagacttgaggtctggtaaccaaaagtagagggatatctatgcagtagctctgttttcactatgaagtaaaaggcaagattatctccttatgagagaaaggaaaggtgggaagtttggaggtttgcaagtgcagagctggaattaatgctgtggaggaatggaaagagttgtctaaagaaaacaggattaactgggtgcagtcacttgtgcctgtaataccagctactctggaagctgaagtgggaagatctcttgagcccaggagtttaagactgcagtgagctctgatcatgccactgcactccagcttgggcaacagacttgaggcctcatctctaaaaagtataaaaataaaaaatgaaaacaggatttatgggcaacaccaagagaccaaaaaaaattgtaacctattacaaaaaaaatgaatctattatagcactggactatctgattgcaaataatatttttctttctgagtgcttagctacctagtgctgacatagggaagggtagtctactagagtaagtaaaatttaagttttcccagataggcatgacagaaaactttaggatactataaaaagtgggtgacttgatgttctacggtatctaaaggtagaaaaggaagtgaagacagtagtggtttagagttaagcagaaagtggaacaatctttggacttaataaagttaaataaccaaatttgaaagtaaaaaaaaaacaaataacaaaatttgggagtaaaaaaataaccaaaaaccaaatactaggagtgaaagttattttactagagaagaaaggttattaaaggtcactagtcagtgtgagtgtaaggcgattaatattattattgagatggagtaagttttggtccagaaggactgaagtggtaggaaaacattatggcagatatgttaaggaactgaaagaccaggataatgcatatgtcatacatgtgaatcatgagggtacccaggatagtagcaggatttgggtgaggacacaaagaaagactcagttagaaagactgagaagggacctggatgtccatagataaacagcaaaagagagaggtagaggacactacagtcaaatggaatgaatcactaaggagctgggcttcttgtttgatttgtcttgtttgcttttatgtgcaggaaatgtaaatgttctggaagtggcaataaaaaaataaaatgataaaaatcaacctcttgattcacaggtatgtgaacaatggaagaatagtttccatttaagatggcttcaggaaagtggtgcttgtaagaagaatcaagttccaattaatgtcaagaggtaaaattaataaagcgtttgggattaactgggttcaagggggatataaaaagatagagagggaaggaaatagcaggagactagtccatgaaaaaccaaagataatacagaataatatgggcataagtgtttagtggaggacctataaccaaatgggtcaggtagggcagtgagaaaagttaacaggaatgtgtagtatcttgaactacctttatctcaaaactgcaatgagtactcaggcctctccaggagtcagctgtagccttggtaaatggaggagtccccatccctccaggaaaggtcagctggctagaattcagcaccacagaagaaagcctcagatctcaagagtctagttagtaccacctattcattgggagcaactggagggtccagatcagtatttgtcaaagtatggtccataatcaccattagagttgtctgggatactcatgaaaatgcatattcctgggccccatcacagtcctactcaatcagaatcttaggggctaaagtatatggatctccagttttgttttgtttttaaatttcccatgtgattactgccaacattaaagtttgagaaccattgattatctttttaacaaggtcacaggcaattcttttgcatattagcatttgagaaacacagctggaagtagatgggaggcctgagcagggactgtgaagcccttcagcctctctggtggaccagcaaggcctggttggggtggcatgatcaaattgtggacgtttctaatgatcccctgaaactttagactttttctgaattcagtaggaaaacataaaaggatttagtgcagtgaggtaaccaaatcagatactttttaataagattagaaagactaggaggtttgaagttaactaagtaggctagaaaaatgcagctaagttccaaaagtaatctaccaagtgataaatcaatgcaacaagtagaaaggaagttctatttggtgttttactttttagaatataggaacagcttggatgggggcaatgaggcagaggaaaaactgaagatgacaatgtttttcaattttagtgatagttagctaaaatacaaagtccaggcctcacccttcaaaaatacccagtcaataatgttggggagtggctaaggaagcagcattttgaataagcacttactccctgccagttttcaaattcaggtggctagtggaccatacttggcaaatattgcgttagacagatggtaatgtcattaacaaaaacaggtaatctagaagtaggtatggggtggctgacgagggtggaggagcattagaaatctacattacaaaatgtttaaaacaagaaataagaaaacaaagcacttgtttttcccaaaacctaatagaattaattaatctaaacataattatgtcacaaataacccagcccccaccaaaaaatacccacaaatattttacttacttttattttaatgcttttttaatgcacagattgttgtggcatctggacacatgacacacttgaaaacaacacattaaatttatactgcctggaatagacaaaaagctgccttgtaagcatcatcaacaatgctcatcattgggggaggggtgtgctgcattagctgggtcccatggaattatatttttaaattctaaacttttcacaaatataaaagggataggcatttcaaatctgaaaggccacatgagggagataacttctattaaatagcaattttttcaagtacgaaaatgattgttatgattcaccagggtttgacttcaacagtatgggaaatgtacttgagttaatcttctggattatatttgtaaaagaagataggttagttaagctaggattggtctataatgtaactcttagtagtcaaactaaaaagtaattaatcgcataaattacactatcctttaaataaagatttttttatgaaaactgctctttctaaaagttttaaaaactttctaaaagttgtgcacatgtaccctagaacttacagtataataaaaaataaaaataaataaataaataaattttaaaaagattacaataggctgggcacagtggcttacacctgtaatcccagcactttgggaggccaaggcgggcagatcaccagaggtcgggagtttgatatcagcctggctaacatggtgaaacacccccccacccacgtctctactaaatatacaaaaaattaactggtcttggtggtgcatgcttgtaattccagtcactcaggaggctgaggcaggagaatcgcttgaacccgggaggtggaggttgcagtgagccggaattgagccactgagctccagcctaggcaacaaagcgagactaggtctccaaaaaaaaaaaaaaaaaaaaaaaaagattacaataatatgataccaaacaaatgaaactgcagaccctgttttcaggattacaaagtgctaatacaagaagaaacacatatccaaacatgtaaaaagaacaaacatctacaattatgatgtaaagccagtaagggaggcagcttgtaccactgcacgctaagagcttaatcaaacaaaaggaatgagaagaagcaagggtaccattagcttcagggattctgaggttcacaaagggcagtttcatatccacttgactattacccgacaaaccttcagactgcttttcctgatgagacaaagagtaattgaaaacggggttatgatctaaagatcacaaactttgagttttcaatgcttacaatccctctaaattggattattttaagaaaattaaataaaactcaagattgtttgaattatcacaggaataaaaaaactttatttcatccagctggtaccaaaaactgggctaaaaaatgaaggaaaacaataagctctagaggtaaacatctcagatggtatatacttttatctctgtaattcctgactaaatggatgtaatttcttttatcataattcctctatatgaatggccttttcttggctctaatggaatattagtgaattcttatgactcagaattttcaataaatttttctgaaacaaaaatttactagcaaaaaagacactgcctttatgtttagcccaaatgttaattgcatttgactaagaatttctgagtaatacatctgtgttcagtgtaaacaaaatgttctgatacactttaagtcttatcaaaatcactactaataaccaagtttgttttatccaatgttaaaatttttatttttcttaatttatatgcattttacattgaaacaaaacgtgaaccaagttgccaaaatttggtagttttaggataaaactactattaataagtttgggaagtctactgaaaaccttttctgagtctctacatgcatgtgctctgtcaatctaagagggggcttacataagtcacattacccaatattacttgcccgatttctcaaacaatgcacattatcatcccaagaagcatctgtttcatgtaaagtttgggaaatagaggcctagattattggaaagctaattaaaatggatcataacagaacaaaataagcattttggttaacgaataaaagatatcaagaactggctaagagacatgcttatcaatcatttccccagcttgtgataaaggaatatcctgtcatcagagacctataataggatgaccatataacttaccatccaagccagaacacttttgagagtcaaagagggccccattcattacagcaagataaacttaaaccaggaccatccaggacagcccttgccccaactatgaagcacacaaggacagtttaccatacaccatagctcagttagttttatcacccataaggtgttgcggtaccaggaaagaatggcaagtcttcttttaaaatactgcatttcagaaaacagattaatattttaggcaatacctgaaacagatatgagaatatcacaatagtaggttatgctgagatagactgtccttatttacaaaatcatcctctggcacatggcactactgaatactctgtcgtcaaacttcaagccgtcagcttccaagtcagcactttcctgattctccttctacatttcaatttcttctttacctctttcattagcattcttcctctaggtgcctatgaaactatggcgtttgtgttcccgtgttccccataattcattcactttatatattacgccctccttgggtacctcattccctcaaatatattccaaggtcctatataactacccctaacttcttcaatcatacatctagcatcattctaacaaagcataatcaatgtgaatttcttatttttcctttaactagcaagtttctcctgttttctaccttttttgtttgttttaactaaactgaccaatacagtgttctcattgcatgctatcctcttttgacagtgttaacttggatcacttgattaaggtggtacctgcctaatttctccactgagagagaatttagtcttttcccctttgtaattaataagtatttggtgtggaggtgctttgaaactatgtaaatatcctattcatcaaatttaccactacttggttagcatttattgatgtttctcggttgaattaattatattctgacaggtgccatgtgatgattttataatttcctcatttcttccatatttattcgttagtatcctactttattaaaaagcatttccttctctccatttatttattcatatatgcgtttatagcagtatgtactcatagatatttttattcaattagttagaattaatgtatatcatttttaaaattttgattcccaaattgtcctggatttggccagtgaaagttccttcaaggtggtttgtgtccttttggcatatcaccttttttaagaacctctttattttctgacacacagatatttacggtttagcgtgtgttttccctgctcctgccctgggacctgccatttctctaagggcccacttcccctttagtagagaatgttttttagaaagcaagatctggggacaagatatgctcatttctaataaactgatactgttcacaggccttctaaggagagagagctaggaaatatatgtattggtgtgagctcagtacttccaatttccaatccaacatcacacagctctcattctactacgccctttccacatttatattcatagctttcctctctaacattaggaaacctgtcagacattattatcaatgaaagttttcatgtttaattttttgtataatattttacaaaacaattaatacctaatatttctaaaatttgtgagtcacctatgaaacaaaggataagaaccgatttgaattaaatctacagaataaataacctgtgctcatatagaccaacttggtgataatggtaatatcaaatattaaataccccatagaggtctatcaccttattttacaccttatagacatatgctccacgctatggcaaggaaaatgagactgtgcttaaaccaaccacacctactgctgaagctggccatggggtctgtttctcctaaacatatgactgtctgcaaaatgggtagataaaagaataaaaccagtgttctttgaagataaggcataaagattctagatagaaaactaaaagcatcagtcctatgtgtagccacatactgtatgtttacatgggtatttatacatttaaaaatatagcttgtctatatcagattgctaacattcaagatatatattgtgaaatcatgtttctgtatattgattcatcacttaatctaaggtttaaacacaatgattctcacacttctgactataaagtacacagataacatatcactcactgaatctccttgatctattttagcggcaagcatcacttatgctaatttttagtcatttctatgtgtattatcaatttcaagtaattaggtttccaaattcaacaaaaaaatccttaagtgactagggaaagtcactcagttccacacagagagagcaggagagaaagtgtgaaagaaataaaaacctctattatttttgtaatggtggctatttcaatggtgaactgaaaaagcaagttctagtttggtacatggatagtttccaaaagacgttcaatgattatcccttgactaaataaagaatagtagggaaatgtaccagacaagaaggcataaaaccttagccacatcttttcaatgaaagactagatgacattgacaaagtcaatcagtttcccttcttacacaattgctaaactctcttccagtttaaaaaacatagaatacataagcatatgtatcaggctaagggtaattattttcatgccgagaaacacatccttaaatattaagacagaactaacaataagtacataacttttaagcatatatatcttaaaactaatggaaattatgtgtactgaaataagcttaagtatataagaggaaacaaagagctcaagacaacaataacaaggccctttatggaaattttgcttccaatgtaatagcttcaaaatgctgtatgacttatttaaaagagctttattagtaattaaatgtcaaaagtataaaaacaactggtctatatccaatttcatagaagttgtactaaacgcattcattatatcgaagtcccaggtgattatagcattagcactttgttagtatttgcagactgctagttttcaaacagattgtggtattataacatgtatttatcagctatgatgcaaattatgcttttaaaataccaccgaatttttccactagagaaatacaataaagatttttgagcttaaaaaattgagaaaacaacatggaaaaaggttaatggaaataagcactaggctattagctaatataactctactatgtagaaacaaataaataagtaaaaatagatggaatagtacaatacgaaaaagcataagtagatttcctgttacaatggattgatggagaaaagaatttcccaagttaaactgtaatacaaacaaaaaaccagaagttctactttgtgccagctttttatcttccatctcctattccctaattcccactctatcaaatctgtaatgcctttcataaggtatttcatttaaaaagatgtcaaagttctgcttgatagttaattgtcggcctttttaagagtattcagtctcacaaaaaataacaaagaaaagctagcaaatgaaaatacgaaaaatatacttttgaataaactgttcaagataataaaagattccaacttgatcaatgttgtgaactacaaatattaaaacacttcaacagcaaatgtttagaaattattgctaaaataaaataatcagggttttggttaaaagcgtgttcattctgtgaaaattcaccgtctacatattctgttttgtgcacgttcctttatgtacagtattatgcatcaacagaaagttttgaaaaattagtaatgtagctaaagtgataagtaagcacaaattagaaaagacaaaagattgaaaaataatgaaccaaaaaggaaataatagaaaaagaataaagcccttcaaattacaaaaagtcataaactaaaagcaataaataattaaatttaaaaaacagagtcaaaagggatgatcaacatagacaaaaactgagcctttgaaaaataataacatggaacaaactcttgtcctgacggaataagaaaaaaatacacaaacagtattagatatttaaaaaaagactcaatattcagcagagattaacattatataacaagaagattctattaaaaatgccatatcaataaatttaaaaattaaaacacatttcttaaaaaacagacttaccaatagcagctgaagaaggtagagatcaaatagaataaaattcagtggaactataattttttaagtcaatcaatgtttaaaaatctacccttaaaaaataagacatacacacacaaaacaggtaagattaaatggtcaacaaggaagttttattaaccattcaaggaacacataatccctacaacaagctttatcaggtatataaaatattaaactattttgaagcctaaaaattggcacacttctcaactcatttcataaggctaatagaatcttgaaatgagaacaaggcaagatcattatgagaatgaaaaattacaagccaatcttatttatgaacaaagatacaaaaatcctaaacataatattagacaaccaaatccagtatgtataatcataatgataaaatattccatgatgaagctgggctaatcacaaaaatgaaagggcaatttaacattagatattatcttagtagtattcttgttaactgattaaaggaggaaaatactgacagacctcaatcaatacagaaaaataaaagttacattcaatacccattcattattacagggggagagagaaggaagaaagatagaggatgaacagagggaggcaggaaggagaaagcaaggaatttagtatatagaaatagaaaagaactttttaccctgttgatacataggcaaacaaacaaagcaaagattatcctaaatagagaaaaattaaaagttctcttttaaaaatcataagcaagacaaagacattgcagtgagacatccagatagcacagtaagacaaaaggggaaagagcataggggattggaaaggaaaaagaaaacattatgattcacaaataatatgactcccaggtggcaaagtggagagaaactacagacaaatatttgaatctgtatgaaattatttgtaagagctcagccaggttatgatatataaagtttatatataaaattctaatttagtatagcaacaaaatctataaagcagctataaatactatggaatacctctaaaagtatatgcatgactacttattgaactgttataggagctcagattattacaataagttaagaagagtaattaataaaatatttgagggagcaatgtggcaatacccagtaaaattaaagattatgtacctacaagaaccattaatcaactgctagttatatgaactagggaaacaattctatatgtgcacaaaaacactagtaagtacactcactgaaaatgtttttaataacagcaaaaaaggaaaataaaactctgtatgtctacataatttattcataagtgaaatataaagcagttaaaatgtgtgaacaaagacacatgtatttatacacttacaaaacaacttaaaacatgaaaaatcaatagtcaatattatttagggaaaaatatacctataccaacacacacacacacatgcacccaaatgataaacgccaaattctgtggttatatagcaggaatgaggaagtacaattaagatcgcttgcacagggttatttatttaatcagatttcttgacagtatattgctgggtcttgcttgttttacccagttgaaaacatgtgttttaaatgtacaattaagatcattttatttaatgtaattaaatatgtttgcatttatatccctcatcctacaatttattttctatttgtcccatctgctgttacctcatcttctttgttttttttttttacttgcttctttgggattaattgagcattttttagtattttattccatcttcacttttattagtcattcctctgttttacatttttagcagttactagaatttataatacatattatgtaacctttcataatctatcttcaaataatattatactactctacatattatataagatcttgcaaaagtaaacttccaatctcaaccctctatcctttgggatattattgtcatatgtttcacatctatgtttttatcaatataaaccattgataatatttttgcagtaaagagtcaacatatctttttcaaaaccttaaaaatgataaaaatgccttttgtatttacctacatatttactatttccaatactctttgttccttgtgtgatgtttcattttccttttttctgaagaattccattaacattacttgcagtgcaagtctttgggcaacaaattctctcagcttttgtttagagacaaaaacttttattttgtctttaatttttgaagaatatttttcttcaaatagaattctagggttctagggtcacaactattcttacagtacttgaaagctaacactcctttgtctaccaactgggatagttttgtggaacagtcttcaaacttatctttaggtttacctttttatattttaaaatttttaattgagatatatatatatattcgaggtgtacaacatgattggatatatgtatacaatttgtaatgattattacaatcaaattaactaacacatccatcaccaaccattttaaatttgtctttagtttatattcctcacccatacttgctacttttaatgatttttgcattattgttttcaccaatttaattttgatgtgctttggtgtctgtgtgtctactattatactggtcagacttctctgagcttcttagatgtatcgttttgtaattttcatcaaatttggaaaaacttctgacatgatttcttgaaatactttttatttcttcccctgcccctgccactattctgagactacatctacacatatatgagaccatgtattgtctcataactaaccgaggcactgttgatttttgttgggaggggcaattattcactctgcctttcattttggatcaatgttactgcaatatcttcaagcacactgaacttgtcttctgcagtgtcctatctgctgttaataccataaagtgaaagttgtgactcaaaaattatacttttcaccactagaagttcctttgattctttctaatatcttctatattcctcttatgttaaggtttttctttaaatatttaaaaatataataactgattacattttttgctggtagttccaccaaatctatcatttatagatctatttctattgactgtttttctcttggttataaatcacactttcctgctctgtggcatgactagtaatttttaccagataatggaactgcaattgttacattgtttaatgtctaaatgttattttactcttttaaaacaattggggctttttgttgagaggagaaagagagttaaaatcagtatggtcaggttttacttaagttttttctaggttgcatctaagcaacctttaatctaggtatagatcagcctacttctaaaacattatccccagtggggtctcaactaaatgccctggttgattatgaagacgtgccattctgagtggtccaaaccttaatatctccccactctgtgtgagctcacagaattgttttatttgtgaatttgagagaagcaaaggggatagaatggcttgacccagcagggtaaacagcagctccacacagccaaaatgcctacccaatgactccataaggcaggaagactcccagcttcatggatgtcagagacatgaagggatatcagagaaggaaagaagccacactggctttgcccaggaaggtaagcaatggctccacacaaccaaaaagctcaccctacaacctccccaggcaaagagatgtcctcctccacagatctcagagaagcaaaggggctatacctatttgacctgggaaggcaagcagtgtggctcaacacagccaacaaacccaccctacaaccctactcaggcagggagattcccacctctatgcatttgggagaaatgtaggcactagtcctgcttgatccgagaggtcaaacagccactcaattcagcctaatgcccatcccagggtaccatacccagagggaagcaaaccctcatcatgcattcctaaggagcatagcctcaggtcccacctgtccagagcagcaactccacctaaccttgcagcctgcacccttgcccaaccacagatcccaaatagcagaattacccagccaaggaatatgtcttatatctgggctgaccagaagccactgcagtacccagccagcagctccacctaataggagagcccagtcagtggtctcaccagtcagcagaacccagagagtagcattatctgacatcacagcgaaggtagtggcccagccaactagagaatacataaattctcttcagggtcatcaccagctgacccttcatgaatcacaggctagacaaaataatgaaattctatccatgtcaaagaactcctgtaaatgtgagaagccagggctgtcttctcaaatgtacagacctatcaataatcaccttaaatgtaaatggattaaattctccaattaaaagacttagagttgctgaatagatttaataaaaaaaaaaaaaaaaagacccaactgtatatactgtctgcaagagaatcacttcactgtcagggacacaaacaaactgatagtgaagtaacacaaaaagatattgcatgcaaatggaaagcaaatgagagtggagtagctatacttatatcaaataaaatagactttaaattttaaaaccataaaagagacaaagaaggtcattatataataataaatggacttgtccagcaaaaggatttaatgtttgtaaatatatatgcacccaacattggagcacccaaataaataaagcaaatattagtagatataaagagagaaattgactccaacacaataatagcacaggacttcaacacaccacttacagtaatggacagatcatgcagacagagaactaataaagaaacattgaatttaggctgcactctaggccaaaagaacctaacagatgtttacagaatattacaaccaactgctgaagaatatacattctactcaactgaacatggaacatttcccaggatagatcatatgttagatcacaaaactagtcttaataaatttaagaaaactaaaataatatcaagtatctttctgaccacaatggtataaaactagaaatcaataacaagaagaactttagaaactttacaaatacatagaaattgaacaacatccttctgaaaaatgaatgggttaatgaagaaattaaaagggaaatttatttattatttatttatttattttgaggcagagtctcattctgtcacccaggctgaagtccagtggcgtgatcttggctcacttcaacctccgcctcctgggttcaagcaattctcctgcctcagcctcctaagtagctgagatgacaggtgcctgccaccatacccagctaatttttgtattttagtggagtatttattttgtattttagcctccctgttggccaggctggtcttgaacttctgacctcaggtgatctgcccaccttggcctcccaaagctctgggattacaagcatgagccactgcacccagccaaaagggaaatttaaaaatttcttaagacaaataaaaacacatcaaaacctatgagatacagcaaaagcagttctaagaaataagtttagagcaataaatgccagcatcaaaaaagaagatctcaaataaacaacataacattgcacctcaaggaactagaaaaatgaagaaatgaaacttataatcaatagaaagaaggaaataaaaatcagagcagaaataaataaaacagaaactaaaaaaatacaaaaagtcaacaaatgaagagttagttgttttttgcaaagagaaacaaaattaacaaactcttagccaaactacatttttaaaaaagagaaaagactcaaataaattaatgatggaaaagaaggcattgcactgaaatcacaaaaatgcaaaaggtcacaagagataattatgaacaagtgtatgacaacaaattggataatgtagaagaaatggataaactagaaacatgcaacctaccaagattgaatcatgaagaaatagaaaatctgaacagaacaataataactaaccagcttaaattagtaatagagtctctcatcagtgaaaatcccagggcatgatagcttccctgttgaattctacaaacatttaataaagaacgaacactaattttactaaaattattccaaataattgaagaggagggaatacttccaaactcattctatgaggccgtaattactctgataatgcaatcagacaaggatggaacaaaaaaagaaaactactctgatggttatagatgcaaaaatcctcaacaaaatactaggaagagcccatatcattaattctgatcaagtgagattcaccccaggatgcaaggatggttcaacgtatgcaaatcaataaatattatacatcacattaacagaatgaatgacaaaatccacatgatcttttcagcagatgcagaaaaaacatttgacaaaattcaacatcccctcatgataaaaactctcaacaaattagatatagaaggtacgcacctcaacacaatcaaggccatatgtgacaaacccacagctaatatactgaatgtggaaaagttgaaagctttcctctaagatctggagcaagacaaggatgctcacttttaccacttctgttcaacatagtattggaagtcctagccagagaaattgggcaagagaaagaattaaaaggcctccaagttggaaaggaagaatttaaattgtgcccgtttgcagatgtcattatcttacatggagaaaatactaaagattccactagagctgcaggatttgaattcaacatacaaaagtcagtagtatttcttctttgttttagacagagtatagctctgttgcccatgctggagttcagtggcaaaatcttggttcactacaacctctgcctcaggggtttgagcagttctcctgcctcagcctctcaagtagctgggactaaaggtgcctgccaccacgcctggctaattttttgtattttagtaaagacagagtttcgccatgttgctcagtctggttgaactcctgaggtcaggcaatctgcctgcctcagccttccaaagtgctaggattacaagcataagccactacgcttggctgacaaaaatcagtggtatttatatatactaaaagcaaactatctaaaaatgaaataaggacaacaatcctatttacaatagctaaaaaaaaaaaaatgggacacttagtaataaatttaaccaaggaggtgaaaactctccgcagtgaaaactatttttaaaaactgattaaaaaattgaagacatacataaatggaaaagcattccatgtttatgaattggaagaatcactattgtaaaaatgtctgttttactcaaaatcatctacagattcaatgcaattcctgtcaaaatcccgaagacatccttcatacaagtggaaaaaaactatcttaaaattcatatggacccagaaaacaccctgaatagccaaagcaattttgagcaaaaaagaacaaagctagaggcatcacattacctgactttcaaatatactatgaagctacaataaccaaaacagcatggcattggcataaaaacagacacacagacaatgaaacagaatagtgaacccaaaaataaatccatacacttacagccaactgatgttcaacaaaggtgccaagaacacagaatagaaaaagaacagtctcttcaataaatggttctgggaaaagtggacatccacatacagaagaatgaagctagattcctgtctcttgctatatacaaaaattaaacaaaatgaattaaaggcttaaatataagacctgaaacaataaaactgctaggagaaatgctaggagaaaacagggaaaacaccatattggacacacattggattgagcaaggatttttttgggtaagatcccaaaagcacaggcaacaaaagcaaaaaatagacgaatgggattctgctagaagctttttagaagaggaaaaagcagaggaaacaagcaatagagtaaagagagaatctacagaatggaagaaaatatttgtaaactatgcatctgttaatatccagattatattaggactatatatccagactatattaggaagtcgatcaactcaatacaaaaaaaaccccaaataatctcattttgaaaatgtgcaaaagacctgaatagacatttctcaaaggaagacatacaaatggccaacagttatattaaaatatcattaatcattaggaaaatgcaaatcaaaacaacaagacagcaccttacacctgttaaaatggcaattatcaaaaagataattaaaaagtagcaaatggtttgcatgtggagaaaaggaaaactcttacacactgtcgtgggaatgtaaattagtacagccattatggaagagagtatgaaggttactcaaaaaaaaaaaaaaaatagaactactatatgacccagcaatcctactgttggatatatattcaaaaacaaataaaatcagtttgtcaaagaggtatcagcacttcaatgtttataacagtactattcacaatagccaagagatgaaatcaacctaagtctgtataaacgaataagtggataaataaaatgaagcatatatatggaatgaaatactatccagccataaaaaagaatgaaatcctggcactcatggcaacatagataaatcttgaggacactatgttatgagaaataagccaggcacaggaagacagctacagcatgatctcacttacatgtggaatctaaagaagttgacgtcataaaagtagaaggcagaacggtggtcaacagaggctagcaagggaaaaggaggagggtacaggtaaattttggttaacagtacacagttacagttagaaggaataaattctggtgttctattgtagattaggataactaaggttaacaaatatggtattgtatattttaaaataggagaattttgaatgttctcaccacaaagaaatgataaatatataaggtgatggatatgccggctaaatgccctgatttgattttgcacaatgtatatacgtattaaaacatcttactgtaccctataaatatgtatatttattatatcttaataaaacaaagttaataaaaaaattaaatagataatgagtgctgactgtggtgtaggtactgtcaaaggcatatttacatatgataaataatttttaaagaagctggccagatgcaatcattacccattatcctatgttgggcccaatttatgtatctcacccaattcactacatactggactttcagtcacttgcccaatggacagcactggccattaccttcaactcattttccagtaccactgattgacgttgcttcccctgtagtgaagatgaaggcacagccctatcaccactttcacagctacagcaatatctacaccctgacacatggaagctcagttcctcctgccacctccagattccagtgaagccacaaagcatacggtgtaggatctaacttccccaacaattgcctactggggtcaggggatataatctgaaagtatagggacagtaacataccataaggtgagctttgaccaatgtgaaatgagagataggaagatgttggcagataaattatttttcttcctcaatctaactgacttgtcctgtacagcctgtctgtagatgcttcacatgactaagcaacagtctgtgtttgctcgtgcagctgtggacagcttagtgaccaacttacatttgttttttcctccttatgtaccatataggtatgtatatagatacatatttgttcaaagattatatgcatgtgcaggcatggatattcattctagttttagcatttgccccaagaggtagctatatgtattaaatttaggatataaaatacagttaattatcaattaagttattttaaaaagtactaaaacatgtccagaaaaaagcagcatttctaattaaaaatagaagcaaagaatagaatataaaaagaaaaatatatatcttaacttaaataatataattaagaactaaaaataaagttactttcccagtgaaaatatgctctgggcagaaaaaaaaatgactaaaatatcaaaacggaaaattagaaagtggtctatttaataataacaaaggctaagccttaatgaaagtctactacatttcctaggatactttgatgatatacagaaaataatgagtaaattatttctcaagtgtgatatatctaggaaatagatcagtgaaacaaaaagagtaatatcacagcatacaaacagaaaattcacatatagatggaaaaaatcacagtttacattgcattcatgtttaaaatcaaacatcactttttcacattttgaagatctccccccctaaatatggaaagaaaaacaagccagagctttaatataatatttttttccaacctggaacagctgcaaaaaacaaatcttgctggagataagcttggttataaatatcaacattccctttaaataagggagtccagttttcataccatctgcctctttcttaaagggaaaaagtatgaaactcataaaccaggacattccctttcaaataaggcatttaaaaatgaatgtaataaaaaggcgatgaactactctgaacccctgtctttaaaattgccctatttagctcagatcagaaaatgagatttttttgaaagcaaacaacttttattcaatgaataaactgcctaaagcaattaatatttttaagtgttgttttctaattttttcacattactagccataataataatctctgattgaaccatatttctcctttatgtgtcatactccctaccatttattttttattttttattttattttacttttttttttttttctgagatggagtctcgctctgtcgcccaggctggagtgcagtggtgcaatctcggctcactgcgagctccgcctgctgggttcacgccattctcctgcctcagcctcagagtagctgggaccgcaggcgcctgccaccacgcctggctaattttttgtttttgtatttttagtagagatggggtttcaccgtgttagccaggatggtgtcgatctcctgacctcgtgatccgcccgccttggcctcccaaagtgctgggattacaggcgtgagccactgcgcctggctcatttattttttaactacgtgtgtcacctctactttttctaaaaggtttttagagcctattctaaagacctccatgttatctctaacagtacaaaaatctagttattaagagactggacttttcttttaatacagattctatcctctgcaaaaatccttcctatgcctctctcaacagtgtttatatatatatatatacactcaagtttggactttatcttaaagccttctttcgtggccgggcgcggtggctcacgcctgtaatcccagcagtttgggaggctgaggtgagtggatcacctgaggtcgggagttcgagaccaacctggccaatatggtgaaaccctgtctctactaaaaatacaaaaaattagctaggcatggtggtggactcctgtaatcccagctactcgggaggctgaggcaggagaatcacttgaacgcaggaggcggaggttgcagtgagccgagattgcgccattgcattctagcccgggcaataagagtgaaactccgcctcaggaaaaaaaaaaaaaaaaaaaaaaaagccttcatttttcttttgcccttcactatttttcattctttaatccttgtgattgaacatttaattttttcactgtaccacaccattactatttcaataatgaagcccataaactacatccattacttaattctttaaaatattcacaagaaagcattaatacaagatggtttaccaaatagagcagtccagagggttatactggttgcatctaacgtaaaggaatattaagtatagtaacactgagatgacttgagggacggtagaagaaaactaagacaggaaaaaaatggcatcttctattttaaaaatatatatgtttagtcaattccttgaattacaatgataggattctgaaaggcaactgaaacaaatgcacatagggagccctgacataattaattctccttttcatattcattctctcccttattctttttctcacacacataaaaacacacccatatactgcaaacaaaaagaacaaaactgaatttttaatcatgagcatttgtagtaaaggcacaaagattatgcttacatttgtccttcataggaaaaatacatcctaggaccattttgtattttttaattcacttttattctgttttagctatggaccacctaggtctgtaattatagaaaacaaagttgctctacaaatggcaaatgacatttaattgcttacttggaatgctgcatcttcagtaaagaggaaggagacagagaaatttcgccacagtaatggttaacaacatttaatctctaagtatttaaaacaaatgatcattttacagcaatcaatatttcttccttttcatgattaatgtagatattatgaaatgaaatgaacaatgagattatcatttcattgcaacaatgaattcattgcaacaatatgattatcaatatcatatcattgcaacaggaaagttgttttaccttatacctatcagctagtttaaaatatttaaaaggttttttcttattaaatttagtccactgtttatttcctcacttccctgagcaagaatgcagggatctttgttttgtacactgaagaatctcaaacaataaggacaatgtctgcacatagtatatactcaatagacatttttgagtaactattctccaaaagacaattatgttaatttgaaacttacgtatttgatgtttaattattgtaaacttaattgaaaatgctttgagttttcaaaaataagcaattgtcaagtttagcccaatgctgcctccttatatattctaaatgtgacctaatggtttctctgtgcacagtaaactgtaacctttccatgtgtaaacagactgcaaccgacttttgtgccaatcactgagttttggccaaaggtggccaactgttcaaaccaggctcaaatgaggcaaacaccaagctgtaaccaatctggctgtttctgtacctaatttctgttttctgttacataactttcctttttctgtccataaatcttccaccacatggttatgctaatctctctctgagcctattctggcctgggaggcttcctgattagagaattattctttgctcaattaaacttgttaaatttaatttgtctaagttttttcttttaatgctatattttatgagaatctgagcctgataaagggtaggttaattcttccctacttgtttcctttctgattttgatcctttttggtgattaactaagataggcttattttccattttcaaaataggtacagtaagaatacctatctcacatggctatgttgtaatggttaaattaaatagttaatttatattaagtgcttctcacatagtaagtgctcaataaatgttatcatcatcattacatcatgctgatgtaaccaattactattgaggcagtatgcagtcaaggaagaaaaagaaagaaagaaggaaggaaggaaggaaggaaggaaggaaagggaaggaaagaaagaaagagatggaaagaaagaaagaaaagagaaaggaagggagggagggaggaaggaaggaagaaaggaaggaaagggaaggaaagaaagagaaggaaagaaagaaagaaagaaagaaagaaaagagaaaggaagggagggagggagggaggaaggaaggaagaaaggaaggaaagggaaggaaagaaagagaaggaaagaaagaaaaagaaagaaagaaagaaagaaagaaagaaagaaagaaagaaagaaagaaagaaagaaagggagagaaaagaaaagagaaaggaagggagggagggagggaggaaggaaggaaagaaagaaaaaagaaaaaaatataaacttgatctcacattcgtttttgagctccatttatttaagattcttaggatataagaatgctctcagaatatactaagcctataacaacttaattacatatacgatgtacaatatctggtattatttgatcttttaaatatcttctatcatcagctaagtggcttctacaaaagtatctttggataacttttaaaatgccaaattatgtatgctatcttattgttcacacatgtttgaaactctggattagtagagtaacagttacatttagaaagtaagttttttatatacactagtttctcttgaggagagacctttttaagaacagagtgctgtggtgtatttcaaaatggttccttttcccctcccccagggatttttatcagatatttactgtgagaacctagtctcacaatatgtatgtatttacatacttagtgcatgtacatatgtacatacaaaaggcttacacactagtccccatttttaaagctggcaacttaatctctaatcgttgtaggaatttgcaaattatccttcagtctaagaaaaaatttctcaggtaaacacttccacaattctttattctgtattctctttaggagttgtaaacttcttgatgttttttctactaagtctgtaagtcacaattccttttatatatccactacatgcattgtgcaggttaatactgttcctcttactagagcaatagcctgactttagataaaactggttctgccataagagcctcaaacctttaatttccaatgataagtttagcatctcaaatatttaaagtaaccctaggtctaacacataatagcaaacaagaaataaaattttagaaaagcccttatagtacattccaacgaatatcttccaaaacctttaagaaaatttccataaatattctacttttctattttctttttgaatattaaactttagtataacattatacaggtctccctccatagccatcagggattggttccaggactcctgtggaaaccaaaatccacaggtgctagaattccttacataaaatggtgtagcatttgcattaacctatgttgtacattcccctgtattctttaaatcatctttagattatgtataatatttaatacactgtaaaagctatgtaaacaattgttttactgtatttttctgttatttttttattgttgtatggctatttttattgctttttttttatcctgagtatttttgatctgcaattgcctgaattcatggatgcaaaacccttgatatggagggccaactgaaaattttttactaaaaaaatctatgatctaaaaaatctatcataggcttccagtttccatttctgtatgtaaggagcttagaagtcactactccatcccttttccaagtaaaaagttaaacagactgaaaaatcagcgctctttttggattcttaagaaaaatgaggacacagagcacaactctgactctcaaggttggagaaataggcaaatgcagagagtcacagcttaccagacagaaacccgtgagaggaaatcgtcacaggaaccagtgctgtggtagaaaaacctgaactgtaattgacaaattgctagaggctcaggatgaaaaagtctgaatgaaaaactctaggggaaccaagacagagaaggactcccacactctgtgagttttacccccaggagctcgactagcttctcacagtaaatacttgagaaaaatcccagtgggaggggaaaaggaaccattttgaaatacactacagcactctgtcattcttaacaagatctgtcctcaggagaaactagttaatcaaaggctaacttgctgggtactgtcagagcctaactgatctggggaaaggaaaacccccaactctagcccactctagctttccatgtggaggaagagaaatactcaactccaggcatcctgtcttcactaaaggaggggaaaacacttgtgaagttcacagtccaaaagccaatgctcactaaatgactaagacctaataataggactacagagtgtaccacatagctccatactttaccaccatgttactagaggcctatttacagcagttccttttacccagtacatcatatctggctatcaagaaaaaattacaaggcatactaaaagggaaaaaaaaaaacacaatttgaagagatacacaagcatcagaaccagatatggcagggatgttgaaattatcaaactggaaacttaaaataaatatgattaatatgccaagggctctaatggataaagtagacaccatgcaacaacagatggagaatgtaagcaaagacatggaaatcttaagaaggaaccaaaagaaatgctagtgatcaaaaacacaatagcagaaatgaagagtgcctttgatgagcttattcatagattgaacactagctgaggaaagatctctaagcttgaggtaaatcaatagaaacctccaaaaccagaaaacaaagataaaacacacacacacacacacacacacagaacagaatacccaaagattgtggtacaactctaaaaggtataacatacgcataatgggaatatcagaagatgaagaaaaagagataagaacagaagaaatatttgaaacaataatgactgagaataaatgtcagacaccaaaccataaatccaagaagctcaaagaacaccaaaaaggataaatgtcaaaaaaaactatacctaggtgtatcatctgaaaatgcttttaaatatcttttacctggatatcttatactcctttaaatcagtacaaaggtatgacagtcattaattcaactcattaatcttacaattcccctttccctctggatagaaggcaatactgcacttcatagttccccattcaaaatttagcaatttgctttgaccaatgaaactctaaatgccattgcataacgagccacactcccttcccactgctgcagtgatcatggaagtatattcagataaaaccttcaatatcttgggtccagaaccattctaccaacttattttggatatgtagtctgtgtgttgtgttaagacattgaaatttgggcttgcttgtttctacagcataacctgagctcctctgactgatacaaagggttacttttccccagcagcctttcataagtacaacatagtctgatttaaatgctgcttctccaagtgatgacagcattctattcatgctcttattataacacaatactatagtaaaatggctgctggaattatccatttcctttgtaaactatactcctgaaggtaggaactgttaatgcctagctcatagtaagtagttaaaacacattttctggattcattgatcattcatatgttcactcatcaagggccaggggccactccggttactagagatagagtgaaaacagagcaaaccaaaattcctgccttcatatgccttatattcttatgaaggataatgataataagcaacacaaataagtgtaaatatatagtttaatagatagtgataaaaattatagagcaaagaaagaatataaagctttggatggtcatcaggtaagactccatttagaaggtgaaattttaataacgaccaaaagaaaagtaaggaaattggtcatacaattgctatatatggatgaagagcaattcagtagaaagaatagcaagtgcaaaaattctgagatgagaaaatgcctggcacgttcagagaacaaaaagggaggcagtatgcccagggcaagagaataacgatgagcagagttgaagatgaaattagagaaataacaaaggttcaagtactgtagagacatttagaccagtttaagagctttatttagatttgatgttgagtaaaatggagagctatttaaaggctttgagtagagtgaggagtgggaaagaacagtaagcgatgaggtcagagataaacagaggcccatattcttccattttatgtcatatttcctctctccacaatacataagaaaaatggatgtatcaatttactaagaaatattgctgagtaaatgatattttatgatgatattaatctgtttattacttaatatgcaggaacagtgactaaaaccaatacataattatcaaaatattgcaatataccaaagtataataatgtactgaacatcaagacagaccaagcatttaatgtagcaacaaatctttaacagacaattgataatactaaatatttaacaaataaatcagttataaatgtatagctttataaatgttactacatttatttggatttgctgaaatatcacaaaataaatacaagtaaaaacatttccttattgtaaaactgccttccataagaaaaacctatgcttggaacccaggttcattgccagaaaaaaacaacccaaagcaataagtacaaagtgaaagaaaacaaaccacaaatcaaaacaccttttgcaaaatgttaaatcaaataaacacaccttgcgttgtgtctttgatgctgccaagtctaaactctggagagctgccaaggggtaagatgtttccaaagccaaggtctttagttaggtagcagtgcttgcattcctggcaaattcaattccaaataccaaaaataatattcttggtgatttttcttactgaaattcaaaacaaagtatatagaaatagtaaatggatgatctccagttccctaatagtccacaaatttaaatcacagggaaatcatttccaaaaggtgtttcttggtttgctaactctgttatttattccatctgaatacgtttctatgccaaatataattggaaaatgttgcatattatgccccattttaacaaggcacatttttatattattatgaaggctctgagaagtcctgtaacagaagaatctatttaaatttatgtgacccagtgtgtcttaaacaattatctgaaaagtagcaggagatacttccactgttttctaaagtcaagcataaatgtaaaaatactgatataaaattattttctgttattttaatttgcacaaggttgactttaaaaacaattgtatttattcagtcgtaaatgtttaagtatatgttactttctaaatgcacattttaaaagcaacatggaataataagcaggtaatgcatgatttattcatttttgttcagtgaatatttaccaaatacatattaaatgtcaggcaatgaacttatgtcaagttttacactgcaattgctctcatatggataagagtataaaatttaagtatttccaaactgggatctaataataataccaacttaaaatttaaccccaactatttgggaacacaagctttactttactaattctaatgagataattaaaaatagcaattttggggttacttttaaatagtgttaacaatacaagtcaagagtaataatatgaaagaataatcctttttaacaaaggtgctacaaaataatacagttggacccttcctcacaccaaacacgaaatttaattcaagatgaatcacagaactaaatgcaaagactaaaactataaaacatttaaaggaaatcgtaggaataaaactttattactttgagtttgaaaatagtctcttagatacaacaccaatagcacaagcaacaaaataaaaaacagacaaattgaactccattaaaataaaaattttatgctttaaagaacatgaccaaaaaagtgcaaagacagtctgcagaatagaagaaaatacttgcacaccatatatataataaaagtcttatatccagaatatataaagaactctcacaactcaacataaaagatcaaataatacaatttttaaatgggcaaagtatttgaacaattttccagagaagacatacaaattgccaaaaagcacatgaaaagatgctcaacatcattagtcattaggaaaatccaaataaaaaccacaatgagataccactttactcctagtaggatggctattttaaaaaaatgcaagtggagataaggaatgtggagaaattggaatcttcatacattgctggtagaaatgtaaaatgttacagccacactttgaaaagtttggcagctcctcaaaaatgcacggagttaccacgtgaccagcaattttagtcttaggtatatatccaagaaaaatgaaaacatctccacacaaaaacttatatacgaatgttcatagcagcattattctaatagccaaaaagtagaaataactcatgatgaacaggtatataaatgtggtatatatctatatggtggaatattaaaaagaatgaaatattgataatgctgcaacatggatgaacttgtaaacatgtatctaagtgaaagaagtcagtcacaaaagtccacttaatacataacttttattgttccctttatatgaaatgtccagaatgggaaggtcaatagagaaagaaaatagattagtggttgcttaagggtgcagaggcagaaggaatgggaactgacataatgggtacagaatttctatctgagataatgaaaatattctgaaattagatagttgcacaatattgggaatattgtaaaaattcctgaattatacactttaaaatgataaactttatgattgtgaaatatagctcaataaagctgttattaaaatacaagtgtcataaaaatacaactctacagtccttatctaaaatgtttgggccagatatgtcttgaatgattttagattataaaaatgtaataaacctcatctaccataattacataacactcctgaaaggatgtgggggaagcatattaatacttcatagaaaaatcttatgccatttaattacataaatagtcccatgtcatttcaagtctgttttttgtctcaattaagtttgtaaaaaacttgacaaagtttaattttgaagaacttttggattttgaaaatgcaagtgatggttgttgggagccttattaatgatgattgttaatattagtaataatagcagctacgcatttgttgactagcaactactgtggcaaacactgtggtaagcacatcacataccacaaattttcataacatttctgcatgacaggtacaatttcccaactgaggaaattgagtttcctaatgattaactgacttgcccaagcatgcaaagttgacagggaaagtagcagagattagaactcaaatctatctgattatagagcttactctctttcctctatgtattagagtatgttcagaccactcaccagaactacagactctacctctgtaaaatggagtaagagcctttttacatatacatacatgtgtacataaccatatatacatatatgtaagtatgtatataaatatacatatgcatgtatgtatacataaaattaatgtatgtacataaaatatatgtatatttacgtatacatacacatacagatacacatatatacacatatatatgtgaagtaagaatgaaatgaagtatttttatgaaaatgtgtcaaatataaagatctacataaatataagacaatatcatctgagtaactattttcattatatatctaaatcaaggttcaaaggggatatgttttcagttaaattttacaaaggcattccaaacaaacgtattaattttagtagaagaaatgcaaagtgttaatttaaacattggttttaaatatctaagcaaagaaaatctaaatatattcaagtggtctataactaaacttctatcatctcaaactttcataaagtttttggggtgcagtatgcaagcatatacattatgttttgtcttaaagcagttagttctatctactcaggagaagccagaacagattacgtttttactttataagtaacttcttaatattctaaaaaagtttaatgatttacgtttatttaacagcctgctcacataagtttacctaccacgtaagttcctagggtaactaggggattgtttatatattcccccttaaaggaaaacctgtgtatacctcagtacaacttttattccatgaaagtataatcatagaattaaagaactttagaaagtgtggtacagtatttgaaaaagcttcagaaccatttcaaaataccaatttgatcatgttgctctccatttgaaaacctgaaatggatcctcattgcctccaagatgcaaatagttttgcatgtcatataagagcctcctcagcctttgccagcaggttcatactgcctcaactctagccacttttctctagattaggccccaatcactaaacttcttttgattttccaatcacaagaacccattgacagcttaatagctttacaaatcttattatacttatttcaatgttgctcagccctagccttgtctaacttgaattcataggcacccttcaagaccccatttcaatcaattacgtactttctctgtacaagtcacctatacctgctggacaaatctttggttatctgattgatatgtaactcataactcacttattaaatattgtacatacttatctctataaacatctagatttttggcatataatagtatccattatttcttattataatattgagatattacctgattttcatctttggaaataaaactgtaaaatatttacatgaattttgtttcatttatggaatagagatggaaaagagaagatgtggattataaaattcaaataataatagattcctgaggttaaccttaacccatataagaccaaacagatgctggggtaagtcaaacactgaagggcaaaaattgaataaatctgagtcccttgaactgaaaagaaaagtacactatgtcttacaattcaggtcaggagttggaaaacttcttctgctttctagatacaaatattataggctttggatgtcaagagggaaaatcaaattataacaatgtgactatgattttagtgtgctgagatgcagagcaaggcaatgaaagtgcctcatgtgcacctctgcggcaattacacaactctgctgtattgtattgtactgtaaaagcagccatagacaatacgtaaacaaatgagtgtgattgttttctaataaaactttatttataaacaattaaatttgaattttacataatttccacatcacatataaacaaatgagcgtgattgttttctaataaaactttatttataaacaattaaatttgaattttacataatttccccatgtccacattatccttttgatttttttcaaccgtttaaatatgtacaaaccattccaagctcacggatcataggatacacaaggtgagccagatctggcttgctggtcgtagtttgctattcaatggtttggggatattttttaatctattcatactcttggattatcaggtttcctctctggcataaatgagtcagaagttcacaaaattttatttaaatctaggtcgttcttattgaattaattgtgtagtattatcttctcatgcaaacaatgttttatattagcagtcaatttttagctatatttaacaaaactatttaaagtctggggtataccatcagttatatatatgcatacacacacacacacacacacacacacacacacacacacacacaaaatggcttttgtgttgatattgcattatctcataataagctggtatcttcgggtctttttcctcaaaaggaaacacgaagtagtttagattcctttatacacatgctcctcaacttaccgtgggtgaaaaatatcttaaatcgaaaatgcatttaataccccaataaacccatagtaaaattgaaatattgtaaatcaaaccatcttaagtccagatgcttttcaacttatgatagggttacataccgataaacccatcatgaagttgaaaaaccataagtcaaaccattgtaaatcagggacggactgtatacgtaagagtggttttctgttgccatcacacaagaattacaaactgcctgggaatttttttaactataaacatgttgctctgttgttttctggcatttcatactacagaaaagaagtctgaggccagcctaataacatgcttttttcttttctttcttgatatggaaaacatttattttctttatcatcataatttgacaattttgtgatttttgtgtctctttaagttgtcatgccttacataaaaaaggccctttcttccttcataggtctttttcagctcaggaaagttttttctcctatttatttttaaaattatttttctttcaaatactctgttcttttcttcaggaacaactatttgtctatctatctatctatctatgtatctatcttcttgtctctttttcagagactccaaatatccacacagtggactctattctttattctccatatatcatctttttatgatttccaattttttaactaaaataacctctcaaatctattctctacaccgactaaactttgtacaacgacatcaattctatttgttactgcctcaaatatagatttttaatgcttttgtgataggcaaaataatgttcccccaatccaaaaatgttcaagtcctaattcccataacctacaaataagttaccttagattgcagaagggactttgcagacatgattcaatgaagaacctcaaaatggacagattgtcctgaattatctggatgtgtcttcaaaagtagataacccttccagatgtggtcaggagacatgacaacaaaataagtcagattgctgcaatgttgctggctttgacgttggaagaaggaggccataagccaaggaatgtgagcagcctccagaaactacaaaagacaaggaaaccaaccatctctcctagagcctccagaaaggaatgcagccctgtcccgaccttgatttcagcccaaagtgacctatatcagacttctgaaccacagaactgtcagatactaaatttgtgttattttaagtcactaaatgtggggtaatgtgttataagaggaacaaaactgatacggctctcatattttcagtttctcatcattttgttttctcttactatcttctctctgacacttcatcactgtctgttatttttacatgaagttctcctatccatagaagccatgtattcttgaatgtgttggacggcaaataactccccgaaatgttcttccttccttagcttaaaattatttttagagattcataggtatgcctctgagttttctactgataacctctgccttgattttgtaggatgtcttgtttcacttgatttattttcaaatgttaatttatccagaatattttagcactgaaaaaactgtatagataatttctacataagccagtgttttccatttatcgataaaggggacggtgttgaggggaggcagaaaatgaactccctaggaatgcagacaaagcagaatcggaaactgggaggttctttttaaaactgtaccttcccatcctgaaaaaaaaaatctgatatacctcctctgcccagagagattcagtactatatactgagtcactgtgaatgacggcaacgtattataatgctcaagcatgttgttcaaaaaaaagaaaaatcttcaaccttttccacatagataattaacttgactggaaagttattaatacccaacaaaggatatttctacctacagagctaagtctaaaactttcaatacagtgcaccttccacctgctataggtaataaactataatccacaattaggactttgccacaggtatccatatagttcattattccataccctgcaatatttgaatattttaacattcaaagtatgtaaaacaaatgttatttggattaacctatctttcttttgtcattgtcaaacttttaaattgttcaatacaattggtctgttatttttgcaactacgtcactaaataatactactacagaagaactaagctagtttatgctgttgtcattctccacttcagtggcttaaaagtcatgtgactgacaagagtctttcattaatggaactgtctttgccttttgagtcaaaaaaactgttaaaccactgaatatggagtatttacctttttattgtttaacatttcaaaattacgaattaagtaggaatcatttatttttcatggaaacatacacctatctcactctattgttgcaaagatgctgaacatttctaccatataaaaaaggtataaatatatataatggtatgaaaaattagctctaggcctacatgatccttatctgtttaataggaaatttgagaatatcaaatatgatcaaatatgtatcactattttccattagtattattttagtcactctggatgaataccaaaaaaccacaaaattctaagtaatattgtttaagacattaacactttgagtcaaatctactgatatcaaaaacacagatacatatgcacaaagattaaggagaaagctggctgagtttcgcgtttctacatagaagaatgtccactggagcagggactctcaaaagatgctttggcattggagtgagacaaagaaattctttattgagctgatagatctctacattacacaatatttatcatctctgaacttcaggatcccaaaagccagtagtacttcctttaaagaaattagaataattttaaaacaccctggcatatttcaaataccccagaggtgtcacccagaatggaaaaccattctggaaatggaaaaccagagcactagattaacagtcctggcctcagatcccacttcttcttcacagcttaccaaaaagagacgtatctgaccggttcacattactccaccggtagagctaacccattataaaccactaagcactggagattttccatcttttattagacctctgccctacaccatgaaaagcagtaattgtaagtaagcgtatctgttccgcaatctgaaatttttctctcagctgaactaaagtctaggttctgggaaagagagtaggagtaaaaggggataggaagtactagtactcatttttggtctcatttttgcataaagcactatccccactcgacttgttattgcaagttgaagttgatatggcaggcgccacatgtctgtttacaaacgcaagagaggaaggaaagagctattattgagcccctaaaaatctctaaatccattgtaatgctctctctaagccatttgtctttatccctgtttctctaccagaaatgaacagagttgaataaagaaagagtcaagtaccaaacagttcaaataaaattacaagtactaacgaaataacaggtgcatatatacatttatgcgttttacaaaagcaatagctctttacctcttcaagtttttccttatccaataacaactttttatatctactactgatatccacttttattgataaagctagatagggaatcagaccaaagaaaataatgaactctatttacagatttctatatgaatatagaaatcaggaaaagagccacagtgaaaacaaccacaattctttttagccacaaattaaaatgttataaaagattattcacttaagtttaaaaaaaaaaaaacagttctaagtatcaagtaatgatattccagtggcatgtactaaaaataatcagcttttctttgtccaaaacggacctcgatagatgagaaagtttatggatttaatgttcatctcaaaagtacaattttggccagacgcggtggctcacccctgtaatctcaacactttgggaggccgaggcgggcggatcacctgaggttgggagttcgagaccagcctgaccaacatgaagaaaccccgtctgtactaaaaatacaaaattagccaggtgtggtggtgcactcctgtaatcccagctactcgggaggctgaggcaggagaattgcttgaaccaggaaggcagaggttgtggtgagctgagatagcgccattgcactccagcctgggcaacaagagtgaaactccgtctcaaaaaaaaaaaaaaaatacagtttcacatttttctcaaaatatttgacaatgttctttttacttgtttaaataccagaatatgctttaagaggttatgatcaaagggcatttgggataaaacatagattacatggttttgtaagatagcaacaaataactgaacattagtagttcccgtttgttagtgctcaaaaaaacaaaaaagtacaatgggaaagggggccccaaaagggaactgcagatgactgaaggccttgaacaaaggtatgttatggtaagaggcactgtggaagaaaggcaaaagccccactctgctcccagctatgtagccttgggtaaaagttacttagtctctctgtaggatgaggcaagtgggagagaataatttccttatccctaaagaagttgaacaaaaacagggtccatttaggcttaaaattgtgcatttttctgaggagcaagtcaatagctttccttggtttctcaaagtggtaaatgacaccaaaaaggttagtcatcctcgcattaaaaggtaatgtttcccaatcttttcaggtatatatatatatctatatatatatatatatctagtgatattaaagaggaaaaggtgtcattcaagacattacaggttctacctaaccagaaccaacacagaatcaataatgaatagatgagttaatttcttccccatttctaaataaccctaagattaaaaaaaaaaaaaatcacaagggaaatttgaaaatacttaaagctgaatggcaatacttatacgtgtttataaatttggatcatatacacaaaaagattaaaagtgtaatcaataatgctttacatttgtgtggatcattactttaatgatactttcacaaccaattattcctccttttttaggaaggaagggcatatcctagagtctccaatttacagataacgaaacaattattgcccaaggacaaacatttcttaaccatgccagtttcctgacttgtaggccaatgctcctcccaatgttaacaagcagcacaagcttccttcctgggggtttgcactgtaaacctgccagaggaaaataaaagatttttacctcttttgttttttctctctggaatgtttgttgtgctgaatcattaggagacagagtatatgagcaaacaaaggcagatttaaaatggttatctgaggttaccatctcacaccatacttgttgatcattaagtatgagccgagtgaagcaaaaacagctctacaggtttagcacacctctccacagtagagaatgaaagggagattatacattggggctcctctagcaataaattgcttcaacttcttcaggaggcttattaagctcaaacaagcagcagagaactccaagtagaagaaacctaatctccaatccccttttcctagtcatccacgcggacaccaacatctgatggattcaggaatacaccaagctccaagaaaaatacccccgccccacaacctcaccaccaccgataaagccacctaatcctgtctgaatctcttctctgcaaatgttttggtatgcaaatactcgttcattaataagaggaagcaggaaaaagagtgaagaggagtaccatgggaaagggggccccaaaagggaacggcagaacccagagagctgcactgacaagtaagcgaccgcgagtaatcggtcagcacaaaggagccaatcccgagccgcgtggaagaccttgggaggtgggcgggactaacgtgtccagggcccagcggctggcgccagacacgctggcagggcgggaaccgcgcgttccttagcaaccgcaatggccacgcccaccgaacccagcaccctccatcccccatcccgcagccagcgccctactcaacgggaacgggtccttcagtgatcaccgtacctactgggtttcccggactccgggtttctcttgcagagcctccctccgcccagccccaccaagtgccgctcccagggacggaacgatcgtctcccaaacgctttagggctcgctaaagaggtgcgcccgctttcattcccggaccccgagcttcccgggcagggtctccccaatcccctcgcactcgccggacacacacctcagctctgccaaggcaagggccgacaaacttcgtgtcctgtgggaaatgttgctgtccacggttctgtcactcaggggcaggggcgggacaagccagccgcacacccctactcccaaagggtgaggcggaaaagag

SEQ ID NO: 567 - DNA, 82616 bp, Homo sapiens; identical to SEQ ID NO: 566

SEQ ID NO: 568 - DNA, 82061 bp, Homo sapiens
gttgattgatattgtgatttttaagttttattgattaaattcaaacttttttatcatttacacaaagaaactgtgacagactctgagaggactaaaaggcatcaacttaaattttaacatgcatttattaaatttatatgcagatgactacactactgcaattacagaaatgagtaagaacatactctcaagatcttacagtcattggttggggtgaaagtatttcttctgtcttcatgaaaaattaaaaagatagaaaatcttgaagtattttgctaccttaaaacaactacccaccctacatttgtactaaaataggcttttgcttgttttaaaagcaattctagatgaggttatatttttacaatactgtatctcatctcaaataaatttatacattctttaccctgtctaaacttgcatgcaaaataagaaccagcaagccttcaaacttcaatcacagtattccataggctatattttaagtctattgcattagttgaaatttattttgcagagtatgttaacaaacatattctaacacttaaaaaatcattacaattttttctgtttttgtcttctaaattactctgagcagtgaattactggagggaagatacccatgtctaaaatttgtgtctggtgccagtctcagatttctgccaaacaccagtaggtattcaaaagtgtggtccctttaaaacagcaggccggatatcacctttctgtcttcaaagattcaaaccagactcccaatctgggatttctctacagagggttggctgcttcccagttaatgtgagttttgcaaagtttgcatttcatgaaaacagtgttgtgtaaacatatattgtgtcactttacctactatttactaaaatcagagagtttagcctttgaaatttatggttctctggagctatcataaatcaatcagtcatacgaatggactagctgtagactcaggatatcaataaaactaggcagtgaaatttgcctataattatactatatttagattaatagttatcaaaaacatttttccccaaaaaatacctcaagggtaaaacagaatggtaaagtttttttcaggataatgaattttcaaacatttccaagaccataaccagccattttaagtactgtaaactctgttatatttcatttggataagtatctaataagcaattattacatatcctctcatttaaattaccactgaaaactagaaataatctttatttaatacgactgttttaacaccatatggaacgggaaataactaaatgaaaattgttcacgtaaatgtgatgggagtgggggggtggggagcagtatttcttgacatgtggcatgtcactcaggaaagtaaaaggcccatcatatccaaaatgccagcttggatattcccttgccacccacttgacgaacagacataccacatggcattaaatgctgcaacctttcctaaaaatgccacttggattggtccgctgtggtgagtatataagaactcttggtctgtctcttgagtctgtgagttcaaagggaagaatctagtaaataacaccggctaaattttgccctcagatgtttggcataaatgatttgtgaggatattggaacctttggctgttttcacaccaatgaaataaattatgctacttgaaaaaaattctacagaacataatgctacacagtcacagtcgactttttgcaaaagtaccagagaatatcttttagaaacagtgcttataaagccccatatactccttagatatttcccaaggatttcttctcttggctagcaggaaaacaatcttaatattttatttattcttcataaatacaatgtatataatataaaacactttgtgcacatgtttccaacaatttcattttctatgcatctttacataaggtagtagctaataactctttctgtggacacgtattttccagttttctaaggtttatgtgttcaagcattgtaaaaacatatttaaaaattgaattaccagtaaaaatattgaatgtacaggtcattatgctcccacaaatacaaaatacattgaaaaattatatcaacagataattacatatgaaatatgaggcatatattttcttctattatttattttctccctaaagagttctaattgattaaatctcaagagacaaaatgtaattttataaaacaactgtattgttcagatttaggagacaacctaagaagatgattctgagtaggtaggatttttgctattactgttatgtgaaaaagactgctcaattaaatgacagattgttacatatctccctaacaagaggggcgaactgatactacaagcagccagaacaacataattagaatagaattccaaggttatattaatagagtaataagttaattaaaaccaagatcaactgagcttctatttacaccagttcagacagcccaagaggaaaagaactctattttagagacatatgtgactctttgagcttctgtcatccaggtgccatttctgatgcagcacatgtgcactgaacagttggcaaagaaggaaaaagattatggtagatgtatgtgcagatagtctctctaatgatgtaaaatacgtccagaaagaaagcagggctttgttgtaaaataaaaaatttcccatgactttttgttctttctgaatgtgatttgagcatgtttctgtaaataagaatatatactaacttatgatgtatatagaacaaaaatagacttactcatcaggaagtgatggaattatacacataaattggcaatgacatttgaaaaatttaggatctggttcccatttcatctaaatgtaccatgtatagggtggctgtcaaagcagaaagatatataaaagtatccagtagcacatactatactgcattgctaggtaaggttcttttcctgacatcctatgcaactatcaaaaatcatatgtctgcaaactgaaaatattagcagaaagaattaaagatgttacagtttcagtattgaaagttttggtcccaaaaggtgctttcgtaaagttatttctctttcatgcattgattgttgcttagctaatcttcatcttggtccagatcagggtcaacatccgtggtgagtctgagataaaagaaagcatagaaagccagtagtagtgccaatatagctgcaagtacaaggccaacttcctgggaagaaaaaaaaagtagacttgaaattgatgaaaaaagattggttaacattattagtttcaccagataaaataaccatattgttccacagtctagaatgaataatttgaacctaataatcatatcctttttgtttaccattttttgccgttaagaaactgttttgtactggcaagtcccaatgaaatggcaaatacaccagtgggtgagtcattagtattattatttctagctaatttgttttttccttatagtaatattaaaaatgtatcattttaatatatttttatagtttggatatcaggatgttcgatacaagcaatgcagtttgtatctacacagttgatctgttttctatttgagtgtgtttaactttatttgtggcttcaatacattcagtattaatgatagcatttgggcacagttttttttttaattatcattccttttcattgtaaagaaacagttgtaactggtctctagattatatatagatgtatacatactcattaaatgtgactttgttgaaactctaatttttaaatcctaaagtctatagtttacactgcagaggaacaaaacaaagtactcttcactcatgaagcataatacaatacatttatcacagttttgaaggatgggcccagatttttcatttgtgatgtgatgtggattaaattaatcaactatattgtaataatgataaaaaatttactcatatattatgataaaaatcatattatctctcaaaaagtatgtatatgtatatatctctgtgtgtataccttccagaactttcttaacattaacatatcatttgactaaatcaaaaaagaaaaaaaaagcaaatagaatgccagttcagtatcctaaagggcttacatactatattctaatttctactgtatattatgccctttacctagcactgctttacagagaagcaatgcattagcatttacatgaatatagtttacatttcacaagaaggtaagtcagtaataataaactttaaaaacattaaaatgaatttggcttataatcaacatggaatttttacatgaatgttgaatttataaatagatcttttatacagatttttagcttcataattacatttatttagatgtccaaactatgaaaataaatattaataaaaaccaagaggttgaaaaactcaagtgtcaaagatctttgtaaggtttcattttttaaatctaatataccaatataatgtcaaaggaaagtgaattttttctttgttgcagtagaaacactttggcatctcaaaagggcatggcagcatcagacaggtttcatttattttcttatatccacagctgtgttcccagacccatctggttacacagctactaattttaagaggatgtaataaacaagtgacacacaactgcaaactccatctgttctgtatagtggacaacaaaactgttcaacagcagtccccattcgcccaagcttaatgcaagaattaagtttgtactcttgattggaggccatgattcatatcttattgataatcagttctaattgctgcttttcaactccttgtccttaaaacaactctgtatcatttcactatatattttcagaacatccagaggcatgaaaaggcatttaagggataggaagcagagaatattcatagaacataacttcagaagacccattaattcattacatctgttcaatgtacagtgtgggtgtggcttaaaggtactaggtggaaaggtatagcaaataattttctccaaaaattatctcttcattgaggagaaaagcattgtagaggctgaatgtcgggagagttgaaacgatggtaaaatttgaaaataatgcttgcaggatgctggtgaaactaaccataacttagagacctataggcatttatgactcccttgccccctttggctatttttagctttaaatcaaaaagaacaaaaaagaacaaacataacatttcaagctggctcatcccaaggggttgtgggcaggatctggttggcacttgaatattttatttatgtaacaaaactaaacttgtgatccttattctttcactataattatgcttttcatataaaccttttaaataaaaaagcaactcattaacaaatgtaaatcttttccttctaaatgctagaaaaccggtatttgcattctgaaaaaaaagttggtgatgctgtaattcttgaaaaaataatcttttaattgagcagcaactaaatagcaaacttagttgtgcaaacattttttaggcggcactcattgcattactgggccataaattatggcattttctttgtatttctaaaacacaaaaaataaaaagtacctcctcagtagaaatcaagtctaggtttcagaacaatgtattaatatcttatatggaaattgctaactgttcccttaaaacgctattactaaacatacatttacaaaaagcactagaagcctctgagggttaagcccctattgtataattctgcatatctctagcccatgatttctcaatcagtactgttgatttgatatggtaattaaatctataagtgatttcttgtataagctcttccaagatgatcatgtcttattcatctttcttttcacaggtgctatactattataatatttatggtaatttataaataatgaaagattgagtaaaatttatataatcgttatacagggatatcaaaattagtaatgtttttaaaactttataacactaatatccataatactacctccaaagccaatctaagaacattttgtaatatataatatggcaacacgatgcacactttaggagggtatcttaaggccgatgacaaacactgaaggagagacttacttacacaaactgggaatggctaattcaaacaaatgttttctcaatcagctaataattcataagtgacttctacacattcaattcaatgttcaatgtttctagtgtattattgaactctcctgacaacattatgaggtaaatggcaaaatttccattttataaatgtgccagcttagacttagatggatcatggcaaaaggaagaggcaaaggggataggattctaggcctccttatcctgagctcagtgctattctcattgctgttatttttctatccatgcatctgttcatattttctatagatatgaattaaatgaagagtatatctatgattcattcaaaagactatgtagtaaagtgataagatatcacaatattatggtcattctatatcaactaggtaagagtacaatatgcttgttgttcattagtccttagttgcttctctgacattatcaatatggataaaatcactcactggggaaattaaaaagcattaaatggcaattgctgaaagaaactttgttatttaaaatcctatgccaaaatgacaaggcaatcaaagtttgacagggcaaattaattagtatgccagatttgaaatgtaaaacaccttcaaggttctgattctaaaaagtttcatatcatcttaataggctctccacataaattgtcaagcaaagtaagtaatatttaaggttaaagtttttgttttccacaggtttacaaatcaaaatgatgtgctagcttattaaaaaggagctatgttctgctgtcagtttgaaagttttctgttgatactttaaatattaaataaaatctaagaaaaatgttttctcatagaaagattagcaaattctacagtgtttttaaaaagacactagataactgcactataaggtagaccttatctcatactaggaacattattatttcttcaaatttaaagactaacaacaattataagagcaaatgtataaaaaagatgtgtgtgtataaaactggtatataaataaataaatagctgcactatttctcaaatcctgatatttaacttctcatcatattgtgccacaagaggattttgttaccccatatttttctaagaaacaaacaaactaattaaaacaacaaaaatcccactgtattgtgaaagataaaagtaaatgacatattgcctttgagggcaatgacagacaatgttctcgctttaagaaatgatcaccaagtagccaaatgtaaaatttaaaaaaatctcaacactgctttttaaaaagtcacgtcataaagaatttttttaatgaatgagatttcacatgaaattagaaaaatacttcaaaagatgaatcttctctcttttaaacaaaaaggcaatttacttttttttcaataaaaactgacacacagcatggaagagatggtgttgtgcaaacatactgcatcacacggcaatgcttgatcaaaatcagcaatcaggagcgaaaagaaggcagtgtttcgtgatcataatagcaaattctggaagacaaccaaatatatcatctggcagttcaacagctgttacagcttggtagtaataccttggcatttgctgtaagctataacttagaaaaattgatttttcatctgccagataaaacccaaaatctccttttaacatgttaatatttaaataaaatatatgtactggtcatttttattttacacctttgatagtagagttgccaaattaattcttctattaatagtttaattcaactctaaatacctggcaaaagattgacatgggcaataatgtaaatgcaatttgttgagcttcattgtgttagcacattaaattaatatctgctaacatcattctcagttgcatttatccctcttaagcagataaaacactggtattctgaaagaacaagtttaggaatgtcattataatttcatcagagagtactgacaacaataagataagcagagtaaaattacataattaatgatctcagtatatataattacaactacaatttaaacaactataaaatgagatttattgaaaaacgaaagaaatttctgacgaaggccacatatatcactgaaatgtctgaataatacacatagtagctagagagaaaataaattgcacctttaagtataactgattctcttaagtgacactgttttaagacccttcaaaatctcagaataggaaggatgttttccattaagtaaattctttacaaaaacctttaagtctggcattctatttagattgtgaaatgtcataaaacatttagaattcaacatttatgcaatccagttttagaaaatgaaatggcatgcacatatcaaattttaaagttatcaaatagaggtttacctttatgcctattgctgttttctttgcttctgcttttaatttggttgctcgtaaaataggtttagtttttttataatcctgtttacctagaaagaaatagtttcagacaatgagttatgctcatatataattaagtttaacaatcatttgaaatgtcaaagaatgtttaaatacagtgaaacagggacacggagttgcaaagtagttcccagttgtggtaaccataaacttgtcaccaaaaggtcaacttttccttctctcttactttttcaggaagaggatactgacggacatcttcaatttgctgtatagtgaatgtcaaaaaagataaaaacttgttttagagaacacaaaatttaaagtaaagaaaataaaacttttggaagcatttggaaacagatgcataagtaaatgagtatatgtaagatcctattaacagctaaagttaactttgtcttcctaagagtaacagctaattataaatgtattttattatggatacgttaagcattcaaaacataagtgagaaatatccccaagtttcctttaagtaaaagactaaagaagaaatctataaatatttaacttttagccccaccctgaattcattagaaaaatatttcttttatttcctcttttatttcctcttaatagagaacaaaattaacatggctagatagaagttatagaatagctacatttagatattagtttcaataatttcttccacatttcatagccaaaaatgtgcgaaactgagttagtgccacaaaatttcctttgtgtatcatctagtgactccagcaaagagtaacaaaagtggattacacagcctggggagaatataggtttaacaacaagaacaagaacagtgaaagcattcattacaatgatatactttttgttagccaactcttaactaggaactgagtcaaaatgagcctcaaacataacaatataatattttattctcaggaggagttaatacatgatcgtataatctctctggctattttatattcttattttgttttattttcatcttttccccttcctttcgatgaccagttcctttacaaaactcatcgctacattcccttcatctaaataatacaaattctaacattaatttccacatcttcttcacattgaaataaattgaaaagcaattggtctaaactcaagtatatcataaaaatttaatgtgcaatatatcttaatgtgtctgctaatgattcaaaagtatctttaaaatttcatacagagttttagaactagaaatggtagtcaaatggatgggcgtagtgaagaaacattatatttatgtccattagacacataaaagtgtttgtttggctggaaagcaaggtattttgtttttaaaggattgtcttctctttccttaactgctattgtatagcaataactctggatcaatgagcatgcagaagcttaataaatattatttgatgatggggtctgatgatctagaaatgagacaattgtcataatatgtatcaaatgatctaaatttaaataatggaatgaacaaaatacatgagaaaaatgttactctgacccattttaaattagcaatatttaattctgatgaaaaaaatcttgacaagtgttcactctaatttcacatctctacagtcaaactattcatgtcattattcctgctgagctataaacagttcagaacaatgaaaatggtgacacatcaaaggcctccggtcagggttaccaagcaagtttctaacaagaattctgaaagatatttgaagattgtagatttatcacaaagtaacttcttgttttatcctgtatatgccctataataatctcttgatgctatggcggggggtggggggtgagcagcaggaataaacagatgcaagaggattatcttaattcatattttttatacagatatgaaatattttggataatgtatctgtcataaaacacatgcaaatatctaagagtcaatactaaaatgagaatttttcactctacttcaactgccatataaccattggttaaataatgtattctatttcaattcaactctcatattcttagagaataatacttccagatttgtattcaagttgatattaacatttgaaactgtatttataataaaaagacagtattaaaagttattgtatacctggtacttttccaagcagtgcatctgtcataaatttagcattctccttgtcgactatgatatccaaaagtgtatattgcaaaatgtggttttagtttactaagtgacaacatttacaggagtgtctggtaggttctttataactaaagccagatcattccattgtacccaaagaggttttcaacatttaaatatttatggcttcaagaaagatacctatgcccacatgattgtaaaaaatataaaatatagaagtccctgacttctgcgtacttacacctaagggaaaaaaaaaacacagttacataatctagattttatatgtagactgtttcttgaacacaactgattctgattttggttgtatcagtgatgcaataaccaaagtagctatttgacagttgctcattaaatcttatgtggagagaaaaacttggtaattcaagcctatgaagccaatctggggcctcaatcaagcccaatgtctgagcttccttaggaacaggttctactgcatttttctgtgtatgaactaacctattagttctttatgtgtttcataattttaaattgaaaatcaaacatatttgataatgtaatgtggaaactctgcaaactagatcgtccctgaggtttgttgttactgttatttgctctttgttgttgttgttagaatccctttgtttagtaactttactgaactaattctatagagactgtattcaatagtatatggtcactgaagtctctgcacagttaccttattggtcatctgctgtggtttaatgtgtcccccaaaattcatgttggaaacttaatttccagtgcaacagttttgagaggtgggatctgtaagaggagagtggatcataaggactctgccctcatgaataacttaatgccattattgtgagagtgggttagttatcatagaagttagttcataatacaaagataaattcagtttacttcctcattctctcttgtgcatgctctttggcccttctgccttccaccatgggataatgcattcacaaggcccttgccagaggcaggcccctccagcttagacttcccagtctccacaatcataagaaataaatatctgttctttacacattttctaatctcaaaggttttgttatagcagcaccaaatagactaagacagaaaactggtaccaagaagtaggggtgctgctataacaaacacctggaaatgtggaagtggctttggaaatgtgcaatggggaggggctggatgaatttgaaagagcaggctagaaaaaccctgtattgccatgaaggaagcattaaaggtgattctggggggtgctcagaagaaatggtgagatgtaaggaaagtctgaatcttcttagggattatttgagtagtcataatcagaatgtttgtagaaacatgaaaagtaaaggccattttgatgaggtctcagatggaaatgggagacatcttattgggacctggagtaaaggctatccttgttataaattggcaaagaacgtggctgaattgcttccatgtcaaatactttatatggaagacagaatgtacaagcaatggactaaagtatctgccagaataaatttctaagcaaattactgaaggagttgtatgactgccttttacctcatatagtgagatgtgcaaaaaaagaaatgactaaaaggtaaaatttacaattaaaagagaaacaggaggaaaagatttataaaactctcagcctggccatgtaaagaataaaaaaaaagtgtgctgaggagagaatactaaaggtgtgaccaagcaaccctttgctaaagagattactagggagagaaggggaccaggtgctattcatcaggacaatgagagaaagacctcaaagacatttcagagatctctgagaatgcccctcccaaaatagatccagaagatcttaagggcaacatctccagagaggcttccaggggacctctgtattcactgcctggagttgccttgggactctgtttctcacattccagcacagcacccctcagccatgccagctgtggcttaagcaggcccaggtgaagtttgtgctgcagctccggggacacaagggataagtcttagcagggttcatgtagtgctgattctgcagacttactgatttcatgagctgtggggccatggaggcccccaactagacttcaaaagatgttctggacagcctggggacccaggcagaaacttgttgcagggatgaagccactgcagagagccctgactagggcaatgcctagtgaagccacaggagaaaagccacctcagagactcaagaattatagagctaccagtgtgcaattacagtctgggaaagaaccagtcaagagactccaacctgtgagagctgctgggtggtttgaacccaacaaagccatatggggagggttgcctgaggccttaggggcccaatgcctgccccaatgtgaccaggatgtgggacatggagtcaaaggatattatgtccagctttaagatttaatgttgttttccctgttgggttttggacttgcttggaatctgttactacttttttcttgcctaattctcccttttggaatgggaatgtctgtggtaggcttgtgtcaacattgcattttctttttctttcttttttttttttttagatgttgtttcactcctgtctcccaggctggagtgcaatggcatgatcctggctcactgcaacctctgcctcccaggttcaagtgattctcctgcctcagcctcccaagtagctgggattacaggcatgcaccaccacgcctggctaatttttgtatttttagtagagatggggtttcgcaatactggccatgctggtcttgaactcctgacctcaggtgatccacccacctcggcgtcccaaagtgctgggattacaggcatgagccaccatgccaggccccagcattgtactttggaagtagataatttgattaatttcacaggctcacagatggagaggaatttgcctcgagacgaatgatgccttgagtcttacccacatgtgattttaaatgagactttggattttgaaattttgagtcgatactggaaggaggtaagacttttgggactattgagatggaatgaatgtattttgcattgtaagaaggacatgaactttgaaggccagggctagaatgctataatttgaatgtgtcctgaaaagttcatgttttggaaacttaatctccaattcaacaacattgagaggtgggacttttaagagattattaggtcataagggctctgccctcatgaatgaattagttatcacaggagtgggctcatgataaaagaatgagcttggtccctttcctcttgctttcttgtatgtgctcttttgtcctttattcttccccattaggatgatgcgttgacctttgactttccagactccagaactttaaaaaatagatttcttttctttataaattacccagtctcaggtattctgttatagcagcaccaaatggactaagacatcatgtaatgactggacagatatttccttaaatgctttgaaccactaagtctcttaattttgctgaggagctatgtgactatttgtgtgtgtgtctgtatatgtgcatgcaggtatatgtgtatgtttttgtgttggggtacatctccatgctacaacagaggtttatagttatgccttagccttcacttctgcttgtgaagagccttaagtccaccaagaggtaagagattataggttcctcacatctttaatgggcatgatatagccctgctcgtgcacatgaccttctagattctcaggaatctgtcagaccttttaaaaaattctatgggcatgttgttcccctgtttttgcttttattctttggtcagtctcatgtttaaccccactagtaatgatgcttcaggcaactacaatgttaaacacttgttgttcattgtttttgtcaaatgccacagagaaagggctcttcacacagagttagctctaagtaaagtcaaataaagacaagttttgagaaaggggcttttcagtgagtttccagactggtcaaattgtgacaagtcttgaggatgggggctttgcatatctccaaatgaattttgccttctccagtggctgctacgctaacgttttccgtaactactgtagttgaaaggctaaagaaaagaaaatggcattaaggcaagttaaaacaccacaaagattgcagatattactgagattcacctgtttttctgaaataaacactccttagatggttttaagattttagttaattttcaggtttctggaaaacattgattttgatagttttcaccagtgttctcactggctttatataaaagcagattttcagaggtttttactttccactcaagaagtacttctcctccatagctttaattttactatcatcacatttaaagttagtatgttggatttttacattaattttcattcatttacaatttttataaccataaaataggatacaatggctgagtcaaacagaggttgctgcttaaaagctcagtgttggtaatctatcagttatttcaggctgaatgtttcaaattctctttttgttttttacttaatttttgcaggtacataataggtgtgtgtgtgtatatatatatatatatatatatatatatatatatatatagatgggggtacatgagctattttgatacaagcatataatgcatgataatcacatcagggtaaatgcggtatctatctcctccagaattttcctttctttgtgttgcaaacaatctgattatactacttttttttttttttctggagtctcactctgtcatcaggccagagtgcagtggcacaatctcgtctcattgtaacctctgactcctctgattctcctgcctcagcctcccaagtaactgggtttacaggcacatgacaccatggccagctaatttttgtatttttagtagagatggggtttcaccatgttagccaggatggtctcaatctcttgacctcgtgatctgcccaccttagcctcccaaatcacacctgggattacaggcatgagccactgcacttggcctttttcattatttttaaatgtacaataagttttatcaaatactagatcttattcattcttactaactatatttctgtgcccattaaccattcccactccttccaccccctccccaatactcttcccagtctctggttaccatccttttattctctatttccatgagttcaattgtttaaatttttttagctcccacaaataagtgagaagatgcccactttttctttctgtacctggcttatttcacttgacataatgacctccagttacatccatgttgtcgcaaatgacaggatctcattcttttttcatggatgaacagtacttcattgtgtataagtaacactttctatagccattcatctattgatggacacttaggttgcttctgaatcttggctactgtgaatagtgctgcaataaacgtaggagtgtagatatctttttggtatcctgatttcctttcttttgcatatatacttagcagtagggttgctggatcatctggtagctctatttttaggtttttgggggaacctccaaaccgttttcaatagtggttgtactaatttacattcccaccaacagtgtatgagggtttcctttcctccacatcctcaccagcattcgttcttgcaccttttggataaaagccatttttaactgaggtgagatgatatttcattgtatttttgattttcatttctctaatgattaatgattttgagcatgttttcatacacctgtttgctacttgtatgctccttttgagaaatgcctattcagatattttgcccattcaaaactcagattattaaattttttcctattgggttgtctgagctcttcatgtattccagttattaatcctttgttagatagtttgcaaatattttctcccattctgtgggttgtccctttcactttactgatggtttcctttgctgttcaggagctttttaatatgatgtaatcccacttctccatttttgctttggttgtctgagcttgtgaactatgattcaagaaatctttacccaatccaatttcctggagagtttccccaatgatttcctttagtagtttcatagtttgaggtttaagtctaatgcattttgatttgatttttgtatatggtaaaagatagggttctagttgcagtcttctgaatatagatatccagtttccacagtaccattttttgaagagactgtccatatcttaatgtatgttcttagcacctttatcaaaaatgagctcactgtagatgtaagaatttgtttctgagttctctattctattccattggtgtatgtgtctggttttatgtgagtaccatgctgttttggttactacagttctgcagtataatttgaagtcagttaatgtgattcttccagttttgttctttttgctcaggatggcttttgcaattctgaggcttttttggtttaatataaatgttaggattactttttctatttctgtaaagaatttcattggtattttgatagagattgcattgaatttatagtttgctctgggtaggataaacaatttagcaatattgatttttccaatccatgaacatggaatattttcccatttttttgtgttctcttcaaatttttatcattgttttatagttttcattatagaaatctttaacttatttgcttaagtttattcctaggtgttttgttttatttgcagctattgcaaatgggattactttcttgattttttttcagactctttgctattgtcatatggaaatcctactgatttttgtaggttgattttgtacaaaaatcaactccagcaactatactgaaattgcttattaattttaatagtttctcataaagtcttttgttttttccaaatataagaccatatcatctgcaaacaaggataatttgatttcttcctttccaatttggatgtcctttctttcttttgtctgattgctctagctatgacttccagtaccatgttgaataacgggggtggaaagtgagcagtcttgtcttgttccagatcttagagaaagggctttcactttttcctcattcagtatgatactagctgtgggtctgtcatatatggcttttattacgttgaggtatgttccttctatacccagtttttttgaggggtttttatcatgaaggatgttaaattttatcaaatgctttttcaccattaattgaaatgatcatagggtttttgtccttcattctattgatatgatgtatcacattgtttgatttgtgtatgttgaatcatccttgcacccctgggataaatcccacttgctcatgatgaataatattttaatgtgttgttggactttggtttaccagaatttggttgaggatttttgcatcaatgttcattaggagtggcctgtagttttcttttttttaatgtgttcttgtctgtttttggtattacagtaatactggccttgtaaaatgagtttgaaagtattcctttctcccctattttttgaaagtttgagtaagattggtattatttcttcctcgaatgtttggtagaatctagcagtgaagccatcaggttctgggcttttccttgttgaaagatgtattatggatttgatctcattgtttgttattgttctgttcaggttttggatttcttcatggttcaatcttagtgagttgtatgagtctaggaatttatccatttcctctaggttaactaatttattggcattcagttacccaaagtagcttgtattttttatttctgaaatatcacttgtaatgcctcctttttcatctctgatgacatacaccccaagtccactggttccgagcccagcagagtaccaggacttgccaaggaattgcagtccttgtggcctagactgcctttcacgtttatctaggatcccagagtattttagtccgtggtgatgacgcttgctgaaactcaggttcgtaccaccaggatagaagacttgcctctggctaggactagtctaaatgctccctctgtgggcaccagctaagttcttccctgtgtggctttccactgtgacagggcagcactgagttccaaggcaaattcccacaatcactgcactctccctcatgcaagtgcacagattgtctcttaacaccacatggccaaaggtgaagtacgggaaaggggtggtataggtgactcaagattgtctttcaaatcctcttcagtgcctctttccttaatacgatgttaaagccaggtaccggttcacctgttttttgcttcttatgaaggtgcttgttttgtgtgaatagttgttcagtttggtgttcctgtggggggatgatcgctagaggattctgttcagccattttgctcatcaggttaatttcttatatatagcctatatttaagtaattttataaaatttcaatgtgaaaatctgtcctttaattagtatgtttaggtgtttacatttaataaaactattgatatgttttcattaaggtctaacttttttgtttctctttgttccctttgatttttgttgctctttcattttccttcttattgtattacttgaacaatttttagtgttccatttaaattatgtattgtgattttgactctagattaatgttttaatggttgccctagaaattataaaatatatacctaactttccagactaaatcaaatcaatttttattcaatttcttatttttaaatatattctaaattatgtttaaaattttaacattttaaaaactttagtaatccaatacatttcatattttaactttccagactaactcaaatcaatttttattcaatttcttatttttaaatatattctaaattatgtttaaaattttaacattttaaaaactttagtaacccaatacatttcacattttaatgtaatggaaataagaagtgcatttatttttagtgttgactttgctagttattgtttatatcatttgactttgctgtgctcatttaagagcagctttgacatttgtcattggttatggaagttttatccagacagtagattttttaaataattcaagcacttaaatgtctacatataaagaattatacacgtgaatatactattgtagcacaggtgtttttgataattaaatgccaggcaagatattggtgtccctgcttgatgcatgttcttattatagcctaatagttttgcaataaaatgtgaaaggtacatgcatagttaggaggattattatactctggttgctgacattttatattaataataaaaactgcaggctataggtgcctgtgattctgttgcagaataaaatttcctattactcttttctcatgttgtgatcagtttaattgaagagtatcctgaaattgctagatctatactattaataagatagttatcatatttaactatttatttgtatcaataaatttttctcaatagtatgtcatcaaaacaaagtacagaaatgagtattacgttcagggtgataactaatgtgtaaatgaaacaggtcaagtgcctgttatcccaaaccttgtgtaaaagacaaataataaacaaacaaaaattgttcaatttatcaggtgataaaaagcactaaaaagaagaatacagttggcaatgggcagacaatcaaagcgagatatgtattgttttagatatggcagtcaaaggagtcctccttaataagatttcatttgagcctatactcaaatgaagttagcaaagaagccatgtgggtagatgatagaagcaatttcaaatattggaaatattgaagtgcaaagattcaaaaaacactaactcctagaaggagtttaacagataagttgattaaaaaaaaatcaattcctaatggcagactcagtgatccagaacagaccctatgttcattttccagtttttgaatacatgggctcaaatgataatggaaataggcaggatctccagcatggttccccaatatgtgctctaacagctattttgttaatgagtgtgaagtagaactattactccctttctttactaaaatgataaagaaaaggaaatgtatactcctgggggaatttcagaggttgactatatgatgaataactttgtatgtgcagtcacactgattattttcactggcctgtttatttcctcactgtgattaattatatcatggaaaccaactgagtactactgaaaatttaaaattatagtagaattttcttactgtagcagaataatgaagtccctagcacatggtcataactagctaattaaccaagccaatgcatttttctcaggcctgatcacagatactgcaagaggctgtctgtccttactggaaaggacagcagtatacttacagtcctactgcaggagtagataaactccacatctcagtgttaaaaatatgattcccagagattttaactgcttcacaaccccacagtatatcacaatgacaatgatatgatgtaagtcttggagaagccatggaaagtgtctgagacatctcattcagatatatacataaaagagacaataataaacattcttttaaaagaggtttgctacctaagtctaatttatggaggtctgcatgttggaattgtctcccagaattaaaggttaacttgccacaccttacttaccattaccatcaccagcaagcatggtgcaaaggctcaacttcttaaaaaataaaaacaacactcacaacttgattattacacatccatacttatgacacaacactcttctactaggtatatgttgcagggaaacttgtacatgtaaatcgatgaacagacacgtctaaaaatattcatagaagcatcgttcgtaatagcattcatagaaaaaaaaactgagaataatttataactgtccaaaatcaggagactagaagaaaaataccagtatatagaaataatggaaagccataaagcacagaaaatgaatgaactatatcaacagccatgaacaaaaataaaactctaaaacatgatgttcagtagaagcaaattttataacaatatatacaacatgatttcatttatataaagatcacctatataaactgacaaaactaaatgatagattactggcacaaatttaagtggcaaatccttaaagagaattaatacaaaattaatattgtggtaatccctcggaaagatggaggacattgcaattgcgatggagtatataaaaggcttcttagctactggtgtattttcaatttttaacttggatggcggatccatggttgttcatgttcttgttttttaaacctatagtacttattttatctatgtaggggacctgaaaagttcctagagttgagtagagcatgggacaataaaaggttctccagtagattgctgtgacagatactctatctcttggagtctatgacatggtagattcaatggaatctgaagtactgttagctaactgagacatagaagcaacccttcagcaggtatgaataaaagaaaagtgtcagtctctagggttttggaacagtgccatacccccttcagcaagtagcatctgctaagaaacaactcctggattgctaccaaatggatagagaactgactaccttgtcatgagactcagggatcatctggcctgagcttccagtcatgaactggaggttatctagttcaataaactataagattaggtattttagcattaaaaacatttgtacatagatctttatcatattctcacaccagctagaaatagactgctatggtattatagctatcattgaagatgaacccaaagggcaatgaaaaagggaaattgtcccagtggccaaaatttgagtagtatattttgttcagtttacctggaaacagaggtaacctaaagaaaagatacgatactagttctcctgaattgaaagctgagccagccacctaggcagtttgaattctacatacctataggcaaactagtaaaatggtcaatcatagtgttggctgaggtaatttatgctggttatcaaggtccgttgaaatggtttgttcatacatagcgcatgcctaaaggagtatgggaagaggtaaggaaattcctgggacaactcaagtactattttgaccaatcataaaatttaatacaatttttaaatttttaaaggcaaagaccctcagtaaactaaggttcttgaattaagaagggaagtcataagttacaactactatgaccaactagagaactgagaatgatagcctgaacctatatttctttgcttgctcctagaatgtaacactcatcttccccatacaaacaatttccctataaagtcaccattatcaaaattttaaaaacatttcttcctcttcctttatgccaaatcacaatagaataaagggaagactgctaacacggtgaaatcccgtctctatcaaaaaaaaaaaaaaaaaaaatttagccgggcgtggtggcaggcgcctgtggtcccagctactcaggagactgaggcaggagaatggcgtgaacctgggaggcggagtttgcagtgagctgagatagcgccactacactccagcctgggagacagagcgagactccgtctcaaaaagaaaaaaaaaaaaatactggacttagtgaacagcagctcaagcttgattgggatatatgtttgggtagctgtggaggatgctggagatatccttagatcattttcagaattattctcattatcaatgacagaaatccatcttgaaataacatgaaaatgggagagaaagagattgagattgattcattgattccaaaaaataagggaaaaggaaaaatttttgtagggattgacataagttgaagttttgacactgaaggactttctctttctaccatcatttctatttcttgtttttctctggaatcatggctatttccatctgtggctcacatcctataaaactaagaccaaagtggaatggatacttctgcctgggatcattttaaacatcgttctcatgccctaaaagattacctttgtgaatggtttcttccaattacataagactaagattcacttaacagtgtgtgtatagctaccaattcaagcaaatttaacaaaccaaactagttcttctctgtgtcctcctgttaaatatggattaaaaatatatacttgaaaactcaaggtacataatcaacagaatttccagtttcaagtcttaaacagagattatgagtattaactaaaagcaaagtcgttattaaaaagtaaacattaatataaaagaattttcaaattatttctggagtttttgatagcaaagatggtagcacacaaattcataatttttacttgcatatacaatacagacaatctgtagtgtcagctttttaaacaaaatactttaaaagccattttaagttataatttctaattagtagatattatctgtgttaaaagttcctttgcttatatattcagtatgaataaaacaggtttaactctggcattagtgctgtccctataaaaaaaacacacatttatgtacatacaaagatagctactaaaacaaatattaatattgagagatataaaaacatatttaataaaaataataactatttaaataccttattgtcatcatttaccattcctcatattacactattttagggatggacacagtcatttatatgttctaaaaagttatctatgccagaaattatttcatatttaaagcaatcattttaactgtgacatgactttttcatgggagcttccttagtttaaattaaaaaaacaaaatagattactttactgcttttggctttttgttgttcaattccttacccttgcccagaaacaagactacatctttgccctttgttgatattgctgctcaagctcattatcacgtgaatatctggttattgttttataaatgttcattttctagaagctcactgtttctttctttctcaacagtcgactttacactagccacactcattatcatcatgtggcagtactgctcttcctctgcctttgctgctttaaaaattaatgcactgttattttctgaatactgcataagctgcttatgagtacattatgctatcaagcaagcacatgcagaaaagcttcctaaactgttattctttcaatgaaaatacagctggttctgcttcaaaggcacatcttttcacctgcaaatggacttgctcctgcacttattcctcaattcattgtcttttatttgtgtctagaaatctttaattgcctttaattagaaaaaagtaaattcagtgctttaatcttgcaaatacattcaatcataattctgtctgggataaataccaagttctattcactgtctgatctctgtaacaaagatatataatttattgtccatttatatagaccacaccaattaagatacaatagaaaagcagagagataagagtcaaaatatttgaaaagaaaaatttgcaatctaaatttaattactcaaatgaattattggaagatgagttatttacagcatgccaaaaatactggcaaataatatttggtaatcaacaataaagacttttatatttccttcaacatttttagaataaatctcaccaaatgcttccaatccctcctcccttcgtcaaaaagcaatatactacttggaatcttacttttcttgtattacctaagttacatataaaagtaacacaatttgtcatataaagtaaatctgcagctgccatatgaacacaatgtttagttattatattgcaaactacaaatatctaaagaagactcattacaaaactaggggtcaatagtctttcgtatggaatcttgttaaaaaaactctagtaactatgtcagtaaacaaatggcctgcattttaacaccttcaagatgaataaaattacaaatgctcacaggaaaataactaggtaaaacattaaccaatcaaattgataaaatgaaaataactacaaagccagaaataatccaggagattaccatcagcataacgtacctttacatttaataaatcgtgcaaaggataacaatttccttaaagacaaaaagcaagtattacctacaaaggtaaactacgcaaaaagtaaaacttctctcaaaattatttggagatatccagaatatagagagcaggctggtaaattcatcattgaaaataaacatctcgggcaaatttttcattttaattttgttatagaaacaattcaaaccaatgataatttttcaatgcttggacataacagcttgtcatgcattaccattacagaaaacacatcatcatttaacaccacattaagtactaagaaacaagcactaagcttagagctgctaaagataaaccaagttgctcataaaatacaaattaatttccaagaaaattcatattaaaaatgctaaccaagcaaaaatttatacatggaggagaattatagttaaatagaagatgttataaataatatcaatcttgagtttgcaattagtactcaaaaaagtccacaaacatttaagaagtggttgtatccaaggtacccatggggatgtagagaagtaaaagaaagacaaacaacaaaaagaataacagggaacctaaaacgcaaaattaagaaaaattaaacaacgacatgtttcagtaagtattcaatttagttaaacatactgcttactatttcaagaaaaatgataaaatactcaaattaatgtaaacaggttaggttaaacaaagggtatataaaattgtaatcacctaagaattaggacagttgctttattgattatttaaatatttattaagtaccttctgtgaacatcattagagatgccaaaaaaaattagatggagcttctgtcttcaagactatttaaattctagtaagtacaattaaaaaaatatgtgaaagataggagaaagtaatcacatttagaagtttaaaaatccttattgtctaagttaaataaggatattaatatactttattaagtcaactatgaaaacttgagaatctcctctccctttcccaaaacaaggaaagaaaagaaaagaaaaaaaaggaatggaaaatgttgaaaatttgaagaatgaaaaaggaaacatagtcaaaaagtttcaagaaaaaaggttagagcggagattagcaaaggaaaaatcactacaaatgaaaaatataaataaaaatgtgaaaatatatcaagatttttaattcatagtaaattatatagaattaaatttgcttgcttgaaaacaaagattctccacctatattaaaaaatcaattatatcattaatttatagattaaaataaagggataagaaaaatacaagagtacttaacaaaataacaaaaagtattttaccaatattaatataaaacaaaaagaagtctaaacagacacttcataagtactttataaataaaaaggtcattatataatagaaaaggggaaattatcataaatatataccaatttacaaatgctaagcaacgaaaacatagcttcaaatatataaagcaaaaactgatagcattacaagaattgaaaactatagtcttggggtattttaattctcatttttcactaaatgacagctaaaatatataaaaagtacacaatagagttgaaaactataattaatataagtagtactgaatcctaatattagagaatacctattcctttcaagcacagggaatgttaacaaaattgactgcatactaattcagacaggaaatactaatatcaaaaactgatatcatacacaaaacactgtcggtacaagaaacaaggctaaaaatcaatttgagaaaaagtaagagtggagcttttgaatgttattaaagttaagctattattagcttaaaatagactgttaaacattttatggaagcctcatgataaccacaaagaaaaaaaactaataatagatacagaaaagataaaaaaaactaatattagattcagaagagataaatagaaagaatcaaagtatatcacaacaaaaattatcaaattgcaaagatgataccaagcgaggaagagaggaacaaaagaaatacaaaacagacaggaaacgattaacaaaaaatgacaataaaaagcccttactatcaaaaattactctaagtgcaaatatattaaactcaccaatcaaaatatatagagtgtctcaatggataaaaaaaggttcagttatatgctgtctataaaagactagctttagatttaatgacacacacaggccgaaagtaaagagatggaaaaagatattccatgcaaatcgtaacccaaaaagagcaggagtagctatacttatatctgactaagtagaatttaaaccaaaaactgttacaagagatgaagaaggtcattacataatgataaatgaattaacttaacaggaagatataatgattataaatttaaaaatacacatatatgcatatgtgtacataaataaatatacatatatacatatatatgtgtatatatgtacatacatgtatatgtatatatacatatctacatacacaagtatatatgtatatatgagtgtacatatatatgtatatgtgtgtgtagacatatatatatatatatatatgcacccaacatcaaagaatctaaatacataaaacagccatggaactgaagaaatagaaagcaataccataatagtagtcaaaaatggatagattattgagacaaaaaactcaagaaaaaaacacagatttaaacaatactacagaacaaatggacttaacaaatgtatacagaacattccaagcaaaagtaacagcatacatattcttctcaagtgtacactaacattctccaggataaatcacatgctaggtcacaaagtaagttttaacagatttaagaagactgaaattactccaagtatcttttatgagcacaatagaataaaactagaaatcaataacaaaaggaaaatgggaaattcacgaatacatgaaaagtaaacaaggaacccatgaacaatcattcagtaaaagaaatcaaatggaaaataagaaaatgttttgaaaggaatgaaaatgaaaacacaatataacaaaattaatgggatacagcaaaggtagtactgagaaaaaagtttattaacaataaacaactagatttaaaaagaaatatctcaaataacctaactttatacctcaaaaaattagaaaaagaacaaccctaagcacaaagttgccaggaaaaagcaaaatagtaaagattctggcagaaataaatgaaatagagaatagaaaaacaatgtggaaaaaatcaataaaactcatcacacacgaaatagcagacattacaactgatgccacagaaatgaaaaagatcataaggggcatttataaacaattatacaccaacaaattgaataaactagaagaaatgggtaagttcctaaaaatatgcaaccaagcaagaatgaatcaagaagaaatagaaagcctgaaaactagtaacaaatgagactgaatcaatagtcagaaacttcccaataaagaaaagcccagtactagatgacttcaattctatgaaacattaaaaaaaaatccttcttaaagtctcccaaaatatggaaaaagagggaacaccttcaaactcattttataaagctagccagcattaccttgatttgaaagccaaagacaccacaccgaagaaaactactgaccactattctcttatgaacataaaacaaaaatcctcaagaaaatattagcaaacaaaattcaacagcacataaaacagatcatatacaatgaccaagtgggatttatccctgggctataaggatggttcaacacatgaaaatcaattcatatgataaagtacattaacaaaatgaagaataaaaatcacatgatgatctcaacaaatgcagaagaagcatttaacacaaagttcaccaggaacttaaacaaatttacaagaaaaaaaccccatcaaaaagtgggcaaaggatatgaacagacacttctcaaaagaagacatttatgtggccaacaaacatatgaaaaaaagctcagcctcactggtcattagagaaatgcaaatcaaaaccacagtgagacaccatctcatgacagtcagaatggcaatcattaaaaagtcaggaaacaacacatgctggagaggatgtggagaaataggaacgcttttacactgttggtgggagtgccaattagttcaaccattgtagaagacattgtggtgattcctcaaggatctagaaccaaaaataccatttgaccaagcaattccattactgggtatatacccaaaggattataaatcattctactataaagacacatccacacttatgtttactgaagcactatttaaaatagcaaagacttggaaccaaccccaatgcccatcaatgatagactggataatgaaaatgtggcacatatacaccatggaatactatgcagccataaaaaataatgagttcatgtcctttgcagggacatggatgaagctggaaaccatctttctcagcaaactaacacaggaacagaaaaccaaacaccgcatgttctcatgcataagtgggggttgaacattgagaacatacgagcacagggaagggaacatcacacaacagggcctgtcagggggtggggtgtaagggaaaggatagcattaggagaaatacctaatatagatgacgggttgatgggtgcagcaaaccaccatgggacatgtatacctacgtaacaaacctgcacgttctgcacatgtatcctagaacttaaggtataacaaaaaataaaattcagcaccatttcatgataaaaattctcaataaattaggtatagaatgaatatctcccttctttttttctagtacttttatgtcttatatttgccttttaggtatagaatgaatgtcccccttctttttttctagtagttttatgtcttatatttgcctttaattcatttttatttcttgacattggtcttggctatgatttcttggatgtaacactaaagaacatgcaactgaagcaaaaacaaacaaaggagactaaattaaactaaaaatcttctgcatggcataaggagcaatgaacaaaataaaaaggtaatctacaaaatgggagaaaatatttgtacaccatgtacttgagaaacagttaagtcaaattatataaggaacttatattttacaatagtaaaaaagacaacttgattgaacatacctgactagaaaatggtcaaaaggtctgaatagacatttctccaaagaaaatggagaaaatgacaaacaggtacatggaaaagtcctcaacctccctaattatcagagaagtgctaatccaaccacaataagataatgtctcacacgtgttaggatgactatgttaaaaaaacgtaataaatgttagtgaggatacagaaaagacagaatccttgtatattcttagtagaaatggaaaaaaatagtatggagattcctctaaaaatcagaaatataactactatatgacccagcaatctctctcctaggtatatacccaaagaaaataaaatctccacattttagagataccatgttcactgcagcattattcacaatagccaagatatggaaacaacctaagtgtccacagacagatgacggaatcaagaaattattttatacatatataaaaatatatttcaccctttaaaaaggaggtcctgccatttgggaaaacatggatgaaattggaggacattatgctaagtgaagtaggccagacaaagaaagaaaaatactgcatgatctctcttatcttttcaatcttaaaaaacggatgtcaaatatgtagaaaaggagagtggaatggtgttagcagagttggagggaaggggaaatgcagagatgtaggtcaagggtataaagttgcaattatgtaggatgaataaactatagatctaatataccacatgagaactacagttaataatattgtattgtacactggatatttgctgagagtagattttaggactcttaccacacacagaaaaggtactatgtgagatgatgcatattttaattggtttgactgtagtaatcatttactctgtgtgtgtatagcaaaaagtgatgttgtacaccttaaatacgtactataaacattctttttttttttttgagatggagtcccactctgtcacccaggctgtagtgcagtaacatgatctctgctcactgcaagctctgcctcccgggttcccgggttcacgccattctcctggctcagcctcccaggtagctgggactacaggcgcccatcacgacgcccggctaattttttttttttttgtatttttagtagagacagggtttcaccatgttagccaggatggtctcgatctcctgaccttgtgatccacctgcctcggcctcccaaagtgctgggattactggcgttaagtcaccgcgcccggcctgtactatacaaattcttaattggctatatgtattccaaatattttttactttgtttgcatgtcttttgtttttcagaaatatattttgctttatagagcgtactttttgtgtcttatttatgaaatagatatatactatattttggtatcaattatttatatttattttctgacttctaatgtaacttctttgtttatcctttagttatttagaagtgttatttttattaatttattttgtatttccaaagcaatggtacagatggaaaaaagtgcactaaaggagagggttgggtgaagaaggggaagttacctttttgcttctaactaatttctaatttactacatttgatttaaaaatgcagttataggatattgattgtttataacttgggatactttctttgtgacttagtatgtaggtaggtaattttttagaaatactccatgtatccttgaaaagaaaatcctgcacctagagcctaatttaaaatagataagcttcctgttatcttcctgtgctaagtgagcttttctagtccaccgttctactagggtagtatctccttgagggtccaagtatatttgggagtctcaattccatctacaaatccttatttccagtcttccttaatccttctttcacatatgacctctggagaattctctttctttttttctgaactcaggtttccatataaaagaacatttgttctactttatttagcatattttacaggagaattttgaagttatcaaattattgccaataagagtcaacagaattaaaagttataatatgtatacaaaggaatgatttaatggattataaaatcaaaaatgctgattatataaaagcattcagcctaaagaataatatttattttttgttttattaaattaattaaaattataagagcactgaaaaatcgtaagtacatgaagttcatatctttactggtaagcaggactgcatttaattttgcttccataaaactctataaagtcctttttcactcacatatttctgtgtatcatatgtattagagaaaatttattttcttaatatgcataattgtgtttttatctcaattaataggagtgtatcaaagataattcattgcttaccaatttgttttctgtactgatcaacaggaagttttatagtagcagcatcttttctacccatctttgatctccaaaatgcctgctgaaaagaaaacaattataatgaaaatttttttaaaaaggagtgtctataaaatccagaaatagtttattctataaaattcatttttaaagcaatgggtacaaatactttgacttatttccattaaatattcataaagaaaacaaaattcttttaaataaattatcaatgatacaattgctggtaattaaatttctcaatcatttgtttttgataacattcatcttatcaagtactatcagtgttccattaaaccatattgttaaataacattatctgtaaatatgaaaatcatgtagtatttacttagataggttggggcttttggcatacttttggcaacatgcttatttccaagtatatatagtttggatatatacttactatgttacattaaaagtaaggctaaagtttgaatctcaagtattttgtattttattttaaaaagcataacatatacatacaaagcagatgaatttcagttctagttctgcccctcttaatgtaaacaataaaaactactaccatttattaatattttcatgcttattaccttatatgcactgttcgatttaatctacctatttttattgatatacaatagttgtacctactttgggtggatatatgtaatattttgatacctgtatacaatgagtaatgaccagttcagaataattgggatatccatcaccttatttacatgttctttgtgttgggagcaaaacaaaacttctcttctaagtatttagaaatacataataaattattgttaatcataattttcctactgtactattgaatactagaaattattccttctactctaactgtatttttgtatcccttaaccaacttctctaccctctacccacttcccatccctggctctggtagccattattctactctctacctccatgagatccactttttcagctctcacaaatgagtgagaaaaagcaatatttgtctttctgtgcctggcttatttctcttaacataatgaccttcagttccatccatgttgctgcaaatggcagcgtttcatttataaggctgaataatattccactgtgtatagagacaacatttttgctatccattcatctactgatggatgctaaggttgattccatatcttcgttattgtgaataatgctgcaataaacatgagagttcagatatgtcttccatatactgatttcctttttttggatatatacccaggagtaggatatctggatcatatggtagttctatttttagtttattgaggaacctccatattgttttccataatggtgtaccaatttacattttcacccacagtgtatgaccatttccttttttctccacatccccaccaacacttgttattttttgcctttctgatagcagccactgtaactaggatgagatgatatctcactgtgctttcaatttggatttccctaatgattagtgatgttgagaatgtttttcaaatacctgttggccatttgtatcttcttttgaaaaatgtctattcagatcttttgcccatttttaattgaattgtgttttgctattgagttgtttgagctccttatatattctgggtattaatcctttgttggatgaatattttgcaaatactttctcatattttgtaagttgtctcttcactttgttgattgttttctttgctgtgaagaagctctctagcttgatgtaatcctatgtgtctatttttgattttgttgcctgggcttttgagatcttacccccccccacaatttttgccagaccaatgtcctgtagtgttttcccaatgtttttttccagtcatttcatagttttatgtcttacatttaagtctttaatccattttgagttgatttttgtatatgatgaaagatagagaatctactttcattcttctgcatatagaaaccagttttcccaggaccatttattaaagagacaatcgtttcccacattgtaacttcatagtacttttataaaaaatgagtagactctaagtgtgtggatttagttccgggttctctgttctattctattgatctatgtgtctatttttatgccagtacccaattgtttcgttactataaatttgtagtataatttgaaatcagatagtgtgattctctggcttttttctttttgctcagaactgcttcagctattggggatcttctggggttccatgtgaattttaggattgttctttaggatttttgtggagaatgtcattggtattttgatagagattgcattaaatcagtagatcactttgggtagtagagaaattttaacaagattaattttatcatgaaggaatgttaaattttgttgaatactttttcagcatctactgaaataatcgtatggtgtttattcttgattctgctgttgtgatacatcatgtttattgatatgtgtatgttgaaccatccctgcatcactggcgtgatccaacttgatcatgatgcattatcttttgaacgtgttgctgaatttggtttgtagtgttttgttgagatttttacatctatgttcatcagcgatattaccttgtagtattccttttttttattgtgttcttgtctagttttggtatcagagtaatgccagccttgtaaaatgagtttggcagtattccctcctcttcaatgttttgaaatagttttagtagaaatgggattagttctttaactgtttggtagaagtcagcaatgaatctatcaggtcctggacttttctttgatggaagattttttattcctgcttcaaactcatgattcatttttggtctgttcaactattctgtcttgtcatgtttaatcttgataggttttatatgcccaggaatgtattcttttcttctagattttgcaatttgttggtatatagttgttcttagtagtcgctaatgatcttttgcatttctgtggtatcagttgtaatgtttcttttttgtttcccattttatttgagttttctcctttttttccttgggcaagcaaaggtttgttaattctacttatcttttcaaaaaacaactttttgttttgttgattttttttgtatttttttgtcacaattaaaatttatttctgctctataagttttatgatttttattgaatttaaatattgcagcagagagtacaacctgattaccacattcatattctccttttcttcctagcacagactctatttcctagcctcaattacaatatgtcattattcatagaatacaatgttacagtcgtaagtattcttcaaactggtgtctgcaagttgttcctcattccttctagtaaggcattacaagatgaagatgaagtcagacaagaactagtcatgtcacaagcaaaaatatagagaatagaaagtccagtaatttggggctaaaaatgttggaaaagccaacttcttctgagaaccaacaggagaaaaatgaaaacaggctttgaagaacaaagacccatgaaaacttatcagcttaaaaaaaaagaaaaaaaaaagagagagagagacaaagagcagattaggggttttcactgtctcacctgagcctattatttcagattacttcaaagcagacactattgggtagaaaaagagaagtcaaggagttctaaagcacagaaagaaagtggacatgagaattaggtctaggaaagaaattgcactgtgtttattggcacatgcaactgagtagaaatggtaagaaggttactaaaatgtgagggaactatatttactaagaaaccagaaacataatctaaaaaagtctttgaatgaaagccaacttttgggcctctacatttaaaccaatatacagcagtacccaaggaaggcaaactctatagagtttataacatccacttcacacatgactagaaaggaataaccatccagaggggagagccatgaagaatggacaaaaagaccataaactgaaacttctatttcagtatagtggatcttctcagtggtctcgtgagcagaggttttatcatcacaatggaccaatgactcctgtggctgttttccattcttccctttataaatgggaatgattattgcaggtataaagcagttatccactgcttaatcattatttcttaggggttttgtgatgctggggaggagtagaaaaatgtcacaggcaaattgagagaggactgtgtgttagcttgagatccttggcttggagctagaagcaataaatgctagatgtttaggttctctctattggggagacagaaaaaaataatgtgcatagttatttccgtgccagaaagataaattattaaaaaaactgttggctactcactaaaatacatgttctcctttttttttcctctgggtactcttgactaatttcccagcctcctttgatgttagttgtggacacatcacttattttcaaccaacagaatgtgagtaaattaatgtttcctacttctagaactgacctataaaaacgttccttgcatactcatttatctggatgaaatggagatgacctctagggtaactctgaacatgagtgatgaagatgatgacagcctggatcatgaatgactgcatggaggacagctatccaaccaacttgtttttctgtttcatattgctgtgataagaaaaaataaatttgcagcatttgcagtactatacatttttcgcatttatttgttacaatagttgtcatcactgaaactaaaacaaacaagtatagatgtttccatataaactgatgcaattatcaaactgtaatttttctaaagagctttattaaggttctaaaacactaaatgcatttgaaatctgtccagacaaaattgtattgtttatctatatatattgtcacacagatagttaacagtgatcccacccaatacagtgaaagccatctccaacttaataatttttatccatatgtgacaaagttataagttcagctaaaaacctatttttctaatcataataatcttcatattcatggtattattgcaatatctaggaatattcaaattatgacaaagtcaaataagttaaattttcatctctaataaaccatgtagttattacatctaagaaaacattttaaaattctagcaataaaatcaagacagcacctaattctatagtcttacttcttataattcaaaacattaaaaataattctgtcaagacaagcaccataaaaattgtcaatagatacattataatttattcatatagcaatcctatttgcatagtattttgcatttattaattgtaaataggaatcaagttattttaatcttaattgtgtgtggctagggaagataccactccattttaggagagaagttggattaaatgaataaacactcaagatattattcccttttcaatttagttttgttttttgcctttacagactatgcttaattttttcttaaagcaaatcactgaggctatctgccaaaatggttactcattatgcttcccccaattcctttctagtcatttaagccaacatcccagcagagataacacttcagaagtcaatactttattcattcactacctacagaaaataaaaaagtaagaggtttatcaaaaatatatttttaccaaagtagctgaattttacttatatgttaatatactttacattaaaaattatgccacggaaaaatctaaagaatctaaattttcagaggggcctatgctttatgaacagacattttataggtataataatcactgaatataaaagctataaaagaatttcaaccaagatacattagagaaaaactggtttaaaatttttgttctagttatttttagtggtttggtattatttaatcaaaatttcaaaatttaaactttctcattgtctttgaaattattatattctatacagtaagtaaaataacgttttaccaaatgataaaacaaaaaatgcttatagaacacattcttacataaattacttacattttattagctgcaagaaacacacaaaaaaatagaaagcattttgccttactaataaacacattgaggctattttaaatgacctaaagagatacctattcatctgtatgatgcaaactgtcaatgactcagacatgtagaacctttaaaatgttctgacttttctttgttcttcaaagccttgcagtaatcatcattcatttctattgctttgatggttagatagcaaactcccaagaaatccagggagacattagcacatacagccgcaatttctaataagacagctacttgcatacaagatcagccacaatttaaaatgtgttgtgatagatgcggaaagggaataacagacttatattagcatgtacaataccaagattgttttcacaatttaattccttggagattatgtctcatcaccttcttttgtaaagaacactgcattccctgaggaactaacttgctctgagacctagctaaactgaaatatggattaataagataatatttattatttatgaattttgctgtaggaatgatttcagattaaatcatcacagaagtttccaacattcttgaaacttgataacacatatttaaagaagaaaaatgctgattttatttaatacttaaattggatattaaaataattcagttaatttttatctaattaaactttacactcattaggacttttaagattaaacatagcattcttgtttttagtatgctttcttaacctgaattttccagagcaattttgcgaactgtattttaaagcataatatgtgacctttaaaaacaaaagtagtattatattcaatcaccttccgaccaagttattttattgctcatttataccttttttatgaaatccagaaagaacaagtaaagaaataagaaatctgaagccttcacatatgtctctgcttccagaaaaagcactaaatccagactgtgacatttaaatacatatcaaaacacaggttattaaaaaaagttcaacccatgtccacagaaaaaataattatcttagtttttaaggctaaaagaaatacacttactaagaaaactcttcgctaaacgtgaagctatagttaggcagaaaaggtatttggttatggctgcatcaaagttgagaaccaatcatgaaaatacaacctcatgctagatgctgaggatataataaacacagaagatatttgtccctgatcttatcacacattaaccatttccagagtattacaaatttaaagttgttcattcacttaacatatttaagtcattgaaatgatgacacatttcctagataaagcaaaaatccttaatattaagaactattaatgatctgaatttgtcatgtgttcctttctcatgttccagtgcactaggaaattcagcttttacttccttgactttgacaagctcattcgtgtttccaggaatttactatgttctgcaatttgctttaaatgtcttttcaatacatccccacttgtgaaacctatatattgtaatattgcacacaagagtcatctctgagtaatcattcagatcttgcctaacaggcatcattcatgattcagatattcagagatagttctccacacttaaggaaatgaaaaaaaaagtcttttgaaagactatcaagtgtgaagtggacaaggtatacacaattataatattaaaatgcagtattataagtaatattaattatttcaatattataagtcatattaattatttcaattaattatatgtattactcatattaatagtattatcatattgtcattgagacaagttattacactgaggaacaaattcgtactgtataaaactggagagctaaacagttgttattctaaagttttcagagatcgaagtgcccagttcacctatactttgacaaactaatgtcctttatagcctcagaaaaagtatctaaaaactgaaatatgcaaaaagatgatttctaaaatcctgatcacttgccaacattgatatgaaaatttatacaaaaagtaagtacaggacacttatctgtgtaaacctaaaaagtcatgttccagaaaagaaatcttagtcgttgggactcaccttccagccaaactacggaactaaaatacagtattaggaaatagtgctagaacaaatatatttcttcatgaaaaacaaaacaaacaaccaaaaatatttaacccctatctcatatcatacacaaaaattaattgaagatagatcatacaactgaacgaagtagctaagacaacaaagttactagggaaaatattatattcatgactttgtagaggcaaatatttattgaagaaaacatagtaggatatatcataaaagagaaaaaaaggatgaactggattacatcaaaattaatatttgcttatcaagacaccaataagaaaataggttattacagatagatagtattcataacatatgtatctgacaaaataatttgcatccagaatgcattaaaaaactatttaataatgtaaggtatacaacctaataatttaaaaaggggtcaaaaacttgaacaggaactagaaacttcagcaaataagatatataaatgacaagcacatgaaaaagttcttaacaacagtagtaatcagcaaagtgcaaattaaaattagaactgagattctactacatatctactagaatggctcaaataaaaaatatttcatatacaaaatattgaagagaatgtggagcaactgaaatttctggtacaacttctttataaaattgactgttcctacaaagttaactaccagcaatttttgcacttctattctcagatatttatgtaagagagataaatgtatatggttacaaaaatactttctacaaaaatggtcatggctgctttgttcataatagttgaaaattgggggcatggtggcgggtgcctgtggtcccagctactagggaggctgaggcaggagaatggtgtgaacccgggaggcagagcttgcagtgagccaagatcgcgccactgcactccagctggggaacagagcaagactacatccccaaaaaaaaaattggaagcagccccaatattgatcaacagaagagttgataaactgtggtttattcatacagtgtaatactaccaagccaaaaaaaaaaaatactgaacataggcaatagagataaatctcaacaatgttatgcagagaaaaagaaaccatgatgtctctgtacttaaatggtcattcatcagtgttatttgttcttgtagcatcacttgacaatggtgacctctactcccttgaaaatacttgaaaaaaatatttcctatgggctaaagaataagtgagaggtaagaaagcagaaatgaaaattacagaccaatccattataaaataaatacaaggaaggagacagatagcatagtaagtagaaaggaactgaggttgaggaagagattttttttgttatactttgtttttactctttagggcttgtttctgattaaagatgaaaatttgagttggtctaaataataattgggaggaacaaccagaaagtgagagggtgaaaatacagaaaaaaaaagtatgaaagcatagaatccagtattcatttcaagtaataatcatagcacactacgtccatgagtcactttaacaagaaaaagagaaaataacaggcaaaattatacataagacttgaggtctggtaaccaaaagtagagggatatctatgcagtagctctgttttcactatgaagtaaaaggcaagattatctccttatgagagaaaggaaaggtgggaagtttggaggtttgcaagtgcagagctggaattaatgctgtggaggaatggaaagagttgtctaaagaaaacaggattaactgggtgcagtcacttgtgcctgtaataccagctactctggaagctgaagtgggaagatctcttgagcccaggagtttaagactgcagtgagctctgatcatgccactgcactccagcttgggcaacagacttgaggcctcatctctaaaaagtataaaaataaaaaatgaaaacaggatttatgggcaacaccaagagaccaaaaaaaattgtaacctattacaaaaaaaatgaatctattatagcactggactatctgattgcaaataatatttttctttctgagtgcttagctacctagtgctgacatagggaagggtagtctactagagtaagtaaaatttaagttttcccagataggcatgacagaaaactttaggatactataaaaagtgggtgacttgatgttctacggtatctaaaggtagaaaaggaagtgaagacagtagtggtttagagttaagcagaaagtggaacaatctttggacttaataaagttaaataaccaaatttgaaagtaaaaaaaaaacaaataacaaaatttgggagtaaaaaaataaccaaaaaccaaatactaggagtgaaagttattttactagagaagaaaggttattaaaggtcactagtcagtgtgagtgtaaggcgattaatattattattgagatggagtaagttttggtccagaaggactgaagtggtaggaaaacattatggcagatatgttaaggaactgaaagaccaggataatgcatatgtcatacatgtgaatcatgagggtacccaggatagtagcaggatttgggtgaggacacaaagaaagactcagttagaaagactgagaagggacctggatgtccatagataaacagcaaaagagagaggtagaggacactacagtcaaatggaatgaatcactaaggagctgggcttcttgtttgatttgtcttgtttgcttttatgtgcaggaaatgtaaatgttctggaagtggcaataaaaaaataaaatgataaaaatcaacctcttgattcacaggtatgtgaacaatggaagaatagtttccatttaagatggcttcaggaaagtggtgcttgtaagaagaatcaagttccaattaatgtcaagaggtaaaattaataaagcgtttgggattaactgggttcaagggggatataaaaagatagagagggaaggaaatagcaggagactagtccatgaaaaaccaaagataatacagaataatatgggcataagtgtttagtggaggacctataaccaaatgggtcaggtagggcagtgagaaaagttaacaggaatgtgtagtatcttgaactacctttatctcaaaactgcaatgagtactcaggcctctccaggagtcagctgtagccttggtaaatggaggagtccccatccctccaggaaaggtcagctggctagaattcagcaccacagaagaaagcctcagatctcaagagtctagttagtaccacctattcattgggagcaactggagggtccagatcagtatttgtcaaagtatggtccataatcaccattagagttgtctgggatactcatgaaaatgcatattcctgggccccatcacagtcctactcaatcagaatcttaggggctaaagtatatggatctccagttttgttttgtttttaaatttcccatgtgattactgccaacattaaagtttgagaaccattgattatctttttaacaaggtcacaggcaattcttttgcatattagcatttgagaaacacagctggaagtagatgggaggcctgagcagggactgtgaagcccttcagcctctctggtggaccagcaaggcctggttggggtggcatgatcaaattgtggacgtttctaatgatcccctgaaactttagactttttctgaattcagtaggaaaacataaaaggatttagtgcagtgaggtaaccaaatcagatactttttaataagattagaaagactaggaggtttgaagttaactaagtaggctagaaaaatgcagctaagttccaaaagtaatctaccaagtgataaatcaatgcaacaagtagaaaggaagttctatttggtgttttactttttagaatataggaacagcttggatgggggcaatgaggcagaggaaaaactgaagatgacaatgtttttcaattttagtgatagttagctaaaatacaaagtccaggcctcacccttcaaaaatacccagtcaataatgttggggagtggctaaggaagcagcattttgaataagcacttactccctgccagttttcaaattcaggtggctagtggaccatacttggcaaatattgcgttagacagatggtaatgtcattaacaaaaacaggtaatctagaagtaggtatggggtggctgacgagggtggaggagcattagaaatctacattacaaaatgtttaaaacaagaaataagaaaacaaagcacttgtttttcccaaaacctaatagaattaattaatctaaacataattatgtcacaaataacccagcccccaccaaaaaatacccacaaatattttacttacttttattttaatgcttttttaatgcacagattgttgtggcatctggacacatgacacacttgaaaacaacacattaaatttatactgcctggaatagacaaaaagctgccttgtaagcatcatcaacaatgctcatcattgggggaggggtgtgctgcattagctgggtcccatggaattatatttttaaattctaaacttttcacaaatataaaagggataggcatttcaaatctgaaaggccacatgagggagataacttctattaaatagcaattttttcaagtacgaaaatgattgttatgattcaccagggtttgacttcaacagtatgggaaatgtacttgagttaatcttctggattatatttgtaaaagaagataggttagttaagctaggattggtctataatgtaactcttagtagtcaaactaaaaagtaattaatcgcataaattacactatcctttaaataaagatttttttatgaaaactgctctttctaaaagttttaaaaactttctaaaagttgtgcacatgtaccctagaacttacagtataataaaaaataaaaataaataaataaataaattttaaaaagattacaataggctgggcacagtggcttacacctgtaatcccagcactttgggaggccaaggcgggcagatcaccagaggtcgggagtttgatatcagcctggctaacatggtgaaacacccccccacccacgtctctactaaatatacaaaaaattaactggtcttggtggtgcatgcttgtaattccagtcactcaggaggctgaggcaggagaatcgcttgaacccgggaggtggaggttgcagtgagccggaattgagccactgagctccagcctaggcaacaaagcgagactaggtctccaaaaaaaaaaaaaaaaaaaaaaaaagattacaataatatgataccaaacaaatgaaactgcagaccctgttttcaggattacaaagtgctaatacaagaagaaacacatatccaaacatgtaaaaagaacaaacatctacaattatgatgtaaagccagtaagggaggcagcttgtaccactgcacgctaagagcttaatcaaacaaaaggaatgagaagaagcaagggtaccattagcttcagggattctgaggttcacaaagggcagtttcatatccacttgactattacccgacaaaccttcagactgcttttcctgatgagacaaagagtaattgaaaacggggttatgatctaaagatcacaaactttgagttttcaatgcttacaatccctctaaattggattattttaagaaaattaaataaaactcaagattgtttgaattatcacaggaataaaaaaactttatttcatccagctggtaccaaaaactgggctaaaaaatgaaggaaaacaataagctctagaggtaaacatctcagatggtatatacttttatctctgtaattcctgactaaatggatgtaatttcttttatcataattcctctatatgaatggccttttcttggctctaatggaatattagtgaattcttatgactcagaattttcaataaatttttctgaaacaaaaatttactagcaaaaaagacactgcctttatgtttagcccaaatgttaattgcatttgactaagaatttctgagtaatacatctgtgttcagtgtaaacaaaatgttctgatacactttaagtcttatcaaaatcactactaataaccaagtttgttttatccaatgttaaaatttttatttttcttaatttatatgcattttacattgaaacaaaacgtgaaccaagttgccaaaatttggtagttttaggataaaactactattaataagtttgggaagtctactgaaaaccttttctgagtctctacatgcatgtgctctgtcaatctaagagggggcttacataagtcacattacccaatattacttgcccgatttctcaaacaatgcacattatcatcccaagaagcatctgtttcatgtaaagtttgggaaatagaggcctagattattggaaagctaattaaaatggatcataacagaacaaaataagcattttggttaacgaataaaagatatcaagaactggctaagagacatgcttatcaatcatttccccagcttgtgataaaggaatatcctgtcatcagagacctataataggatgaccatataacttaccatccaagccagaacacttttgagagtcaaagagggccccattcattacagcaagataaacttaaaccaggaccatccaggacagcccttgccccaactatgaagcacacaaggacagtttaccatacaccatagctcagttagttttatcacccataaggtgttgcggtaccaggaaagaatggcaagtcttcttttaaaatactgcatttcagaaaacagattaatattttaggcaatacctgaaacagatatgagaatatcacaatagtaggttatgctgagatagactgtccttatttacaaaatcatcctctggcacatggcactactgaatactctgtcgtcaaacttcaagccgtcagcttccaagtcagcactttcctgattctccttctacatttcaatttcttctttacctctttcattagcattcttcctctaggtgcctatgaaactatggcgtttgtgttcccgtgttccccataattcattcactttatatattacgccctccttgggtacctcattccctcaaatatattccaaggtcctatataactacccctaacttcttcaatcatacatctagcatcattctaacaaagcataatcaatgtgaatttcttatttttcctttaactagcaagtttctcctgttttctaccttttttgtttgttttaactaaactgaccaatacagtgttctcattgcatgctatcctcttttgacagtgttaacttggatcacttgattaaggtggtacctgcctaatttctccactgagagagaatttagtcttttcccctttgtaattaataagtatttggtgtggaggtgctttgaaactatgtaaatatcctattcatcaaatttaccactacttggttagcatttattgatgtttctcggttgaattaattatattctgacaggtgccatgtgatgattttataatttcctcatttcttccatatttattcgttagtatcctactttattaaaaagcatttccttctctccatttatttattcatatatgcgtttatagcagtatgtactcatagatatttttattcaattagttagaattaatgtatatcatttttaaaattttgattcccaaattgtcctggatttggccagtgaaagttccttcaaggtggtttgtgtccttttggcatatcaccttttttaagaacctctttattttctgacacacagatatttacggtttagcgtgtgttttccctgctcctgccctgggacctgccatttctctaagggcccacttcccctttagtagagaatgttttttagaaagcaagatctggggacaagatatgctcatttctaataaactgatactgttcacaggccttctaaggagagagagctaggaaatatatgtattggtgtgagctcagtacttccaatttccaatccaacatcacacagctctcattctactacgccctttccacatttatattcatagctttcctctctaacattaggaaacctgtcagacattattatcaatgaaagttttcatgtttaattttttgtataatattttacaaaacaattaatacctaatatttctaaaatttgtgagtcacctatgaaacaaaggataagaaccgatttgaattaaatctacagaataaataacctgtgctcatatagaccaacttggtgataatggtaatatcaaatattaaataccccatagaggtctatcaccttattttacaccttatagacatatgctccacgctatggcaaggaaaatgagactgtgcttaaaccaaccacacctactgctgaagctggccatggggtctgtttctcctaaacatatgactgtctgcaaaatgggtagataaaagaataaaaccagtgttctttgaagataaggcataaagattctagatagaaaactaaaagcatcagtcctatgtgtagccacatactgtatgtttacatgggtatttatacatttaaaaatatagcttgtctatatcagattgctaacattcaagatatatattgtgaaatcatgtttctgtatattgattcatcacttaatctaaggtttaaacacaatgattctcacacttctgactataaagtacacagataacatatcactcactgaatctccttgatctattttagcggcaagcatcacttatgctaatttttagtcatttctatgtgtattatcaatttcaagtaattaggtttccaaattcaacaaaaaaatccttaagtgactagggaaagtcactcagttccacacagagagagcaggagagaaagtgtgaaagaaataaaaacctctattatttttgtaatggtggctatttcaatggtgaactgaaaaagcaagttctagtttggtacatggatagtttccaaaagacgttcaatgattatcccttgactaaataaagaatagtagggaaatgtaccagacaagaaggcataaaaccttagccacatcttttcaatgaaagactagatgacattgacaaagtcaatcagtttcccttcttacacaattgctaaactctcttccagtttaaaaaacatagaatacataagcatatgtatcaggctaagggtaattattttcatgccgagaaacacatccttaaatattaagacagaactaacaataagtacataacttttaagcatatatatcttaaaactaatggaaattatgtgtactgaaataagcttaagtatataagaggaaacaaagagctcaagacaacaataacaaggccctttatggaaattttgcttccaatgtaatagcttcaaaatgctgtatgacttatttaaaagagctttattagtaattaaatgtcaaaagtataaaaacaactggtctatatccaatttcatagaagttgtactaaacgcattcattatatcgaagtcccaggtgattatagcattagcactttgttagtatttgcagactgctagttttcaaacagattgtggtattataacatgtatttatcagctatgatgcaaattatgcttttaaaataccaccgaatttttccactagagaaatacaataaagatttttgagcttaaaaaattgagaaaacaacatggaaaaaggttaatggaaataagcactaggctattagctaatataactctactatgtagaaacaaataaataagtaaaaatagatggaatagtacaatacgaaaaagcataagtagatttcctgttacaatggattgatggagaaaagaatttcccaagttaaactgtaatacaaacaaaaaaccagaagttctactttgtgccagctttttatcttccatctcctattccctaattcccactctatcaaatctgtaatgcctttcataaggtatttcatttaaaaagatgtcaaagttctgcttgatagttaattgtcggcctttttaagagtattcagtctcacaaaaaataacaaagaaaagctagcaaatgaaaatacgaaaaatatacttttgaataaactgttcaagataataaaagattccaacttgatcaatgttgtgaactacaaatattaaaacacttcaacagcaaatgtttagaaattattgctaaaataaaataatcagggttttggttaaaagcgtgttcattctgtgaaaattcaccgtctacatattctgttttgtgcacgttcctttatgtacagtattatgcatcaacagaaagttttgaaaaattagtaatgtagctaaagtgataagtaagcacaaattagaaaagacaaaagattgaaaaataatgaaccaaaaaggaaataatagaaaaagaataaagcccttcaaattacaaaaagtcataaactaaaagcaataaataattaaatttaaaaaacagagtcaaaagggatgatcaacatagacaaaaactgagcctttgaaaaataataacatggaacaaactcttgtcctgacggaataagaaaaaaatacacaaacagtattagatatttaaaaaaagactcaatattcagcagagattaacattatataacaagaagattctattaaaaatgccatatcaataaatttaaaaattaaaacacatttcttaaaaaacagacttaccaatagcagctgaagaaggtagagatcaaatagaataaaattcagtggaactataattttttaagtcaatcaatgtttaaaaatctacccttaaaaaataagacatacacacacaaaacaggtaagattaaatggtcaacaaggaagttttattaaccattcaaggaacacataatccctacaacaagctttatcaggtatataaaatattaaactattttgaagcctaaaaattggcacacttctcaactcatttcataaggctaatagaatcttgaaatgagaacaaggcaagatcattatgagaatgaaaaattacaagccaatcttatttatgaacaaagatacaaaaatcctaaacataatattagacaaccaaatccagtatgtataatcataatgataaaatattccatgatgaagctgggctaatcacaaaaatgaaagggcaatttaacattagatattatcttagtagtattcttgttaactgattaaaggaggaaaatactgacagacctcaatcaatacagaaaaataaaagttacattcaatacccattcattattacagggggagagagaaggaagaaagatagaggatgaacagagggaggcaggaaggagaaagcaaggaatttagtatatagaaatagaaaagaactttttaccctgttgatacataggcaaacaaacaaagcaaagattatcctaaatagagaaaaattaaaagttctcttttaaaaatcataagcaagacaaagacattgcagtgagacatccagatagcacagtaagacaaaaggggaaagagcataggggattggaaaggaaaaagaaaacattatgattcacaaataatatgactcccaggtggcaaagtggagagaaactacagacaaatatttgaatctgtatgaaattatttgtaagagctcagccaggttatgatatataaagtttatatataaaattctaatttagtatagcaacaaaatctataaagcagctataaatactatggaatacctctaaaagtatatgcatgactacttattgaactgttataggagctcagattattacaataagttaagaagagtaattaataaaatatttgagggagcaatgtggcaatacccagtaaaattaaagattatgtacctacaagaaccattaatcaactgctagttatatgaactagggaaacaattctatatgtgcacaaaaacactagtaagtacactcactgaaaatgtttttaataacagcaaaaaaggaaaataaaactctgtatgtctacataatttattcataagtgaaatataaagcagttaaaatgtgtgaacaaagacacatgtatttatacacttacaaaacaacttaaaacatgaaaaatcaatagtcaatattatttagggaaaaatatacctataccaacacacacacacacatgcacccaaatgataaacgccaaattctgtggttatatagcaggaatgaggaagtacaattaagatcgcttgcacagggttatttatttaatcagatttcttgacagtatattgctgggtcttgcttgttttacccagttgaaaacatgtgttttaaatgtacaattaagatcattttatttaatgtaattaaatatgtttgcatttatatccctcatcctacaatttattttctatttgtcccatctgctgttacctcatcttctttgttttttttttttacttgcttctttgggattaattgagcattttttagtattttattccatcttcacttttattagtcattcctctgttttacatttttagcagttactagaatttataatacatattatgtaacctttcataatctatcttcaaataatattatactactctacatattatataagatcttgcaaaagtaaacttccaatctcaaccctctatcctttgggatattattgtcatatgtttcacatctatgtttttatcaatataaaccattgataatatttttgcagtaaagagtcaacatatctttttcaaaaccttaaaaatgataaaaatgccttttgtatttacctacatatttactatttccaatactctttgttccttgtgtgatgtttcattttccttttttctgaagaattccattaacattacttgcagtgcaagtctttgggcaacaaattctctcagcttttgtttagagacaaaaacttttattttgtctttaatttttgaagaatatttttcttcaaatagaattctagggttctagggtcacaactattcttacagtacttgaaagctaacactcctttgtctaccaactgggatagttttgtggaacagtcttcaaacttatctttaggtttacctttttatattttaaaatttttaattgagatatatatatatattcgaggtgtacaacatgattggatatatgtatacaatttgtaatgattattacaatcaaattaactaacacatccatcaccaaccattttaaatttgtctttagtttatattcctcacccatacttgctacttttaatgatttttgcattattgttttcaccaatttaattttgatgtgctttggtgtctgtgtgtctactattatactggtcagacttctctgagcttcttagatgtatcgttttgtaattttcatcaaatttggaaaaacttctgacatgatttcttgaaatactttttatttcttcccctgcccctgccactattctgagactacatctacacatatatgagaccatgtattgtctcataactaaccgaggcactgttgatttttgttgggaggggcaattattcactctgcctttcattttggatcaatgttactgcaatatcttcaagcacactgaacttgtcttctgcagtgtcctatctgctgttaataccataaagtgaaagttgtgactcaaaaattatacttttcaccactagaagttcctttgattctttctaatatcttctatattcctcttatgttaaggtttttctttaaatatttaaaaatataataactgattacattttttgctggtagttccaccaaatctatcatttatagatctatttctattgactgtttttctcttggttataaatcacactttcctgctctgtggcatgactagtaatttttaccagataatggaactgcaattgttacattgtttaatgtctaaatgttattttactcttttaaaacaattggggctttttgttgagaggagaaagagagttaaaatcagtatggtcaggttttacttaagttttttctaggttgcatctaagcaacctttaatctaggtatagatcagcctacttctaaaacattatccccagtggggtctcaactaaatgccctggttgattatgaagacgtgccattctgagtggtccaaaccttaatatctccccactctgtgtgagctcacagaattgttttatttgtgaatttgagagaagcaaaggggatagaatggcttgacccagcagggtaaacagcagctccacacagccaaaatgcctacccaatgactccataaggcaggaagactcccagcttcatggatgtcagagacatgaagggatatcagagaaggaaagaagccacactggctttgcccaggaaggtaagcaatggctccacacaaccaaaaagctcaccctacaacctccccaggcaaagagatgtcctcctccacagatctcagagaagcaaaggggctatacctatttgacctgggaaggcaagcagtgtggctcaacacagccaacaaacccaccctacaaccctactcaggcagggagattcccacctctatgcatttgggagaaatgtaggcactagtcctgcttgatccgagaggtcaaacagccactcaattcagcctaatgcccatcccagggtaccatacccagagggaagcaaaccctcatcatgcattcctaaggagcatagcctcaggtcccacctgtccagagcagcaactccacctaaccttgcagcctgcacccttgcccaaccacagatcccaaatagcagaattacccagccaaggaatatgtcttatatctgggctgaccagaagccactgcagtacccagccagcagctccacctaataggagagcccagtcagtggtctcaccagtcagcagaacccagagagtagcattatctgacatcacagcgaaggtagtggcccagccaactagagaatacataaattctcttcagggtcatcaccagctgacccttcatgaatcacaggctagacaaaataatgaaattctatccatgtcaaagaactcctgtaaatgtgagaagccagggctgtcttctcaaatgtacagacctatcaataatcaccttaaatgtaaatggattaaattctccaattaaaagacttagagttgctgaatagatttaataaaaaaaaaaaaaaaaagacccaactgtatatactgtctgcaagagaatcacttcactgtcagggacacaaacaaactgatagtgaagtaacacaaaaagatattgcatgcaaatggaaagcaaatgagagtggagtagctatacttatatcaaataaaatagactttaaattttaaaaccataaaagagacaaagaaggtcattatataataataaatggacttgtccagcaaaaggatttaatgtttgtaaatatatatgcacccaacattggagcacccaaataaataaagcaaatattagtagatataaagagagaaattgactccaacacaataatagcacaggacttcaacacaccacttacagtaatggacagatcatgcagacagagaactaataaagaaacattgaatttaggctgcactctaggccaaaagaacctaacagatgtttacagaatattacaaccaactgctgaagaatatacattctactcaactgaacatggaacatttcccaggatagatcatatgttagatcacaaaactagtcttaataaatttaagaaaactaaaataatatcaagtatctttctgaccacaatggtataaaactagaaatcaataacaagaagaactttagaaactttacaaatacatagaaattgaacaacatccttctgaaaaatgaatgggttaatgaagaaattaaaagggaaatttatttattatttatttatttattttgaggcagagtctcattctgtcacccaggctgaagtccagtggcgtgatcttggctcacttcaacctccgcctcctgggttcaagcaattctcctgcctcagcctcctaagtagctgagatgacaggtgcctgccaccatacccagctaatttttgtattttagtggagtatttattttgtattttagcctccctgttggccaggctggtcttgaacttctgacctcaggtgatctgcccaccttggcctcccaaagctctgggattacaagcatgagccactgcacccagccaaaagggaaatttaaaaatttcttaagacaaataaaaacacatcaaaacctatgagatacagcaaaagcagttctaagaaataagtttagagcaataaatgccagcatcaaaaaagaagatctcaaataaacaacataacattgcacctcaaggaactagaaaaatgaagaaatgaaacttataatcaatagaaagaaggaaataaaaatcagagcagaaataaataaaacagaaactaaaaaaatacaaaaagtcaacaaatgaagagttagttgttttttgcaaagagaaacaaaattaacaaactcttagccaaactacatttttaaaaaagagaaaagactcaaataaattaatgatggaaaagaaggcattgcactgaaatcacaaaaatgcaaaaggtcacaagagataattatgaacaagtgtatgacaacaaattggataatgtagaagaaatggataaactagaaacatgcaacctaccaagattgaatcatgaagaaatagaaaatctgaacagaacaataataactaaccagcttaaattagtaatagagtctctcatcagtgaaaatcccagggcatgatagcttccctgttgaattctacaaacatttaataaagaacgaacactaattttactaaaattattccaaataattgaagaggagggaatacttccaaactcattctatgaggccgtaattactctgataatgcaatcagacaaggatggaacaaaaaaagaaaactactctgatggttatagatgcaaaaatcctcaacaaaatactaggaagagcccatatcattaattctgatcaagtgagattcaccccaggatgcaaggatggttcaacgtatgcaaatcaataaatattatacatcacattaacagaatgaatgacaaaatccacatgatcttttcagcagatgcagaaaaaacatttgacaaaattcaacatcccctcatgataaaaactctcaacaaattagatatagaaggtacgcacctcaacacaatcaaggccatatgtgacaaacccacagctaatatactgaatgtggaaaagttgaaagctttcctctaagatctggagcaagacaaggatgctcacttttaccacttctgttcaacatagtattggaagtcctagccagagaaattgggcaagagaaagaattaaaaggcctccaagttggaaaggaagaatttaaattgtgcccgtttgcagatgtcattatcttacatggagaaaatactaaagattccactagagctgcaggatttgaattcaacatacaaaagtcagtagtatttcttctttgttttagacagagtatagctctgttgcccatgctggagttcagtggcaaaatcttggttcactacaacctctgcctcaggggtttgagcagttctcctgcctcagcctctcaagtagctgggactaaaggtgcctgccaccacgcctggctaattttttgtattttagtaaagacagagtttcgccatgttgctcagtctggttgaactcctgaggtcaggcaatctgcctgcctcagccttccaaagtgctaggattacaagcataagccactacgcttggctgacaaaaatcagtggtatttatatatactaaaagcaaactatctaaaaatgaaataaggacaacaatcctatttacaatagctaaaaaaaaaaaaatgggacacttagtaataaatttaaccaaggaggtgaaaactctccgcagtgaaaactatttttaaaaactgattaaaaaattgaagacatacataaatggaaaagcattccatgtttatgaattggaagaatcactattgtaaaaatgtctgttttactcaaaatcatctacagattcaatgcaattcctgtcaaaatcccgaagacatccttcatacaagtggaaaaaaactatcttaaaattcatatggacccagaaaacaccctgaatagccaaagcaattttgagcaaaaaagaacaaagctagaggcatcacattacctgactttcaaatatactatgaagctacaataaccaaaacagcatggcattggcataaaaacagacacacagacaatgaaacagaatagtgaacccaaaaataaatccatacacttacagccaactgatgttcaacaaaggtgccaagaacacagaatagaaaaagaacagtctcttcaataaatggttctgggaaaagtggacatccacatacagaagaatgaagctagattcctgtctcttgctatatacaaaaattaaacaaaatgaattaaaggcttaaatataagacctgaaacaataaaactgctaggagaaatgctaggagaaaacagggaaaacaccatattggacacacattggattgagcaaggatttttttgggtaagatcccaaaagcacaggcaacaaaagcaaaaaatagacgaatgggattctgctagaagctttttagaagaggaaaaagcagaggaaacaagcaatagagtaaagagagaatctacagaatggaagaaaatatttgtaaactatgcatctgttaatatccagattatattaggactatatatccagactatattaggaagtcgatcaactcaatacaaaaaaaaccccaaataatctcattttgaaaatgtgcaaaagacctgaatagacatttctcaaaggaagacatacaaatggccaacagttatattaaaatatcattaatcattaggaaaatgcaaatcaaaacaacaagacagcaccttacacctgttaaaatggcaattatcaaaaagataattaaaaagtagcaaatggtttgcatgtggagaaaaggaaaactcttacacactgtcgtgggaatgtaaattagtacagccattatggaagagagtatgaaggttactcaaaaaaaaaaaaaaaatagaactactatatgacccagcaatcctactgttggatatatattcaaaaacaaataaaatcagtttgtcaaagaggtatcagcacttcaatgtttataacagtactattcacaatagccaagagatgaaatcaacctaagtctgtataaacgaataagtggataaataaaatgaagcatatatatggaatgaaatactatccagccataaaaaagaatgaaatcctggcactcatggcaacatagataaatcttgaggacactatgttatgagaaataagccaggcacaggaagacagctacagcatgatctcacttacatgtggaatctaaagaagttgacgtcataaaagtagaaggcagaacggtggtcaacagaggctagcaagggaaaaggaggagggtacaggtaaattttggttaacagtacacagttacagttagaaggaataaattctggtgttctattgtagattaggataactaaggttaacaaatatggtattgtatattttaaaataggagaattttgaatgttctcaccacaaagaaatgataaatatataaggtgatggatatgccggctaaatgccctgatttgattttgcacaatgtatatacgtattaaaacatcttactgtaccctataaatatgtatatttattatatcttaataaaacaaagttaataaaaaaattaaatagataatgagtgctgactgtggtgtaggtactgtcaaaggcatatttacatatgataaataatttttaaagaagctggccagatgcaatcattacccattatcctatgttgggcccaatttatgtatctcacccaattcactacatactggactttcagtcacttgcccaatggacagcactggccattaccttcaactcattttccagtaccactgattgacgttgcttcccctgtagtgaagatgaaggcacagccctatcaccactttcacagctacagcaatatctacaccctgacacatggaagctcagttcctcctgccacctccagattccagtgaagccacaaagcatacggtgtaggatctaacttccccaacaattgcctactggggtcaggggatataatctgaaagtatagggacagtaacataccataaggtgagctttgaccaatgtgaaatgagagataggaagatgttggcagataaattatttttcttcctcaatctaactgacttgtcctgtacagcctgtctgtagatgcttcacatgactaagcaacagtctgtgtttgctcgtgcagctgtggacagcttagtgaccaacttacatttgttttttcctccttatgtaccatataggtatgtatatagatacatatttgttcaaagattatatgcatgtgcaggcatggatattcattctagttttagcatttgccccaagaggtagctatatgtattaaatttaggatataaaatacagttaattatcaattaagttattttaaaaagtactaaaacatgtccagaaaaaagcagcatttctaattaaaaatagaagcaaagaatagaatataaaaagaaaaatatatatcttaacttaaataatataattaagaactaaaaataaagttactttcccagtgaaaatatgctctgggcagaaaaaaaaatgactaaaatatcaaaacggaaaattagaaagtggtctatttaataataacaaaggctaagccttaatgaaagtctactacatttcctaggatactttgatgatatacagaaaataatgagtaaattatttctcaagtgtgatatatctaggaaatagatcagtgaaacaaaaagagtaatatcacagcatacaaacagaaaattcacatatagatggaaaaaatcacagtttacattgcattcatgtttaaaatcaaacatcactttttcacattttgaagatctccccccctaaatatggaaagaaaaacaagccagagctttaatataatatttttttccaacctggaacagctgcaaaaaacaaatcttgctggagataagcttggttataaatatcaacattccctttaaataagggagtccagttttcataccatctgcctctttcttaaagggaaaaagtatgaaactcataaaccaggacattccctttcaaataaggcatttaaaaatgaatgtaataaaaaggcgatgaactactctgaacccctgtctttaaaattgccctatttagctcagatcagaaaatgagatttttttgaaagcaaacaacttttattcaatgaataaactgcctaaagcaattaatatttttaagtgttgttttctaattttttcacattactagccataataataatctctgattgaaccatatttctcctttatgtgtcatactccctaccatttattttttattttttattttattttacttttttttttttttctgagatggagtctcgctctgtcgcccaggctggagtgcagtggtgcaatctcggctcactgcgagctccgcctgctgggttcacgccattctcctgcctcagcctcagagtagctgggaccgcaggcgcctgccaccacgcctggctaattttttgtttttgtatttttagtagagatggggtttcaccgtgttagccaggatggtgtcgatctcctgacctcgtgatccgcccgccttggcctcccaaagtgctgggattacaggcgtgagccactgcgcctggctcatttattttttaactacgtgtgtcacctctactttttctaaaaggtttttagagcctattctaaagacctccatgttatctctaacagtacaaaaatctagttattaagagactggacttttcttttaatacagattctatcctctgcaaaaatccttcctatgcctctctcaacagtgtttatatatatatatatacactcaagtttggactttatcttaaagccttctttcgtggccgggcgcggtggctcacgcctgtaatcccagcagtttgggaggctgaggtgagtggatcacctgaggtcgggagttcgagaccaacctggccaatatggtgaaaccctgtctctactaaaaatacaaaaaattagctaggcatggtggtggactcctgtaatcccagctactcgggaggctgaggcaggagaatcacttgaacgcaggaggcggaggttgcagtgagccgagattgcgccattgcattctagcccgggcaataagagtgaaactccgcctcaggaaaaaaaaaaaaaaaaaaaaaaaagccttcatttttcttttgcccttcactatttttcattctttaatccttgtgattgaacatttaattttttcactgtaccacaccattactatttcaataatgaagcccataaactacatccattacttaattctttaaaatattcacaagaaagcattaatacaagatggtttaccaaatagagcagtccagagggttatactggttgcatctaacgtaaaggaatattaagtatagtaacactgagatgacttgagggacggtagaagaaaactaagacaggaaaaaaatggcatcttctattttaaaaatatatatgtttagtcaattccttgaattacaatgataggattctgaaaggcaactgaaacaaatgcacatagggagccctgacataattaattctccttttcatattcattctctcccttattctttttctcacacacataaaaacacacccatatactgcaaacaaaaagaacaaaactgaatttttaatcatgagcatttgtagtaaaggcacaaagattatgcttacatttgtccttcataggaaaaatacatcctaggaccattttgtattttttaattcacttttattctgttttagctatggaccacctaggtctgtaattatagaaaacaaagttgctctacaaatggcaaatgacatttaattgcttacttggaatgctgcatcttcagtaaagaggaaggagacagagaaatttcgccacagtaatggttaacaacatttaatctctaagtatttaaaacaaatgatcattttacagcaatcaatatttcttccttttcatgattaatgtagatattatgaaatgaaatgaacaatgagattatcatttcattgcaacaatgaattcattgcaacaatatgattatcaatatcatatcattgcaacaggaaagttgttttaccttatacctatcagctagtttaaaatatttaaaaggttttttcttattaaatttagtccactgtttatttcctcacttccctgagcaagaatgcagggatctttgttttgtacactgaagaatctcaaacaataaggacaatgtctgcacatagtatatactcaatagacatttttgagtaactattctccaaaagacaattatgttaatttgaaacttacgtatttgatgtttaattattgtaaacttaattgaaaatgctttgagttttcaaaaataagcaattgtcaagtttagcccaatgctgcctccttatatattctaaatgtgacctaatggtttctctgtgcacagtaaactgtaacctttccatgtgtaaacagactgcaaccgacttttgtgccaatcactgagttttggccaaaggtggccaactgttcaaaccaggctcaaatgaggcaaacaccaagctgtaaccaatctggctgtttctgtacctaatttctgttttctgttacataactttcctttttctgtccataaatcttccaccacatggttatgctaatctctctctgagcctattctggcctgggaggcttcctgattagagaattattctttgctcaattaaacttgttaaatttaatttgtctaagttttttcttttaatgctatattttatgagaatctgagcctgataaagggtaggttaattcttccctacttgtttcctttctgattttgatcctttttggtgattaactaagataggcttattttccattttcaaaataggtacagtaagaatacctatctcacatggctatgttgtaatggttaaattaaatagttaatttatattaagtgcttctcacatagtaagtgctcaataaatgttatcatcatcattacatcatgctgatgtaaccaattactattgaggcagtatgcagtcaaggaagaaaaagaaagaaagaaggaaggaaggaaggaaggaaggaaggaaagggaaggaaagaaagaaagagatggaaagaaagaaagaaaagagaaaggaagggagggagggaggaaggaaggaagaaaggaaggaaagggaaggaaagaaagagaaggaaagaaagaaagaaagaaagaaagaaaagagaaaggaagggagggagggagggaggaaggaaggaagaaaggaaggaaagggaaggaaagaaagagaaggaaagaaagaaaaagaaagaaagaaagaaagaaagaaagaaagaaagaaagaaagaaagaaagaaagaaagggagagaaaagaaaagagaaaggaagggagggagggagggaggaaggaaggaaagaaagaaaaaagaaaaaaatataaacttgatctcacattcgtttttgagctccatttatttaagattcttaggatataagaatgctctcagaatatactaagcctataacaacttaattacatatacgatgtacaatatctggtattatttgatcttttaaatatcttctatcatcagctaagtggcttctacaaaagtatctttggataacttttaaaatgccaaattatgtatgctatcttattgttcacacatgtttgaaactctggattagtagagtaacagttacatttagaaagtaagttttttatatacactagtttctcttgaggagagacctttttaagaacagagtgctgtggtgtatttcaaaatggttccttttcccctcccccagggatttttatcagatatttactgtgagaacctagtctcacaatatgtatgtatttacatacttagtgcatgtacatatgtacatacaaaaggcttacacactagtccccatttttaaagctggcaacttaatctctaatcgttgtaggaatttgcaaattatccttcagtctaagaaaaaatttctcaggtaaacacttccacaattctttattctgtattctctttaggagttgtaaacttcttgatgttttttctactaagtctgtaagtcacaattccttttatatatccactacatgcattgtgcaggttaatactgttcctcttactagagcaatagcctgactttagataaaactggttctgccataagagcctcaaacctttaatttccaatgataagtttagcatctcaaatatttaaagtaaccctaggtctaacacataatagcaaacaagaaataaaattttagaaaagcccttatagtacattccaacgaatatcttccaaaacctttaagaaaatttccataaatattctacttttctattttctttttgaatattaaactttagtataacattatacaggtctccctccatagccatcagggattggttccaggactcctgtggaaaccaaaatccacaggtgctagaattccttacataaaatggtgtagcatttgcattaacctatgttgtacattcccctgtattctttaaatcatctttagattatgtataatatttaatacactgtaaaagctatgtaaacaattgttttactgtatttttctgttatttttttattgttgtatggctatttttattgctttttttttatcctgagtatttttgatctgcaattgcctgaattcatggatgcaaaacccttgatatggagggccaactgaaaattttttactaaaaaaatctatgatctaaaaaatctatcataggcttccagtttccatttctgtatgtaaggagcttagaagtcactactccatcccttttccaagtaaaaagttaaacagactgaaaaatcagcgctctttttggattcttaagaaaaatgaggacacagagcacaactctgactctcaaggttggagaaataggcaaatgcagagagtcacagcttaccagacagaaacccgtgagaggaaatcgtcacaggaaccagtgctgtggtagaaaaacctgaactgtaattgacaaattgctagaggctcaggatgaaaaagtctgaatgaaaaactctaggggaaccaagacagagaaggactcccacactctgtgagttttacccccaggagctcgactagcttctcacagtaaatacttgagaaaaatcccagtgggaggggaaaaggaaccattttgaaatacactacagcactctgtcattcttaacaagatctgtcctcaggagaaactagttaatcaaaggctaacttgctgggtactgtcagagcctaactgatctggggaaaggaaaacccccaactctagcccactctagctttccatgtggaggaagagaaatactcaactccaggcatcctgtcttcactaaaggaggggaaaacacttgtgaagttcacagtccaaaagccaatgctcactaaatgactaagacctaataataggactacagagtgtaccacatagctccatactttaccaccatgttactagaggcctatttacagcagttccttttacccagtacatcatatctggctatcaagaaaaaattacaaggcatactaaaagggaaaaaaaaaaacacaatttgaagagatacacaagcatcagaaccagatatggcagggatgttgaaattatcaaactggaaacttaaaataaatatgattaatatgccaagggctctaatggataaagtagacaccatgcaacaacagatggagaatgtaagcaaagacatggaaatcttaagaaggaaccaaaagaaatgctagtgatcaaaaacacaatagcagaaatgaagagtgcctttgatgagcttattcatagattgaacactagctgaggaaagatctctaagcttgaggtaaatcaatagaaacctccaaaaccagaaaacaaagataaaacacacacacacacacacacacacagaacagaatacccaaagattgtggtacaactctaaaaggtataacatacgcataatgggaatatcagaagatgaagaaaaagagataagaacagaagaaatatttgaaacaataatgactgagaataaatgtcagacaccaaaccataaatccaagaagctcaaagaacaccaaaaaggataaatgtcaaaaaaaactatacctaggtgtatcatctgaaaatgcttttaaatatcttttacctggatatcttatactcctttaaatcagtacaaaggtatgacagtcattaattcaactcattaatcttacaattcccctttccctctggatagaaggcaatactgcacttcatagttccccattcaaaatttagcaatttgctttgaccaatgaaactctaaatgccattgcataacgagccacactcccttcccactgctgcagtgatcatggaagtatattcagataaaaccttcaatatcttgggtccagaaccattctaccaacttattttggatatgtagtctgtgtgttgtgttaagacattgaaatttgggcttgcttgtttctacagcataacctgagctcctctgactgatacaaagggttacttttccccagcagcctttcataagtacaacatagtctgatttaaatgctgcttctccaagtgatgacagcattctattcatgctcttattataacacaatactatagtaaaatggctgctggaattatccatttcctttgtaaactatactcctgaaggtaggaactgttaatgcctagctcatagtaagtagttaaaacacattttctggattcattgatcattcatatgttcactcatcaagggccaggggccactccggttactagagatagagtgaaaacagagcaaaccaaaattcctgccttcatatgccttatattcttatgaaggataatgataataagcaacacaaataagtgtaaatatatagtttaatagatagtgataaaaattatagagcaaagaaagaatataaagctttggatggtcatcaggtaagactccatttagaaggtgaaattttaataacgaccaaaagaaaagtaaggaaattggtcatacaattgctatatatggatgaagagcaattcagtagaaagaatagcaagtgcaaaaattctgagatgagaaaatgcctggcacgttcagagaacaaaaagggaggcagtatgcccagggcaagagaataacgatgagcagagttgaagatgaaattagagaaataacaaaggttcaagtactgtagagacatttagaccagtttaagagctttatttagatttgatgttgagtaaaatggagagctatttaaaggctttgagtagagtgaggagtgggaaagaacagtaagcgatgaggtcagagataaacagaggcccatattcttccattttatgtcatatttcctctctccacaatacataagaaaaatggatgtatcaatttactaagaaatattgctgagtaaatgatattttatgatgatattaatctgtttattacttaatatgcaggaacagtgactaaaaccaatacataattatcaaaatattgcaatataccaaagtataataatgtactgaacatcaagacagaccaagcatttaatgtagcaacaaatctttaacagacaattgataatactaaatatttaacaaataaatcagttataaatgtatagctttataaatgttactacatttatttggatttgctgaaatatcacaaaataaatacaagtaaaaacatttccttattgtaaaactgccttccataagaaaaacctatgcttggaacccaggttcattgccagaaaaaaacaacccaaagcaataagtacaaagtgaaagaaaacaaaccacaaatcaaaacaccttttgcaaaatgttaaatcaaataaacacaccttgcgttgtgtctttgatgctgccaagtctaaactctggagagctgccaaggggtaagatgtttccaaagccaaggtctttagttaggtagcagtgcttgcattcctggcaaattcaattccaaataccaaaaataatattcttggtgatttttcttactgaaattcaaaacaaagtatatagaaatagtaaatggatgatctccagttccctaatagtccacaaatttaaatcacagggaaatcatttccaaaaggtgtttcttggtttgctaactctgttatttattccatctgaatacgtttctatgccaaatataattggaaaatgttgcatattatgccccattttaacaaggcacatttttatattattatgaaggctctgagaagtcctgtaacagaagaatctatttaaatttatgtgacccagtgtgtcttaaacaattatctgaaaagtagcaggagatacttccactgttttctaaagtcaagcataaatgtaaaaatactgatataaaattattttctgttattttaatttgcacaaggttgactttaaaaacaattgtatttattcagtcgtaaatgtttaagtatatgttactttctaaatgcacattttaaaagcaacatggaataataagcaggtaatgcatgatttattcatttttgttcagtgaatatttaccaaatacatattaaatgtcaggcaatgaacttatgtcaagttttacactgcaattgctctcatatggataagagtataaaatttaagtatttccaaactgggatctaataataataccaacttaaaatttaaccccaactatttgggaacacaagctttactttactaattctaatgagataattaaaaatagcaattttggggttacttttaaatagtgttaacaatacaagtcaagagtaataatatgaaagaataatcctttttaacaaaggtgctacaaaataatacagttggacccttcctcacaccaaacacgaaatttaattcaagatgaatcacagaactaaatgcaaagactaaaactataaaacatttaaaggaaatcgtaggaataaaactttattactttgagtttgaaaatagtctcttagatacaacaccaatagcacaagcaacaaaataaaaaacagacaaattgaactccattaaaataaaaattttatgctttaaagaacatgaccaaaaaagtgcaaagacagtctgcagaatagaagaaaatacttgcacaccatatatataataaaagtcttatatccagaatatataaagaactctcacaactcaacataaaagatcaaataatacaatttttaaatgggcaaagtatttgaacaattttccagagaagacatacaaattgccaaaaagcacatgaaaagatgctcaacatcattagtcattaggaaaatccaaataaaaaccacaatgagataccactttactcctagtaggatggctattttaaaaaaatgcaagtggagataaggaatgtggagaaattggaatcttcatacattgctggtagaaatgtaaaatgttacagccacactttgaaaagtttggcagctcctcaaaaatgcacggagttaccacgtgaccagcaattttagtcttaggtatatatccaagaaaaatgaaaacatctccacacaaaaacttatatacgaatgttcatagcagcattattctaatagccaaaaagtagaaataactcatgatgaacaggtatataaatgtggtatatatctatatggtggaatattaaaaagaatgaaatattgataatgctgcaacatggatgaacttgtaaacatgtatctaagtgaaagaagtcagtcacaaaagtccacttaatacataacttttattgttccctttatatgaaatgtccagaatgggaaggtcaatagagaaagaaaatagattagtggttgcttaagggtgcagaggcagaaggaatgggaactgacataatgggtacagaatttctatctgagataatgaaaatattctgaaattagatagttgcacaatattgggaatattgtaaaaattcctgaattatacactttaaaatgataaactttatgattgtgaaatatagctcaataaagctgttattaaaatacaagtgtcataaaaatacaactctacagtccttatctaaaatgtttgggccagatatgtcttgaatgattttagattataaaaatgtaataaacctcatctaccataattacataacactcctgaaaggatgtgggggaagcatattaatacttcatagaaaaatcttatgccatttaattacataaatagtcccatgtcatttcaagtctgttttttgtctcaattaagtttgtaaaaaacttgacaaagtttaattttgaagaacttttggattttgaaaatgcaagtgatggttgttgggagccttattaatgatgattgttaatattagtaataatagcagctacgcatttgttgactagcaactactgtggcaaacactgtggtaagcacatcacataccacaaattttcataacatttctgcatgacaggtacaatttcccaactgaggaaattgagtttcctaatgattaactgacttgcccaagcatgcaaagttgacagggaaagtagcagagattagaactcaaatctatctgattatagagcttactctctttcctctatgtattagagtatgttcagaccactcaccagaactacagactctacctctgtaaaatggagtaagagcctttttacatatacatacatgtgtacataaccatatatacatatatgtaagtatgtatataaatatacatatgcatgtatgtatacataaaattaatgtatgtacataaaatatatgtatatttacgtatacatacacatacagatacacatatatacacatatatatgtgaagtaagaatgaaatgaagtatttttatgaaaatgtgtcaaatataaagatctacataaatataagacaatatcatctgagtaactattttcattatatatctaaatcaaggttcaaaggggatatgttttcagttaaattttacaaaggcattccaaacaaacgtattaattttagtagaagaaatgcaaagtgttaatttaaacattggttttaaatatctaagcaaagaaaatctaaatatattcaagtggtctataactaaacttctatcatctcaaactttcataaagtttttggggtgcagtatgcaagcatatacattatgttttgtcttaaagcagttagttctatctactcaggagaagccagaacagattacgtttttactttataagtaacttcttaatattctaaaaaagtttaatgatttacgtttatttaacagcctgctcacataagtttacctaccacgtaagttcctagggtaactaggggattgtttatatattcccccttaaaggaaaacctgtgtatacctcagtacaacttttattccatgaaagtataatcatagaattaaagaactttagaaagtgtggtacagtatttgaaaaagcttcagaaccatttcaaaataccaatttgatcatgttgctctccatttgaaaacctgaaatggatcctcattgcctccaagatgcaaatagttttgcatgtcatataagagcctcctcagcctttgccagcaggttcatactgcctcaactctagccacttttctctagattaggccccaatcactaaacttcttttgattttccaatcacaagaacccattgacagcttaatagctttacaaatcttattatacttatttcaatgttgctcagccctagccttgtctaacttgaattcataggcacccttcaagaccccatttcaatcaattacgtactttctctgtacaagtcacctatacctgctggacaaatctttggttatctgattgatatgtaactcataactcacttattaaatattgtacatacttatctctataaacatctagatttttggcatataatagtatccattatttcttattataatattgagatattacctgattttcatctttggaaataaaactgtaaaatatttacatgaattttgtttcatttatggaatagagatggaaaagagaagatgtggattataaaattcaaataataatagattcctgaggttaaccttaacccatataagaccaaacagatgctggggtaagtcaaacactgaagggcaaaaattgaataaatctgagtcccttgaactgaaaagaaaagtacactatgtcttacaattcaggtcaggagttggaaaacttcttctgctttctagatacaaatattataggctttggatgtcaagagggaaaatcaaattataacaatgtgactatgattttagtgtgctgagatgcagagcaaggcaatgaaagtgcctcatgtgcacctctgcggcaattacacaactctgctgtattgtattgtactgtaaaagcagccatagacaatacgtaaacaaatgagtgtgattgttttctaataaaactttatttataaacaattaaatttgaattttacataatttccacatcacatataaacaaatgagcgtgattgttttctaataaaactttatttataaacaattaaatttgaattttacataatttccccatgtccacattatccttttgatttttttcaaccgtttaaatatgtacaaaccattccaagctcacggatcataggatacacaaggtgagccagatctggcttgctggtcgtagtttgctattcaatggtttggggatattttttaatctattcatactcttggattatcaggtttcctctctggcataaatgagtcagaagttcacaaaattttatttaaatctaggtcgttcttattgaattaattgtgtagtattatcttctcatgcaaacaatgttttatattagcagtcaatttttagctatatttaacaaaactatttaaagtctggggtataccatcagttatatatatgcatacacacacacacacacacacacacacacacacacacacacacaaaatggcttttgtgttgatattgcattatctcataataagctggtatcttcgggtctttttcctcaaaaggaaacacgaagtagtttagattcctttatacacatgctcctcaacttaccgtgggtgaaaaatatcttaaatcgaaaatgcatttaataccccaataaacccatagtaaaattgaaatattgtaaatcaaaccatcttaagtccagatgcttttcaacttatgatagggttacataccgataaacccatcatgaagttgaaaaaccataagtcaaaccattgtaaatcagggacggactgtatacgtaagagtggttttctgttgccatcacacaagaattacaaactgcctgggaatttttttaactataaacatgttgctctgttgttttctggcatttcatactacagaaaagaagtctgaggccagcctaataacatgcttttttcttttctttcttgatatggaaaacatttattttctttatcatcataatttgacaattttgtgatttttgtgtctctttaagttgtcatgccttacataaaaaaggccctttcttccttcataggtctttttcagctcaggaaagttttttctcctatttatttttaaaattatttttctttcaaatactctgttcttttcttcaggaacaactatttgtctatctatctatctatctatgtatctatcttcttgtctctttttcagagactccaaatatccacacagtggactctattctttattctccatatatcatctttttatgatttccaattttttaactaaaataacctctcaaatctattctctacaccgactaaactttgtacaacgacatcaattctatttgttactgcctcaaatatagatttttaatgcttttgtgataggcaaaataatgttcccccaatccaaaaatgttcaagtcctaattcccataacctacaaataagttaccttagattgcagaagggactttgcagacatgattcaatgaagaacctcaaaatggacagattgtcctgaattatctggatgtgtcttcaaaagtagataacccttccagatgtggtcaggagacatgacaacaaaataagtcagattgctgcaatgttgctggctttgacgttggaagaaggaggccataagccaaggaatgtgagcagcctccagaaactacaaaagacaaggaaaccaaccatctctcctagagcctccagaaaggaatgcagccctgtcccgaccttgatttcagcccaaagtgacctatatcagacttctgaaccacagaactgtcagatactaaatttgtgttattttaagtcactaaatgtggggtaatgtgttataagaggaacaaaactgatacggctctcatattttcagtttctcatcattttgttttctcttactatcttctctctgacacttcatcactgtctgttatttttacatgaagttctcctatccatagaagccatgtattcttgaatgtgttggacggcaaataactccccgaaatgttcttccttccttagcttaaaattatttttagagattcataggtatgcctctgagttttctactgataacctctgccttgattttgtaggatgtcttgtttcacttgatttattttcaaatgttaatttatccagaatattttagcactgaaaaaactgtatagataatttctacataagccagtgttttccatttatcgataaaggggacggtgttgaggggaggcagaaaatgaactccctaggaatgcagacaaagcagaatcggaaactgggaggttctttttaaaactgtaccttcccatcctgaaaaaaaaaatctgatatacctcctctgcccagagagattcagtactatatactgagtcactgtgaatgacggcaacgtattataatgctcaagcatgttgttcaaaaaaaagaaaaatcttcaaccttttccacatagataattaacttgactggaaagttattaatacccaacaaaggatatttctacctacagagctaagtctaaaactttcaatacagtgcaccttccacctgctataggtaataaactataatccacaattaggactttgccacaggtatccatatagttcattattccataccctgcaatatttgaatattttaacattcaaagtatgtaaaacaaatgttatttggattaacctatctttcttttgtcattgtcaaacttttaaattgttcaatacaattggtctgttatttttgcaactacgtcactaaataatactactacagaagaactaagctagtttatgctgttgtcattctccacttcagtggcttaaaagtcatgtgactgacaagagtctttcattaatggaactgtctttgccttttgagtcaaaaaaactgttaaaccactgaatatggagtatttacctttttattgtttaacatttcaaaattacgaattaagtaggaatcatttatttttcatggaaacatacacctatctcactctattgttgcaaagatgctgaacatttctaccatataaaaaaggtataaatatatataatggtatgaaaaattagctctaggcctacatgatccttatctgtttaataggaaatttgagaatatcaaatatgatcaaatatgtatcactattttccattagtattattttagtcactctggatgaataccaaaaaaccacaaaattctaagtaatattgtttaagacattaacactttgagtcaaatctactgatatcaaaaacacagatacatatgcacaaagattaaggagaaagctggctgagtttcgcgtttctacatagaagaatgtccactggagcagggactctcaaaagatgctttggcattggagtgagacaaagaaattctttattgagctgatagatctctacattacacaatatttatcatctctgaacttcaggatcccaaaagccagtagtacttcctttaaagaaattagaataattttaaaacaccctggcatatttcaaataccccagaggtgtcacccagaatggaaaaccattctggaaatggaaaaccagagcactagattaacagtcctggcctcagatcccacttcttcttcacagcttaccaaaaagagacgtatctgaccggttcacattactccaccggtagagctaacccattataaaccactaagcactggagattttccatcttttattagacctctgccctacaccatgaaaagcagtaattgtaagtaagcgtatctgttccgcaatctgaaatttttctctcagctgaactaaagtctaggttctgggaaagagagtaggagtaaaaggggataggaagtactagtactcatttttggtctcatttttgcataaagcactatccccactcgacttgttattgcaagttgaagttgatatggcaggcgccacatgtctgtttacaaacgcaagagaggaaggaaagagctattattgagcccctaaaaatctctaaatccattgtaatgctctctctaagccatttgtctttatccctgtttctctaccagaaatgaacagagttgaataaagaaagagtcaagtaccaaacagttcaaataaaattacaagtactaacgaaataacaggtgcatatatacatttatgcgttttacaaaagcaatagctctttacctcttcaagtttttccttatccaataacaactttttatatctactactgatatccacttttattgataaagctagatagggaatcagaccaaagaaaataatgaactctatttacagatttctatatgaatatagaaatcaggaaaagagccacagtgaaaacaaccacaattctttttagccacaaattaaaatgttataaaagattattcacttaagtttaaaaaaaaaaaaacagttctaagtatcaagtaatgatattccagtggcatgtactaaaaataatcagcttttctttgtccaaaacggacctcgatagatgagaaagtttatggatttaatgttcatctcaaaagtacaattttggccagacgcggtggctcacccctgtaatctcaacactttgggaggccgaggcgggcggatcacctgaggttgggagttcgagaccagcctgaccaacatgaagaaaccccgtctgtactaaaaatacaaaattagccaggtgtggtggtgcactcctgtaatcccagctactcgggaggctgaggcaggagaattgcttgaaccaggaaggcagaggttgtggtgagctgagatagcgccattgcactccagcctgggcaacaagagtgaaactccgtctcaaaaaaaaaaaaaaaatacagtttcacatttttctcaaaatatttgacaatgttctttttacttgtttaaataccagaatatgctttaagaggttatgatcaaagggcatttgggataaaacatagattacatggttttgtaagatagcaacaaataactgaacattagtagttcccgtttgttagtgctcaaaaaaacaaaaaagtacaatgggaaagggggccccaaaagggaactgcagatgactgaaggccttgaacaaaggtatgttatggtaagaggcactgtggaagaaaggcaaaagccccactctgctcccagctatgtagccttgggtaaaagttacttagtctctctgtaggatgaggcaagtgggagagaataatttccttatccctaaagaagttgaacaaaaacagggtccatttaggcttaaaattgtgcatttttctgaggagcaagtcaatagctttccttggtttctcaaagtggtaaatgacaccaaaaaggttagtcatcctcgcattaaaaggtaatgtttcccaatcttttcaggtatatatatatatctatatatatatatatatctagtgatattaaagaggaaaaggtgtcattcaagacattacaggttctacctaaccagaaccaacacagaatcaataatgaatagatgagttaatttcttccccatttctaaataaccctaagattaaaaaaaaaaaaaatcacaagggaaatttgaaaatacttaaagctgaatggcaatacttatacgtgtttataaatttggatcatatacacaaaaagattaaaagtgtaatcaataatgctttacatttgtgtggatcattactttaatgatactttcacaaccaattattcctccttttttaggaaggaagggcatatcctagagtctccaatttacagataacgaaacaattattgcccaaggacaaacatttcttaaccatgccagtttcctgacttgtaggccaatgctcctcccaatgttaacaagcagcacaagcttccttcctgggggtttgcactgtaaacctgccagaggaaaataaaagatttttacctcttttgttttttctctctggaatgtttgttgtgctgaatcattaggagacagagtatatgagcaaacaaaggcagatttaaaatggttatctgaggttaccatctcacaccatacttgttgatcattaagtatgagccgagtgaagcaaaaacagctctacaggtttagcacacctctccacagtagagaatgaaagggagattatacattggggctcctctagcaataaattgcttcaacttcttcaggaggcttattaagctcaaacaagcagcagagaactccaagtagaagaaacctaatctccaatccccttttcctagtcatccacgcggacaccaacatctgatggattcaggaatacaccaagctccaagaaaaatacccccgccccacaacctcaccaccaccgataaagccacctaatcctgtctgaatctcttctctgcaaatgttttggtatgcaaatactcgttcattaataagaggaagcaggaaaaagagtgaagaggagtaccatgggaaagggggccccaaaagggaacggcagaacccagagagctgcactgacaagtaagcgaccgcgagtaatcggtcagcac

SEQ ID NO: 569 - DNA, 82616 bp, Homo sapiens; identical to SEQ ID NO: 566

SEQ ID NO: 570 - DNA, 82616 bp, Homo sapiens; identical to SEQ ID NO: 566

SEQ ID NO: 571 - DNA, 82509 bp, Homo sapiens
gttgattgatattgtgatttttaagttttattgattaaattcaaacttttttatcatttacacaaagaaactgtgacagactctgagaggactaaaaggcatcaacttaaattttaacatgcatttattaaatttatatgcagatgactacactactgcaattacagaaatgagtaagaacatactctcaagatcttacagtcattggttggggtgaaagtatttcttctgtcttcatgaaaaattaaaaagatagaaaatcttgaagtattttgctaccttaaaacaactacccaccctacatttgtactaaaataggcttttgcttgttttaaaagcaattctagatgaggttatatttttacaatactgtatctcatctcaaataaatttatacattctttaccctgtctaaacttgcatgcaaaataagaaccagcaagccttcaaacttcaatcacagtattccataggctatattttaagtctattgcattagttgaaatttattttgcagagtatgttaacaaacatattctaacacttaaaaaatcattacaattttttctgtttttgtcttctaaattactctgagcagtgaattactggagggaagatacccatgtctaaaatttgtgtctggtgccagtctcagatttctgccaaacaccagtaggtattcaaaagtgtggtccctttaaaacagcaggccggatatcacctttctgtcttcaaagattcaaaccagactcccaatctgggatttctctacagagggttggctgcttcccagttaatgtgagttttgcaaagtttgcatttcatgaaaacagtgttgtgtaaacatatattgtgtcactttacctactatttactaaaatcagagagtttagcctttgaaatttatggttctctggagctatcataaatcaatcagtcatacgaatggactagctgtagactcaggatatcaataaaactaggcagtgaaatttgcctataattatactatatttagattaatagttatcaaaaacatttttccccaaaaaatacctcaagggtaaaacagaatggtaaagtttttttcaggataatgaattttcaaacatttccaagaccataaccagccattttaagtactgtaaactctgttatatttcatttggataagtatctaataagcaattattacatatcctctcatttaaattaccactgaaaactagaaataatctttatttaatacgactgttttaacaccatatggaacgggaaataactaaatgaaaattgttcacgtaaatgtgatgggagtgggggggtggggagcagtatttcttgacatgtggcatgtcactcaggaaagtaaaaggcccatcatatccaaaatgccagcttggatattcccttgccacccacttgacgaacagacataccacatggcattaaatgctgcaacctttcctaaaaatgccacttggattggtccgctgtggtgagtatataagaactcttggtctgtctcttgagtctgtgagttcaaagggaagaatctagtaaataacaccggctaaattttgccctcagatgtttggcataaatgatttgtgaggatattggaacctttggctgttttcacaccaatgaaataaattatgctacttgaaaaaaattctacagaacataatgctacacagtcacagtcgactttttgcaaaagtaccagagaatatcttttagaaacagtgcttataaagccccatatactccttagatatttcccaaggatttcttctcttggctagcaggaaaacaatcttaatattttatttattcttcataaatacaatgtatataatataaaacactttgtgcacatgtttccaacaatttcattttctatgcatctttacataaggtagtagctaataactctttctgtggacacgtattttccagttttctaaggtttatgtgttcaagcattgtaaaaacatatttaaaaattgaattaccagtaaaaatattgaatgtacaggtcattatgctcccacaaatacaaaatacattgaaaaattatatcaacagataattacatatgaaatatgaggcatatattttcttctattatttattttctccctaaagagttctaattgattaaatctcaagagacaaaatgtaattttataaaacaactgtattgttcagatttaggagacaacctaagaagatgattctgagtaggtaggatttttgctattactgttatgtgaaaaagactgctcaattaaatgacagattgttacatatctccctaacaagaggggcgaactgatactacaagcagccagaacaacataattagaatagaattccaaggttatattaatagagtaataagttaattaaaaccaagatcaactgagcttctatttacaccagttcagacagcccaagaggaaaagaactctattttagagacatatgtgactctttgagcttctgtcatccaggtgccatttctgatgcagcacatgtgcactgaacagttggcaaagaaggaaaaagattatggtagatgtatgtgcagatagtctctctaatgatgtaaaatacgtccagaaagaaagcagggctttgttgtaaaataaaaaatttcccatgactttttgttctttctgaatgtgatttgagcatgtttctgtaaataagaatatatactaacttatgatgtatatagaacaaaaatagacttactcatcaggaagtgatggaattatacacataaattggcaatgacatttgaaaaatttaggatctggttcccatttcatctaaatgtaccatgtatagggtggctgtcaaagcagaaagatatataaaagtatccagtagcacatactatactgcattgctaggtaaggttcttttcctgacatcctatgcaactatcaaaaatcatatgtctgcaaactgaaaatattagcagaaagaattaaagatgttacagtttcagtattgaaagttttggtcccaaaaggtgctttcgtaaagttatttctctttcatgcattgattgttgcttagctaatcttcatcttggtccagatcagggtcaacatccgtggtgagtctgagataaaagaaagcatagaaagccagtagtagtgccaatatagctgcaagtacaaggccaacttcctgggaagaaaaaaaaagtagacttgaaattgatgaaaaaagattggttaacattattagtttcaccagataaaataaccatattgttccacagtctagaatgaataatttgaacctaataatcatatcctttttgtttaccattttttgccgttaagaaactgttttgtactggcaagtcccaatgaaatggcaaatacaccagtgggtgagtcattagtattattatttctagctaatttgttttttccttatagtaatattaaaaatgtatcattttaatatatttttatagtttggatatcaggatgttcgatacaagcaatgcagtttgtatctacacagttgatctgttttctatttgagtgtgtttaactttatttgtggcttcaatacattcagtattaatgatagcatttgggcacagttttttttttaattatcattccttttcattgtaaagaaacagttgtaactggtctctagattatatatagatgtatacatactcattaaatgtgactttgttgaaactctaatttttaaatcctaaagtctatagtttacactgcagaggaacaaaacaaagtactcttcactcatgaagcataatacaatacatttatcacagttttgaaggatgggcccagatttttcatttgtgatgtgatgtggattaaattaatcaactatattgtaataatgataaaaaatttactcatatattatgataaaaatcatattatctctcaaaaagtatgtatatgtatatatctctgtgtgtataccttccagaactttcttaacattaacatatcatttgactaaatcaaaaaagaaaaaaaaagcaaatagaatgccagttcagtatcctaaagggcttacatactatattctaatttctactgtatattatgccctttacctagcactgctttacagagaagcaatgcattagcatttacatgaatatagtttacatttcacaagaaggtaagtcagtaataataaactttaaaaacattaaaatgaatttggcttataatcaacatggaatttttacatgaatgttgaatttataaatagatcttttatacagatttttagcttcataattacatttatttagatgtccaaactatgaaaataaatattaataaaaaccaagaggttgaaaaactcaagtgtcaaagatctttgtaaggtttcattttttaaatctaatataccaatataatgtcaaaggaaagtgaattttttctttgttgcagtagaaacactttggcatctcaaaagggcatggcagcatcagacaggtttcatttattttcttatatccacagctgtgttcccagacccatctggttacacagctactaattttaagaggatgtaataaacaagtgacacacaactgcaaactccatctgttctgtatagtggacaacaaaactgttcaacagcagtccccattcgcccaagcttaatgcaagaattaagtttgtactcttgattggaggccatgattcatatcttattgataatcagttctaattgctgcttttcaactccttgtccttaaaacaactctgtatcatttcactatatattttcagaacatccagaggcatgaaaaggcatttaagggataggaagcagagaatattcatagaacataacttcagaagacccattaattcattacatctgttcaatgtacagtgtgggtgtggcttaaaggtactaggtggaaaggtatagcaaataattttctccaaaaattatctcttcattgaggagaaaagcattgtagaggctgaatgtcgggagagttgaaacgatggtaaaatttgaaaataatgcttgcaggatgctggtgaaactaaccataacttagagacctataggcatttatgactcccttgccccctttggctatttttagctttaaatcaaaaagaacaaaaaagaacaaacataacatttcaagctggctcatcccaaggggttgtgggcaggatctggttggcacttgaatattttatttatgtaacaaaactaaacttgtgatccttattctttcactataattatgcttttcatataaaccttttaaataaaaaagcaactcattaacaaatgtaaatcttttccttctaaatgctagaaaaccggtatttgcattctgaaaaaaaagttggtgatgctgtaattcttgaaaaaataatcttttaattgagcagcaactaaatagcaaacttagttgtgcaaacattttttaggcggcactcattgcattactgggccataaattatggcattttctttgtatttctaaaacacaaaaaataaaaagtacctcctcagtagaaatcaagtctaggtttcagaacaatgtattaatatcttatatggaaattgctaactgttcccttaaaacgctattactaaacatacatttacaaaaagcactagaagcctctgagggttaagcccctattgtataattctgcatatctctagcccatgatttctcaatcagtactgttgatttgatatggtaattaaatctataagtgatttcttgtataagctcttccaagatgatcatgtcttattcatctttcttttcacaggtgctatactattataatatttatggtaatttataaataatgaaagattgagtaaaatttatataatcgttatacagggatatcaaaattagtaatgtttttaaaactttataacactaatatccataatactacctccaaagccaatctaagaacattttgtaatatataatatggcaacacgatgcacactttaggagggtatcttaaggccgatgacaaacactgaaggagagacttacttacacaaactgggaatggctaattcaaacaaatgttttctcaatcagctaataattcataagtgacttctacacattcaattcaatgttcaatgtttctagtgtattattgaactctcctgacaacattatgaggtaaatggcaaaatttccattttataaatgtgccagcttagacttagatggatcatggcaaaaggaagaggcaaaggggataggattctaggcctccttatcctgagctcagtgctattctcattgctgttatttttctatccatgcatctgttcatattttctatagatatgaattaaatgaagagtatatctatgattcattcaaaagactatgtagtaaagtgataagatatcacaatattatggtcattctatatcaactaggtaagagtacaatatgcttgttgttcattagtccttagttgcttctctgacattatcaatatggataaaatcactcactggggaaattaaaaagcattaaatggcaattgctgaaagaaactttgttatttaaaatcctatgccaaaatgacaaggcaatcaaagtttgacagggcaaattaattagtatgccagatttgaaatgtaaaacaccttcaaggttctgattctaaaaagtttcatatcatcttaataggctctccacataaattgtcaagcaaagtaagtaatatttaaggttaaagtttttgttttccacaggtttacaaatcaaaatgatgtgctagcttattaaaaaggagctatgttctgctgtcagtttgaaagttttctgttgatactttaaatattaaataaaatctaagaaaaatgttttctcatagaaagattagcaaattctacagtgtttttaaaaagacactagataactgcactataaggtagaccttatctcatactaggaacattattatttcttcaaatttaaagactaacaacaattataagagcaaatgtataaaaaagatgtgtgtgtataaaactggtatataaataaataaatagctgcactatttctcaaatcctgatatttaacttctcatcatattgtgccacaagaggattttgttaccccatatttttctaagaaacaaacaaactaattaaaacaacaaaaatcccactgtattgtgaaagataaaagtaaatgacatattgcctttgagggcaatgacagacaatgttctcgctttaagaaatgatcaccaagtagccaaatgtaaaatttaaaaaaatctcaacactgctttttaaaaagtcacgtcataaagaatttttttaatgaatgagatttcacatgaaattagaaaaatacttcaaaagatgaatcttctctcttttaaacaaaaaggcaatttacttttttttcaataaaaactgacacacagcatggaagagatggtgttgtgcaaacatactgcatcacacggcaatgcttgatcaaaatcagcaatcaggagcgaaaagaaggcagtgtttcgtgatcataatagcaaattctggaagacaaccaaatatatcatctggcagttcaacagctgttacagcttggtagtaataccttggcatttgctgtaagctataacttagaaaaattgatttttcatctgccagataaaacccaaaatctccttttaacatgttaatatttaaataaaatatatgtactggtcatttttattttacacctttgatagtagagttgccaaattaattcttctattaatagtttaattcaactctaaatacctggcaaaagattgacatgggcaataatgtaaatgcaatttgttgagcttcattgtgttagcacattaaattaatatctgctaacatcattctcagttgcatttatccctcttaagcagataaaacactggtattctgaaagaacaagtttaggaatgtcattataatttcatcagagagtactgacaacaataagataagcagagtaaaattacataattaatgatctcagtatatataattacaactacaatttaaacaactataaaatgagatttattgaaaaacgaaagaaatttctgacgaaggccacatatatcactgaaatgtctgaataatacacatagtagctagagagaaaataaattgcacctttaagtataactgattctcttaagtgacactgttttaagacccttcaaaatctcagaataggaaggatgttttccattaagtaaattctttacaaaaacctttaagtctggcattctatttagattgtgaaatgtcataaaacatttagaattcaacatttatgcaatccagttttagaaaatgaaatggcatgcacatatcaaattttaaagttatcaaatagaggtttacctttatgcctattgctgttttctttgcttctgcttttaatttggttgctcgtaaaataggtttagtttttttataatcctgtttacctagaaagaaatagtttcagacaatgagttatgctcatatataattaagtttaacaatcatttgaaatgtcaaagaatgtttaaatacagtgaaacagggacacggagttgcaaagtagttcccagttgtggtaaccataaacttgtcaccaaaaggtcaacttttccttctctcttactttttcaggaagaggatactgacggacatcttcaatttgctgtatagtgaatgtcaaaaaagataaaaacttgttttagagaacacaaaatttaaagtaaagaaaataaaacttttggaagcatttggaaacagatgcataagtaaatgagtatatgtaagatcctattaacagctaaagttaactttgtcttcctaagagtaacagctaattataaatgtattttattatggatacgttaagcattcaaaacataagtgagaaatatccccaagtttcctttaagtaaaagactaaagaagaaatctataaatatttaacttttagccccaccctgaattcattagaaaaatatttcttttatttcctcttttatttcctcttaatagagaacaaaattaacatggctagatagaagttatagaatagctacatttagatattagtttcaataatttcttccacatttcatagccaaaaatgtgcgaaactgagttagtgccacaaaatttcctttgtgtatcatctagtgactccagcaaagagtaacaaaagtggattacacagcctggggagaatataggtttaacaacaagaacaagaacagtgaaagcattcattacaatgatatactttttgttagccaactcttaactaggaactgagtcaaaatgagcctcaaacataacaatataatattttattctcaggaggagttaatacatgatcgtataatctctctggctattttatattcttattttgttttattttcatcttttccccttcctttcgatgaccagttcctttacaaaactcatcgctacattcccttcatctaaataatacaaattctaacattaatttccacatcttcttcacattgaaataaattgaaaagcaattggtctaaactcaagtatatcataaaaatttaatgtgcaatatatcttaatgtgtctgctaatgattcaaaagtatctttaaaatttcatacagagttttagaactagaaatggtagtcaaatggatgggcgtagtgaagaaacattatatttatgtccattagacacataaaagtgtttgtttggctggaaagcaaggtattttgtttttaaaggattgtcttctctttccttaactgctattgtatagcaataactctggatcaatgagcatgcagaagcttaataaatattatttgatgatggggtctgatgatctagaaatgagacaattgtcataatatgtatcaaatgatctaaatttaaataatggaatgaacaaaatacatgagaaaaatgttactctgacccattttaaattagcaatatttaattctgatgaaaaaaatcttgacaagtgttcactctaatttcacatctctacagtcaaactattcatgtcattattcctgctgagctataaacagttcagaacaatgaaaatggtgacacatcaaaggcctccggtcagggttaccaagcaagtttctaacaagaattctgaaagatatttgaagattgtagatttatcacaaagtaacttcttgttttatcctgtatatgccctataataatctcttgatgctatggcggggggtggggggtgagcagcaggaataaacagatgcaagaggattatcttaattcatattttttatacagatatgaaatattttggataatgtatctgtcataaaacacatgcaaatatctaagagtcaatactaaaatgagaatttttcactctacttcaactgccatataaccattggttaaataatgtattctatttcaattcaactctcatattcttagagaataatacttccagatttgtattcaagttgatattaacatttgaaactgtatttataataaaaagacagtattaaaagttattgtatacctggtacttttccaagcagtgcatctgtcataaatttagcattctccttgtcgactatgatatccaaaagtgtatattgcaaaatgtggttttagtttactaagtgacaacatttacaggagtgtctggtaggttctttataactaaagccagatcattccattgtacccaaagaggttttcaacatttaaatatttatggcttcaagaaagatacctatgcccacatgattgtaaaaaatataaaatatagaagtccctgacttctgcgtacttacacctaagggaaaaaaaaaacacagttacataatctagattttatatgtagactgtttcttgaacacaactgattctgattttggttgtatcagtgatgcaataaccaaagtagctatttgacagttgctcattaaatcttatgtggagagaaaaacttggtaattcaagcctatgaagccaatctggggcctcaatcaagcccaatgtctgagcttccttaggaacaggttctactgcatttttctgtgtatgaactaacctattagttctttatgtgtttcataattttaaattgaaaatcaaacatatttgataatgtaatgtggaaactctgcaaactagatcgtccctgaggtttgttgttactgttatttgctctttgttgttgttgttagaatccctttgtttagtaactttactgaactaattctatagagactgtattcaatagtatatggtcactgaagtctctgcacagttaccttattggtcatctgctgtggtttaatgtgtcccccaaaattcatgttggaaacttaatttccagtgcaacagttttgagaggtgggatctgtaagaggagagtggatcataaggactctgccctcatgaataacttaatgccattattgtgagagtgggttagttatcatagaagttagttcataatacaaagataaattcagtttacttcctcattctctcttgtgcatgctctttggcccttctgccttccaccatgggataatgcattcacaaggcccttgccagaggcaggcccctccagcttagacttcccagtctccacaatcataagaaataaatatctgttctttacacattttctaatctcaaaggttttgttatagcagcaccaaatagactaagacagaaaactggtaccaagaagtaggggtgctgctataacaaacacctggaaatgtggaagtggctttggaaatgtgcaatggggaggggctggatgaatttgaaagagcaggctagaaaaaccctgtattgccatgaaggaagcattaaaggtgattctggggggtgctcagaagaaatggtgagatgtaaggaaagtctgaatcttcttagggattatttgagtagtcataatcagaatgtttgtagaaacatgaaaagtaaaggccattttgatgaggtctcagatggaaatgggagacatcttattgggacctggagtaaaggctatccttgttataaattggcaaagaacgtggctgaattgcttccatgtcaaatactttatatggaagacagaatgtacaagcaatggactaaagtatctgccagaataaatttctaagcaaattactgaaggagttgtatgactgccttttacctcatatagtgagatgtgcaaaaaaagaaatgactaaaaggtaaaatttacaattaaaagagaaacaggaggaaaagatttataaaactctcagcctggccatgtaaagaataaaaaaaaagtgtgctgaggagagaatactaaaggtgtgaccaagcaaccctttgctaaagagattactagggagagaaggggaccaggtgctattcatcaggacaatgagagaaagacctcaaagacatttcagagatctctgagaatgcccctcccaaaatagatccagaagatcttaagggcaacatctccagagaggcttccaggggacctctgtattcactgcctggagttgccttgggactctgtttctcacattccagcacagcacccctcagccatgccagctgtggcttaagcaggcccaggtgaagtttgtgctgcagctccggggacacaagggataagtcttagcagggttcatgtagtgctgattctgcagacttactgatttcatgagctgtggggccatggaggcccccaactagacttcaaaagatgttctggacagcctggggacccaggcagaaacttgttgcagggatgaagccactgcagagagccctgactagggcaatgcctagtgaagccacaggagaaaagccacctcagagactcaagaattatagagctaccagtgtgcaattacagtctgggaaagaaccagtcaagagactccaacctgtgagagctgctgggtggtttgaacccaacaaagccatatggggagggttgcctgaggccttaggggcccaatgcctgccccaatgtgaccaggatgtgggacatggagtcaaaggatattatgtccagctttaagatttaatgttgttttccctgttgggttttggacttgcttggaatctgttactacttttttcttgcctaattctcccttttggaatgggaatgtctgtggtaggcttgtgtcaacattgcattttctttttctttcttttttttttttttagatgttgtttcactcctgtctcccaggctggagtgcaatggcatgatcctggctcactgcaacctctgcctcccaggttcaagtgattctcctgcctcagcctcccaagtagctgggattacaggcatgcaccaccacgcctggctaatttttgtatttttagtagagatggggtttcgcaatactggccatgctggtcttgaactcctgacctcaggtgatccacccacctcggcgtcccaaagtgctgggattacaggcatgagccaccatgccaggccccagcattgtactttggaagtagataatttgattaatttcacaggctcacagatggagaggaatttgcctcgagacgaatgatgccttgagtcttacccacatgtgattttaaatgagactttggattttgaaattttgagtcgatactggaaggaggtaagacttttgggactattgagatggaatgaatgtattttgcattgtaagaaggacatgaactttgaaggccagggctagaatgctataatttgaatgtgtcctgaaaagttcatgttttggaaacttaatctccaattcaacaacattgagaggtgggacttttaagagattattaggtcataagggctctgccctcatgaatgaattagttatcacaggagtgggctcatgataaaagaatgagcttggtccctttcctcttgctttcttgtatgtgctcttttgtcctttattcttccccattaggatgatgcgttgacctttgactttccagactccagaactttaaaaaatagatttcttttctttataaattacccagtctcaggtattctgttatagcagcaccaaatggactaagacatcatgtaatgactggacagatatttccttaaatgctttgaaccactaagtctcttaattttgctgaggagctatgtgactatttgtgtgtgtgtctgtatatgtgcatgcaggtatatgtgtatgtttttgtgttggggtacatctccatgctacaacagaggtttatagttatgccttagccttcacttctgcttgtgaagagccttaagtccaccaagaggtaagagattataggttcctcacatctttaatgggcatgatatagccctgctcgtgcacatgaccttctagattctcaggaatctgtcagaccttttaaaaaattctatgggcatgttgttcccctgtttttgcttttattctttggtcagtctcatgtttaaccccactagtaatgatgcttcaggcaactacaatgttaaacacttgttgttcattgtttttgtcaaatgccacagagaaagggctcttcacacagagttagctctaagtaaagtcaaataaagacaagttttgagaaaggggcttttcagtgagtttccagactggtcaaattgtgacaagtcttgaggatgggggctttgcatatctccaaatgaattttgccttctccagtggctgctacgctaacgttttccgtaactactgtagttgaaaggctaaagaaaagaaaatggcattaaggcaagttaaaacaccacaaagattgcagatattactgagattcacctgtttttctgaaataaacactccttagatggttttaagattttagttaattttcaggtttctggaaaacattgattttgatagttttcaccagtgttctcactggctttatataaaagcagattttcagaggtttttactttccactcaagaagtacttctcctccatagctttaattttactatcatcacatttaaagttagtatgttggatttttacattaattttcattcatttacaatttttataaccataaaataggatacaatggctgagtcaaacagaggttgctgcttaaaagctcagtgttggtaatctatcagttatttcaggctgaatgtttcaaattctctttttgttttttacttaatttttgcaggtacataataggtgtgtgtgtgtatatatatatatatatatatatatatatatatatatatagatgggggtacatgagctattttgatacaagcatataatgcatgataatcacatcagggtaaatgcggtatctatctcctccagaattttcctttctttgtgttgcaaacaatctgattatactacttttttttttttttctggagtctcactctgtcatcaggccagagtgcagtggcacaatctcgtctcattgtaacctctgactcctctgattctcctgcctcagcctcccaagtaactgggtttacaggcacatgacaccatggccagctaatttttgtatttttagtagagatggggtttcaccatgttagccaggatggtctcaatctcttgacctcgtgatctgcccaccttagcctcccaaatcacacctgggattacaggcatgagccactgcacttggcctttttcattatttttaaatgtacaataagttttatcaaatactagatcttattcattcttactaactatatttctgtgcccattaaccattcccactccttccaccccctccccaatactcttcccagtctctggttaccatccttttattctctatttccatgagttcaattgtttaaatttttttagctcccacaaataagtgagaagatgcccactttttctttctgtacctggcttatttcacttgacataatgacctccagttacatccatgttgtcgcaaatgacaggatctcattcttttttcatggatgaacagtacttcattgtgtataagtaacactttctatagccattcatctattgatggacacttaggttgcttctgaatcttggctactgtgaatagtgctgcaataaacgtaggagtgtagatatctttttggtatcctgatttcctttcttttgcatatatacttagcagtagggttgctggatcatctggtagctctatttttaggtttttgggggaacctccaaaccgttttcaatagtggttgtactaatttacattcccaccaacagtgtatgagggtttcctttcctccacatcctcaccagcattcgttcttgcaccttttggataaaagccatttttaactgaggtgagatgatatttcattgtatttttgattttcatttctctaatgattaatgattttgagcatgttttcatacacctgtttgctacttgtatgctccttttgagaaatgcctattcagatattttgcccattcaaaactcagattattaaattttttcctattgggttgtctgagctcttcatgtattccagttattaatcctttgttagatagtttgcaaatattttctcccattctgtgggttgtccctttcactttactgatggtttcctttgctgttcaggagctttttaatatgatgtaatcccacttctccatttttgctttggttgtctgagcttgtgaactatgattcaagaaatctttacccaatccaatttcctggagagtttccccaatgatttcctttagtagtttcatagtttgaggtttaagtctaatgcattttgatttgatttttgtatatggtaaaagatagggttctagttgcagtcttctgaatatagatatccagtttccacagtaccattttttgaagagactgtccatatcttaatgtatgttcttagcacctttatcaaaaatgagctcactgtagatgtaagaatttgtttctgagttctctattctattccattggtgtatgtgtctggttttatgtgagtaccatgctgttttggttactacagttctgcagtataatttgaagtcagttaatgtgattcttccagttttgttctttttgctcaggatggcttttgcaattctgaggcttttttggtttaatataaatgttaggattactttttctatttctgtaaagaatttcattggtattttgatagagattgcattgaatttatagtttgctctgggtaggataaacaatttagcaatattgatttttccaatccatgaacatggaatattttcccatttttttgtgttctcttcaaatttttatcattgttttatagttttcattatagaaatctttaacttatttgcttaagtttattcctaggtgttttgttttatttgcagctattgcaaatgggattactttcttgattttttttcagactctttgctattgtcatatggaaatcctactgatttttgtaggttgattttgtacaaaaatcaactccagcaactatactgaaattgcttattaattttaatagtttctcataaagtcttttgttttttccaaatataagaccatatcatctgcaaacaaggataatttgatttcttcctttccaatttggatgtcctttctttcttttgtctgattgctctagctatgacttccagtaccatgttgaataacgggggtggaaagtgagcagtcttgtcttgttccagatcttagagaaagggctttcactttttcctcattcagtatgatactagctgtgggtctgtcatatatggcttttattacgttgaggtatgttccttctatacccagtttttttgaggggtttttatcatgaaggatgttaaattttatcaaatgctttttcaccattaattgaaatgatcatagggtttttgtccttcattctattgatatgatgtatcacattgtttgatttgtgtatgttgaatcatccttgcacccctgggataaatcccacttgctcatgatgaataatattttaatgtgttgttggactttggtttaccagaatttggttgaggatttttgcatcaatgttcattaggagtggcctgtagttttcttttttttaatgtgttcttgtctgtttttggtattacagtaatactggccttgtaaaatgagtttgaaagtattcctttctcccctattttttgaaagtttgagtaagattggtattatttcttcctcgaatgtttggtagaatctagcagtgaagccatcaggttctgggcttttccttgttgaaagatgtattatggatttgatctcattgtttgttattgttctgttcaggttttggatttcttcatggttcaatcttagtgagttgtatgagtctaggaatttatccatttcctctaggttaactaatttattggcattcagttacccaaagtagcttgtattttttatttctgaaatatcacttgtaatgcctcctttttcatctctgatgacatacaccccaagtccactggttccgagcccagcagagtaccaggacttgccaaggaattgcagtccttgtggcctagactgcctttcacgtttatctaggatcccagagtattttagtccgtggtgatgacgcttgctgaaactcaggttcgtaccaccaggatagaagacttgcctctggctaggactagtctaaatgctccctctgtgggcaccagctaagttcttccctgtgtggctttccactgtgacagggcagcactgagttccaaggcaaattcccacaatcactgcactctccctcatgcaagtgcacagattgtctcttaacaccacatggccaaaggtgaagtacgggaaaggggtggtataggtgactcaagattgtctttcaaatcctcttcagtgcctctttccttaatacgatgttaaagccaggtaccggttcacctgttttttgcttcttatgaaggtgcttgttttgtgtgaatagttgttcagtttggtgttcctgtggggggatgatcgctagaggattctgttcagccattttgctcatcaggttaatttcttatatatagcctatatttaagtaattttataaaatttcaatgtgaaaatctgtcctttaattagtatgtttaggtgtttacatttaataaaactattgatatgttttcattaaggtctaacttttttgtttctctttgttccctttgatttttgttgctctttcattttccttcttattgtattacttgaacaatttttagtgttccatttaaattatgtattgtgattttgactctagattaatgttttaatggttgccctagaaattataaaatatatacctaactttccagactaaatcaaatcaatttttattcaatttcttatttttaaatatattctaaattatgtttaaaattttaacattttaaaaactttagtaatccaatacatttcatattttaactttccagactaactcaaatcaatttttattcaatttcttatttttaaatatattctaaattatgtttaaaattttaacattttaaaaactttagtaacccaatacatttcacattttaatgtaatggaaataagaagtgcatttatttttagtgttgactttgctagttattgtttatatcatttgactttgctgtgctcatttaagagcagctttgacatttgtcattggttatggaagttttatccagacagtagattttttaaataattcaagcacttaaatgtctacatataaagaattatacacgtgaatatactattgtagcacaggtgtttttgataattaaatgccaggcaagatattggtgtccctgcttgatgcatgttcttattatagcctaatagttttgcaataaaatgtgaaaggtacatgcatagttaggaggattattatactctggttgctgacattttatattaataataaaaactgcaggctataggtgcctgtgattctgttgcagaataaaatttcctattactcttttctcatgttgtgatcagtttaattgaagagtatcctgaaattgctagatctatactattaataagatagttatcatatttaactatttatttgtatcaataaatttttctcaatagtatgtcatcaaaacaaagtacagaaatgagtattacgttcagggtgataactaatgtgtaaatgaaacaggtcaagtgcctgttatcccaaaccttgtgtaaaagacaaataataaacaaacaaaaattgttcaatttatcaggtgataaaaagcactaaaaagaagaatacagttggcaatgggcagacaatcaaagcgagatatgtattgttttagatatggcagtcaaaggagtcctccttaataagatttcatttgagcctatactcaaatgaagttagcaaagaagccatgtgggtagatgatagaagcaatttcaaatattggaaatattgaagtgcaaagattcaaaaaacactaactcctagaaggagtttaacagataagttgattaaaaaaaaatcaattcctaatggcagactcagtgatccagaacagaccctatgttcattttccagtttttgaatacatgggctcaaatgataatggaaataggcaggatctccagcatggttccccaatatgtgctctaacagctattttgttaatgagtgtgaagtagaactattactccctttctttactaaaatgataaagaaaaggaaatgtatactcctgggggaatttcagaggttgactatatgatgaataactttgtatgtgcagtcacactgattattttcactggcctgtttatttcctcactgtgattaattatatcatggaaaccaactgagtactactgaaaatttaaaattatagtagaattttcttactgtagcagaataatgaagtccctagcacatggtcataactagctaattaaccaagccaatgcatttttctcaggcctgatcacagatactgcaagaggctgtctgtccttactggaaaggacagcagtatacttacagtcctactgcaggagtagataaactccacatctcagtgttaaaaatatgattcccagagattttaactgcttcacaaccccacagtatatcacaatgacaatgatatgatgtaagtcttggagaagccatggaaagtgtctgagacatctcattcagatatatacataaaagagacaataataaacattcttttaaaagaggtttgctacctaagtctaatttatggaggtctgcatgttggaattgtctcccagaattaaaggttaacttgccacaccttacttaccattaccatcaccagcaagcatggtgcaaaggctcaacttcttaaaaaataaaaacaacactcacaacttgattattacacatccatacttatgacacaacactcttctactaggtatatgttgcagggaaacttgtacatgtaaatcgatgaacagacacgtctaaaaatattcatagaagcatcgttcgtaatagcattcatagaaaaaaaaactgagaataatttataactgtccaaaatcaggagactagaagaaaaataccagtatatagaaataatggaaagccataaagcacagaaaatgaatgaactatatcaacagccatgaacaaaaataaaactctaaaacatgatgttcagtagaagcaaattttataacaatatatacaacatgatttcatttatataaagatcacctatataaactgacaaaactaaatgatagattactggcacaaatttaagtggcaaatccttaaagagaattaatacaaaattaatattgtggtaatccctcggaaagatggaggacattgcaattgcgatggagtatataaaaggcttcttagctactggtgtattttcaatttttaacttggatggcggatccatggttgttcatgttcttgttttttaaacctatagtacttattttatctatgtaggggacctgaaaagttcctagagttgagtagagcatgggacaataaaaggttctccagtagattgctgtgacagatactctatctcttggagtctatgacatggtagattcaatggaatctgaagtactgttagctaactgagacatagaagcaacccttcagcaggtatgaataaaagaaaagtgtcagtctctagggttttggaacagtgccatacccccttcagcaagtagcatctgctaagaaacaactcctggattgctaccaaatggatagagaactgactaccttgtcatgagactcagggatcatctggcctgagcttccagtcatgaactggaggttatctagttcaataaactataagattaggtattttagcattaaaaacatttgtacatagatctttatcatattctcacaccagctagaaatagactgctatggtattatagctatcattgaagatgaacccaaagggcaatgaaaaagggaaattgtcccagtggccaaaatttgagtagtatattttgttcagtttacctggaaacagaggtaacctaaagaaaagatacgatactagttctcctgaattgaaagctgagccagccacctaggcagtttgaattctacatacctataggcaaactagtaaaatggtcaatcatagtgttggctgaggtaatttatgctggttatcaaggtccgttgaaatggtttgttcatacatagcgcatgcctaaaggagtatgggaagaggtaaggaaattcctgggacaactcaagtactattttgaccaatcataaaatttaatacaatttttaaatttttaaaggcaaagaccctcagtaaactaaggttcttgaattaagaagggaagtcataagttacaactactatgaccaactagagaactgagaatgatagcctgaacctatatttctttgcttgctcctagaatgtaacactcatcttccccatacaaacaatttccctataaagtcaccattatcaaaattttaaaaacatttcttcctcttcctttatgccaaatcacaatagaataaagggaagactgctaacacggtgaaatcccgtctctatcaaaaaaaaaaaaaaaaaaaatttagccgggcgtggtggcaggcgcctgtggtcccagctactcaggagactgaggcaggagaatggcgtgaacctgggaggcggagtttgcagtgagctgagatagcgccactacactccagcctgggagacagagcgagactccgtctcaaaaagaaaaaaaaaaaaatactggacttagtgaacagcagctcaagcttgattgggatatatgtttgggtagctgtggaggatgctggagatatccttagatcattttcagaattattctcattatcaatgacagaaatccatcttgaaataacatgaaaatgggagagaaagagattgagattgattcattgattccaaaaaataagggaaaaggaaaaatttttgtagggattgacataagttgaagttttgacactgaaggactttctctttctaccatcatttctatttcttgtttttctctggaatcatggctatttccatctgtggctcacatcctataaaactaagaccaaagtggaatggatacttctgcctgggatcattttaaacatcgttctcatgccctaaaagattacctttgtgaatggtttcttccaattacataagactaagattcacttaacagtgtgtgtatagctaccaattcaagcaaatttaacaaaccaaactagttcttctctgtgtcctcctgttaaatatggattaaaaatatatacttgaaaactcaaggtacataatcaacagaatttccagtttcaagtcttaaacagagattatgagtattaactaaaagcaaagtcgttattaaaaagtaaacattaatataaaagaattttcaaattatttctggagtttttgatagcaaagatggtagcacacaaattcataatttttacttgcatatacaatacagacaatctgtagtgtcagctttttaaacaaaatactttaaaagccattttaagttataatttctaattagtagatattatctgtgttaaaagttcctttgcttatatattcagtatgaataaaacaggtttaactctggcattagtgctgtccctataaaaaaaacacacatttatgtacatacaaagatagctactaaaacaaatattaatattgagagatataaaaacatatttaataaaaataataactatttaaataccttattgtcatcatttaccattcctcatattacactattttagggatggacacagtcatttatatgttctaaaaagttatctatgccagaaattatttcatatttaaagcaatcattttaactgtgacatgactttttcatgggagcttccttagtttaaattaaaaaaacaaaatagattactttactgcttttggctttttgttgttcaattccttacccttgcccagaaacaagactacatctttgccctttgttgatattgctgctcaagctcattatcacgtgaatatctggttattgttttataaatgttcattttctagaagctcactgtttctttctttctcaacagtcgactttacactagccacactcattatcatcatgtggcagtactgctcttcctctgcctttgctgctttaaaaattaatgcactgttattttctgaatactgcataagctgcttatgagtacattatgctatcaagcaagcacatgcagaaaagcttcctaaactgttattctttcaatgaaaatacagctggttctgcttcaaaggcacatcttttcacctgcaaatggacttgctcctgcacttattcctcaattcattgtcttttatttgtgtctagaaatctttaattgcctttaattagaaaaaagtaaattcagtgctttaatcttgcaaatacattcaatcataattctgtctgggataaataccaagttctattcactgtctgatctctgtaacaaagatatataatttattgtccatttatatagaccacaccaattaagatacaatagaaaagcagagagataagagtcaaaatatttgaaaagaaaaatttgcaatctaaatttaattactcaaatgaattattggaagatgagttatttacagcatgccaaaaatactggcaaataatatttggtaatcaacaataaagacttttatatttccttcaacatttttagaataaatctcaccaaatgcttccaatccctcctcccttcgtcaaaaagcaatatactacttggaatcttacttttcttgtattacctaagttacatataaaagtaacacaatttgtcatataaagtaaatctgcagctgccatatgaacacaatgtttagttattatattgcaaactacaaatatctaaagaagactcattacaaaactaggggtcaatagtctttcgtatggaatcttgttaaaaaaactctagtaactatgtcagtaaacaaatggcctgcattttaacaccttcaagatgaataaaattacaaatgctcacaggaaaataactaggtaaaacattaaccaatcaaattgataaaatgaaaataactacaaagccagaaataatccaggagattaccatcagcataacgtacctttacatttaataaatcgtgcaaaggataacaatttccttaaagacaaaaagcaagtattacctacaaaggtaaactacgcaaaaagtaaaacttctctcaaaattatttggagatatccagaatatagagagcaggctggtaaattcatcattgaaaataaacatctcgggcaaatttttcattttaattttgttatagaaacaattcaaaccaatgataatttttcaatgcttggacataacagcttgtcatgcattaccattacagaaaacacatcatcatttaacaccacattaagtactaagaaacaagcactaagcttagagctgctaaagataaaccaagttgctcataaaatacaaattaatttccaagaaaattcatattaaaaatgctaaccaagcaaaaatttatacatggaggagaattatagttaaatagaagatgttataaataatatcaatcttgagtttgcaattagtactcaaaaaagtccacaaacatttaagaagtggttgtatccaaggtacccatggggatgtagagaagtaaaagaaagacaaacaacaaaaagaataacagggaacctaaaacgcaaaattaagaaaaattaaacaacgacatgtttcagtaagtattcaatttagttaaacatactgcttactatttcaagaaaaatgataaaatactcaaattaatgtaaacaggttaggttaaacaaagggtatataaaattgtaatcacctaagaattaggacagttgctttattgattatttaaatatttattaagtaccttctgtgaacatcattagagatgccaaaaaaaattagatggagcttctgtcttcaagactatttaaattctagtaagtacaattaaaaaaatatgtgaaagataggagaaagtaatcacatttagaagtttaaaaatccttattgtctaagttaaataaggatattaatatactttattaagtcaactatgaaaacttgagaatctcctctccctttcccaaaacaaggaaagaaaagaaaagaaaaaaaaggaatggaaaatgttgaaaatttgaagaatgaaaaaggaaacatagtcaaaaagtttcaagaaaaaaggttagagcggagattagcaaaggaaaaatcactacaaatgaaaaatataaataaaaatgtgaaaatatatcaagatttttaattcatagtaaattatatagaattaaatttgcttgcttgaaaacaaagattctccacctatattaaaaaatcaattatatcattaatttatagattaaaataaagggataagaaaaatacaagagtacttaacaaaataacaaaaagtattttaccaatattaatataaaacaaaaagaagtctaaacagacacttcataagtactttataaataaaaaggtcattatataatagaaaaggggaaattatcataaatatataccaatttacaaatgctaagcaacgaaaacatagcttcaaatatataaagcaaaaactgatagcattacaagaattgaaaactatagtcttggggtattttaattctcatttttcactaaatgacagctaaaatatataaaaagtacacaatagagttgaaaactataattaatataagtagtactgaatcctaatattagagaatacctattcctttcaagcacagggaatgttaacaaaattgactgcatactaattcagacaggaaatactaatatcaaaaactgatatcatacacaaaacactgtcggtacaagaaacaaggctaaaaatcaatttgagaaaaagtaagagtggagcttttgaatgttattaaagttaagctattattagcttaaaatagactgttaaacattttatggaagcctcatgataaccacaaagaaaaaaaactaataatagatacagaaaagataaaaaaaactaatattagattcagaagagataaatagaaagaatcaaagtatatcacaacaaaaattatcaaattgcaaagatgataccaagcgaggaagagaggaacaaaagaaatacaaaacagacaggaaacgattaacaaaaaatgacaataaaaagcccttactatcaaaaattactctaagtgcaaatatattaaactcaccaatcaaaatatatagagtgtctcaatggataaaaaaaggttcagttatatgctgtctataaaagactagctttagatttaatgacacacacaggccgaaagtaaagagatggaaaaagatattccatgcaaatcgtaacccaaaaagagcaggagtagctatacttatatctgactaagtagaatttaaaccaaaaactgttacaagagatgaagaaggtcattacataatgataaatgaattaacttaacaggaagatataatgattataaatttaaaaatacacatatatgcatatgtgtacataaataaatatacatatatacatatatatgtgtatatatgtacatacatgtatatgtatatatacatatctacatacacaagtatatatgtatatatgagtgtacatatatatgtatatgtgtgtgtagacatatatatatatatatatatgcacccaacatcaaagaatctaaatacataaaacagccatggaactgaagaaatagaaagcaataccataatagtagtcaaaaatggatagattattgagacaaaaaactcaagaaaaaaacacagatttaaacaatactacagaacaaatggacttaacaaatgtatacagaacattccaagcaaaagtaacagcatacatattcttctcaagtgtacactaacattctccaggataaatcacatgctaggtcacaaagtaagttttaacagatttaagaagactgaaattactccaagtatcttttatgagcacaatagaataaaactagaaatcaataacaaaaggaaaatgggaaattcacgaatacatgaaaagtaaacaaggaacccatgaacaatcattcagtaaaagaaatcaaatggaaaataagaaaatgttttgaaaggaatgaaaatgaaaacacaatataacaaaattaatgggatacagcaaaggtagtactgagaaaaaagtttattaacaataaacaactagatttaaaaagaaatatctcaaataacctaactttatacctcaaaaaattagaaaaagaacaaccctaagcacaaagttgccaggaaaaagcaaaatagtaaagattctggcagaaataaatgaaatagagaatagaaaaacaatgtggaaaaaatcaataaaactcatcacacacgaaatagcagacattacaactgatgccacagaaatgaaaaagatcataaggggcatttataaacaattatacaccaacaaattgaataaactagaagaaatgggtaagttcctaaaaatatgcaaccaagcaagaatgaatcaagaagaaatagaaagcctgaaaactagtaacaaatgagactgaatcaatagtcagaaacttcccaataaagaaaagcccagtactagatgacttcaattctatgaaacattaaaaaaaaatccttcttaaagtctcccaaaatatggaaaaagagggaacaccttcaaactcattttataaagctagccagcattaccttgatttgaaagccaaagacaccacaccgaagaaaactactgaccactattctcttatgaacataaaacaaaaatcctcaagaaaatattagcaaacaaaattcaacagcacataaaacagatcatatacaatgaccaagtgggatttatccctgggctataaggatggttcaacacatgaaaatcaattcatatgataaagtacattaacaaaatgaagaataaaaatcacatgatgatctcaacaaatgcagaagaagcatttaacacaaagttcaccaggaacttaaacaaatttacaagaaaaaaaccccatcaaaaagtgggcaaaggatatgaacagacacttctcaaaagaagacatttatgtggccaacaaacatatgaaaaaaagctcagcctcactggtcattagagaaatgcaaatcaaaaccacagtgagacaccatctcatgacagtcagaatggcaatcattaaaaagtcaggaaacaacacatgctggagaggatgtggagaaataggaacgcttttacactgttggtgggagtgccaattagttcaaccattgtagaagacattgtggtgattcctcaaggatctagaaccaaaaataccatttgaccaagcaattccattactgggtatatacccaaaggattataaatcattctactataaagacacatccacacttatgtttactgaagcactatttaaaatagcaaagacttggaaccaaccccaatgcccatcaatgatagactggataatgaaaatgtggcacatatacaccatggaatactatgcagccataaaaaataatgagttcatgtcctttgcagggacatggatgaagctggaaaccatctttctcagcaaactaacacaggaacagaaaaccaaacaccgcatgttctcatgcataagtgggggttgaacattgagaacatacgagcacagggaagggaacatcacacaacagggcctgtcagggggtggggtgtaagggaaaggatagcattaggagaaatacctaatatagatgacgggttgatgggtgcagcaaaccaccatgggacatgtatacctacgtaacaaacctgcacgttctgcacatgtatcctagaacttaaggtataacaaaaaataaaattcagcaccatttcatgataaaaattctcaataaattaggtatagaatgaatatctcccttctttttttctagtacttttatgtcttatatttgccttttaggtatagaatgaatgtcccccttctttttttctagtagttttatgtcttatatttgcctttaattcatttttatttcttgacattggtcttggctatgatttcttggatgtaacactaaagaacatgcaactgaagcaaaaacaaacaaaggagactaaattaaactaaaaatcttctgcatggcataaggagcaatgaacaaaataaaaaggtaatctacaaaatgggagaaaatatttgtacaccatgtacttgagaaacagttaagtcaaattatataaggaacttatattttacaatagtaaaaaagacaacttgattgaacatacctgactagaaaatggtcaaaaggtctgaatagacatttctccaaagaaaatggagaaaatgacaaacaggtacatggaaaagtcctcaacctccctaattatcagagaagtgctaatccaaccacaataagataatgtctcacacgtgttaggatgactatgttaaaaaaacgtaataaatgttagtgaggatacagaaaagacagaatccttgtatattcttagtagaaatggaaaaaaatagtatggagattcctctaaaaatcagaaatataactactatatgacccagcaatctctctcctaggtatatacccaaagaaaataaaatctccacattttagagataccatgttcactgcagcattattcacaatagccaagatatggaaacaacctaagtgtccacagacagatgacggaatcaagaaattattttatacatatataaaaatatatttcaccctttaaaaaggaggtcctgccatttgggaaaacatggatgaaattggaggacattatgctaagtgaagtaggccagacaaagaaagaaaaatactgcatgatctctcttatcttttcaatcttaaaaaacggatgtcaaatatgtagaaaaggagagtggaatggtgttagcagagttggagggaaggggaaatgcagagatgtaggtcaagggtataaagttgcaattatgtaggatgaataaactatagatctaatataccacatgagaactacagttaataatattgtattgtacactggatatttgctgagagtagattttaggactcttaccacacacagaaaaggtactatgtgagatgatgcatattttaattggtttgactgtagtaatcatttactctgtgtgtgtatagcaaaaagtgatgttgtacaccttaaatacgtactataaacattctttttttttttttgagatggagtcccactctgtcacccaggctgtagtgcagtaacatgatctctgctcactgcaagctctgcctcccgggttcccgggttcacgccattctcctggctcagcctcccaggtagctgggactacaggcgcccatcacgacgcccggctaattttttttttttttgtatttttagtagagacagggtttcaccatgttagccaggatggtctcgatctcctgaccttgtgatccacctgcctcggcctcccaaagtgctgggattactggcgttaagtcaccgcgcccggcctgtactatacaaattcttaattggctatatgtattccaaatattttttactttgtttgcatgtcttttgtttttcagaaatatattttgctttatagagcgtactttttgtgtcttatttatgaaatagatatatactatattttggtatcaattatttatatttattttctgacttctaatgtaacttctttgtttatcctttagttatttagaagtgttatttttattaatttattttgtatttccaaagcaatggtacagatggaaaaaagtgcactaaaggagagggttgggtgaagaaggggaagttacctttttgcttctaactaatttctaatttactacatttgatttaaaaatgcagttataggatattgattgtttataacttgggatactttctttgtgacttagtatgtaggtaggtaattttttagaaatactccatgtatccttgaaaagaaaatcctgcacctagagcctaatttaaaatagataagcttcctgttatcttcctgtgctaagtgagcttttctagtccaccgttctactagggtagtatctccttgagggtccaagtatatttgggagtctcaattccatctacaaatccttatttccagtcttccttaatccttctttcacatatgacctctggagaattctctttctttttttctgaactcaggtttccatataaaagaacatttgttctactttatttagcatattttacaggagaattttgaagttatcaaattattgccaataagagtcaacagaattaaaagttataatatgtatacaaaggaatgatttaatggattataaaatcaaaaatgctgattatataaaagcattcagcctaaagaataatatttattttttgttttattaaattaattaaaattataagagcactgaaaaatcgtaagtacatgaagttcatatctttactggtaagcaggactgcatttaattttgcttccataaaactctataaagtcctttttcactcacatatttctgtgtatcatatgtattagagaaaatttattttcttaatatgcataattgtgtttttatctcaattaataggagtgtatcaaagataattcattgcttaccaatttgttttctgtactgatcaacaggaagttttatagtagcagcatcttttctacccatctttgatctccaaaatgcctgctgaaaagaaaacaattataatgaaaatttttttaaaaaggagtgtctataaaatccagaaatagtttattctataaaattcatttttaaagcaatgggtacaaatactttgacttatttccattaaatattcataaagaaaacaaaattcttttaaataaattatcaatgatacaattgctggtaattaaatttctcaatcatttgtttttgataacattcatcttatcaagtactatcagtgttccattaaaccatattgttaaataacattatctgtaaatatgaaaatcatgtagtatttacttagataggttggggcttttggcatacttttggcaacatgcttatttccaagtatatatagtttggatatatacttactatgttacattaaaagtaaggctaaagtttgaatctcaagtattttgtattttattttaaaaagcataacatatacatacaaagcagatgaatttcagttctagttctgcccctcttaatgtaaacaataaaaactactaccatttattaatattttcatgcttattaccttatatgcactgttcgatttaatctacctatttttattgatatacaatagttgtacctactttgggtggatatatgtaatattttgatacctgtatacaatgagtaatgaccagttcagaataattgggatatccatcaccttatttacatgttctttgtgttgggagcaaaacaaaacttctcttctaagtatttagaaatacataataaattattgttaatcataattttcctactgtactattgaatactagaaattattccttctactctaactgtatttttgtatcccttaaccaacttctctaccctctacccacttcccatccctggctctggtagccattattctactctctacctccatgagatccactttttcagctctcacaaatgagtgagaaaaagcaatatttgtctttctgtgcctggcttatttctcttaacataatgaccttcagttccatccatgttgctgcaaatggcagcgtttcatttataaggctgaataatattccactgtgtatagagacaacatttttgctatccattcatctactgatggatgctaaggttgattccatatcttcgttattgtgaataatgctgcaataaacatgagagttcagatatgtcttccatatactgatttcctttttttggatatatacccaggagtaggatatctggatcatatggtagttctatttttagtttattgaggaacctccatattgttttccataatggtgtaccaatttacattttcacccacagtgtatgaccatttccttttttctccacatccccaccaacacttgttattttttgcctttctgatagcagccactgtaactaggatgagatgatatctcactgtgctttcaatttggatttccctaatgattagtgatgttgagaatgtttttcaaatacctgttggccatttgtatcttcttttgaaaaatgtctattcagatcttttgcccatttttaattgaattgtgttttgctattgagttgtttgagctccttatatattctgggtattaatcctttgttggatgaatattttgcaaatactttctcatattttgtaagttgtctcttcactttgttgattgttttctttgctgtgaagaagctctctagcttgatgtaatcctatgtgtctatttttgattttgttgcctgggcttttgagatcttacccccccccacaatttttgccagaccaatgtcctgtagtgttttcccaatgtttttttccagtcatttcatagttttatgtcttacatttaagtctttaatccattttgagttgatttttgtatatgatgaaagatagagaatctactttcattcttctgcatatagaaaccagttttcccaggaccatttattaaagagacaatcgtttcccacattgtaacttcatagtacttttataaaaaatgagtagactctaagtgtgtggatttagttccgggttctctgttctattctattgatctatgtgtctatttttatgccagtacccaattgtttcgttactataaatttgtagtataatttgaaatcagatagtgtgattctctggcttttttctttttgctcagaactgcttcagctattggggatcttctggggttccatgtgaattttaggattgttctttaggatttttgtggagaatgtcattggtattttgatagagattgcattaaatcagtagatcactttgggtagtagagaaattttaacaagattaattttatcatgaaggaatgttaaattttgttgaatactttttcagcatctactgaaataatcgtatggtgtttattcttgattctgctgttgtgatacatcatgtttattgatatgtgtatgttgaaccatccctgcatcactggcgtgatccaacttgatcatgatgcattatcttttgaacgtgttgctgaatttggtttgtagtgttttgttgagatttttacatctatgttcatcagcgatattaccttgtagtattccttttttttattgtgttcttgtctagttttggtatcagagtaatgccagccttgtaaaatgagtttggcagtattccctcctcttcaatgttttgaaatagttttagtagaaatgggattagttctttaactgtttggtagaagtcagcaatgaatctatcaggtcctggacttttctttgatggaagattttttattcctgcttcaaactcatgattcatttttggtctgttcaactattctgtcttgtcatgtttaatcttgataggttttatatgcccaggaatgtattcttttcttctagattttgcaatttgttggtatatagttgttcttagtagtcgctaatgatcttttgcatttctgtggtatcagttgtaatgtttcttttttgtttcccattttatttgagttttctcctttttttccttgggcaagcaaaggtttgttaattctacttatcttttcaaaaaacaactttttgttttgttgattttttttgtatttttttgtcacaattaaaatttatttctgctctataagttttatgatttttattgaatttaaatattgcagcagagagtacaacctgattaccacattcatattctccttttcttcctagcacagactctatttcctagcctcaattacaatatgtcattattcatagaatacaatgttacagtcgtaagtattcttcaaactggtgtctgcaagttgttcctcattccttctagtaaggcattacaagatgaagatgaagtcagacaagaactagtcatgtcacaagcaaaaatatagagaatagaaagtccagtaatttggggctaaaaatgttggaaaagccaacttcttctgagaaccaacaggagaaaaatgaaaacaggctttgaagaacaaagacccatgaaaacttatcagcttaaaaaaaaagaaaaaaaaaagagagagagagacaaagagcagattaggggttttcactgtctcacctgagcctattatttcagattacttcaaagcagacactattgggtagaaaaagagaagtcaaggagttctaaagcacagaaagaaagtggacatgagaattaggtctaggaaagaaattgcactgtgtttattggcacatgcaactgagtagaaatggtaagaaggttactaaaatgtgagggaactatatttactaagaaaccagaaacataatctaaaaaagtctttgaatgaaagccaacttttgggcctctacatttaaaccaatatacagcagtacccaaggaaggcaaactctatagagtttataacatccacttcacacatgactagaaaggaataaccatccagaggggagagccatgaagaatggacaaaaagaccataaactgaaacttctatttcagtatagtggatcttctcagtggtctcgtgagcagaggttttatcatcacaatggaccaatgactcctgtggctgttttccattcttccctttataaatgggaatgattattgcaggtataaagcagttatccactgcttaatcattatttcttaggggttttgtgatgctggggaggagtagaaaaatgtcacaggcaaattgagagaggactgtgtgttagcttgagatccttggcttggagctagaagcaataaatgctagatgtttaggttctctctattggggagacagaaaaaaataatgtgcatagttatttccgtgccagaaagataaattattaaaaaaactgttggctactcactaaaatacatgttctcctttttttttcctctgggtactcttgactaatttcccagcctcctttgatgttagttgtggacacatcacttattttcaaccaacagaatgtgagtaaattaatgtttcctacttctagaactgacctataaaaacgttccttgcatactcatttatctggatgaaatggagatgacctctagggtaactctgaacatgagtgatgaagatgatgacagcctggatcatgaatgactgcatggaggacagctatccaaccaacttgtttttctgtttcatattgctgtgataagaaaaaataaatttgcagcatttgcagtactatacatttttcgcatttatttgttacaatagttgtcatcactgaaactaaaacaaacaagtatagatgtttccatataaactgatgcaattatcaaactgtaatttttctaaagagctttattaaggttctaaaacactaaatgcatttgaaatctgtccagacaaaattgtattgtttatctatatatattgtcacacagatagttaacagtgatcccacccaatacagtgaaagccatctccaacttaataatttttatccatatgtgacaaagttataagttcagctaaaaacctatttttctaatcataataatcttcatattcatggtattattgcaatatctaggaatattcaaattatgacaaagtcaaataagttaaattttcatctctaataaaccatgtagttattacatctaagaaaacattttaaaattctagcaataaaatcaagacagcacctaattctatagtcttacttcttataattcaaaacattaaaaataattctgtcaagacaagcaccataaaaattgtcaatagatacattataatttattcatatagcaatcctatttgcatagtattttgcatttattaattgtaaataggaatcaagttattttaatcttaattgtgtgtggctagggaagataccactccattttaggagagaagttggattaaatgaataaacactcaagatattattcccttttcaatttagttttgttttttgcctttacagactatgcttaattttttcttaaagcaaatcactgaggctatctgccaaaatggttactcattatgcttcccccaattcctttctagtcatttaagccaacatcccagcagagataacacttcagaagtcaatactttattcattcactacctacagaaaataaaaaagtaagaggtttatcaaaaatatatttttaccaaagtagctgaattttacttatatgttaatatactttacattaaaaattatgccacggaaaaatctaaagaatctaaattttcagaggggcctatgctttatgaacagacattttataggtataataatcactgaatataaaagctataaaagaatttcaaccaagatacattagagaaaaactggtttaaaatttttgttctagttatttttagtggtttggtattatttaatcaaaatttcaaaatttaaactttctcattgtctttgaaattattatattctatacagtaagtaaaataacgttttaccaaatgataaaacaaaaaatgcttatagaacacattcttacataaattacttacattttattagctgcaagaaacacacaaaaaaatagaaagcattttgccttactaataaacacattgaggctattttaaatgacctaaagagatacctattcatctgtatgatgcaaactgtcaatgactcagacatgtagaacctttaaaatgttctgacttttctttgttcttcaaagccttgcagtaatcatcattcatttctattgctttgatggttagatagcaaactcccaagaaatccagggagacattagcacatacagccgcaatttctaataagacagctacttgcatacaagatcagccacaatttaaaatgtgttgtgatagatgcggaaagggaataacagacttatattagcatgtacaataccaagattgttttcacaatttaattccttggagattatgtctcatcaccttcttttgtaaagaacactgcattccctgaggaactaacttgctctgagacctagctaaactgaaatatggattaataagataatatttattatttatgaattttgctgtaggaatgatttcagattaaatcatcacagaagtttccaacattcttgaaacttgataacacatatttaaagaagaaaaatgctgattttatttaatacttaaattggatattaaaataattcagttaatttttatctaattaaactttacactcattaggacttttaagattaaacatagcattcttgtttttagtatgctttcttaacctgaattttccagagcaattttgcgaactgtattttaaagcataatatgtgacctttaaaaacaaaagtagtattatattcaatcaccttccgaccaagttattttattgctcatttataccttttttatgaaatccagaaagaacaagtaaagaaataagaaatctgaagccttcacatatgtctctgcttccagaaaaagcactaaatccagactgtgacatttaaatacatatcaaaacacaggttattaaaaaaagttcaacccatgtccacagaaaaaataattatcttagtttttaaggctaaaagaaatacacttactaagaaaactcttcgctaaacgtgaagctatagttaggcagaaaaggtatttggttatggctgcatcaaagttgagaaccaatcatgaaaatacaacctcatgctagatgctgaggatataataaacacagaagatatttgtccctgatcttatcacacattaaccatttccagagtattacaaatttaaagttgttcattcacttaacatatttaagtcattgaaatgatgacacatttcctagataaagcaaaaatccttaatattaagaactattaatgatctgaatttgtcatgtgttcctttctcatgttccagtgcactaggaaattcagcttttacttccttgactttgacaagctcattcgtgtttccaggaatttactatgttctgcaatttgctttaaatgtcttttcaatacatccccacttgtgaaacctatatattgtaatattgcacacaagagtcatctctgagtaatcattcagatcttgcctaacaggcatcattcatgattcagatattcagagatagttctccacacttaaggaaatgaaaaaaaaagtcttttgaaagactatcaagtgtgaagtggacaaggtatacacaattataatattaaaatgcagtattataagtaatattaattatttcaatattataagtcatattaattatttcaattaattatatgtattactcatattaatagtattatcatattgtcattgagacaagttattacactgaggaacaaattcgtactgtataaaactggagagctaaacagttgttattctaaagttttcagagatcgaagtgcccagttcacctatactttgacaaactaatgtcctttatagcctcagaaaaagtatctaaaaactgaaatatgcaaaaagatgatttctaaaatcctgatcacttgccaacattgatatgaaaatttatacaaaaagtaagtacaggacacttatctgtgtaaacctaaaaagtcatgttccagaaaagaaatcttagtcgttgggactcaccttccagccaaactacggaactaaaatacagtattaggaaatagtgctagaacaaatatatttcttcatgaaaaacaaaacaaacaaccaaaaatatttaacccctatctcatatcatacacaaaaattaattgaagatagatcatacaactgaacgaagtagctaagacaacaaagttactagggaaaatattatattcatgactttgtagaggcaaatatttattgaagaaaacatagtaggatatatcataaaagagaaaaaaaggatgaactggattacatcaaaattaatatttgcttatcaagacaccaataagaaaataggttattacagatagatagtattcataacatatgtatctgacaaaataatttgcatccagaatgcattaaaaaactatttaataatgtaaggtatacaacctaataatttaaaaaggggtcaaaaacttgaacaggaactagaaacttcagcaaataagatatataaatgacaagcacatgaaaaagttcttaacaacagtagtaatcagcaaagtgcaaattaaaattagaactgagattctactacatatctactagaatggctcaaataaaaaatatttcatatacaaaatattgaagagaatgtggagcaactgaaatttctggtacaacttctttataaaattgactgttcctacaaagttaactaccagcaatttttgcacttctattctcagatatttatgtaagagagataaatgtatatggttacaaaaatactttctacaaaaatggtcatggctgctttgttcataatagttgaaaattgggggcatggtggcgggtgcctgtggtcccagctactagggaggctgaggcaggagaatggtgtgaacccgggaggcagagcttgcagtgagccaagatcgcgccactgcactccagctggggaacagagcaagactacatccccaaaaaaaaaattggaagcagccccaatattgatcaacagaagagttgataaactgtggtttattcatacagtgtaatactaccaagccaaaaaaaaaaaatactgaacataggcaatagagataaatctcaacaatgttatgcagagaaaaagaaaccatgatgtctctgtacttaaatggtcattcatcagtgttatttgttcttgtagcatcacttgacaatggtgacctctactcccttgaaaatacttgaaaaaaatatttcctatgggctaaagaataagtgagaggtaagaaagcagaaatgaaaattacagaccaatccattataaaataaatacaaggaaggagacagatagcatagtaagtagaaaggaactgaggttgaggaagagattttttttgttatactttgtttttactctttagggcttgtttctgattaaagatgaaaatttgagttggtctaaataataattgggaggaacaaccagaaagtgagagggtgaaaatacagaaaaaaaaagtatgaaagcatagaatccagtattcatttcaagtaataatcatagcacactacgtccatgagtcactttaacaagaaaaagagaaaataacaggcaaaattatacataagacttgaggtctggtaaccaaaagtagagggatatctatgcagtagctctgttttcactatgaagtaaaaggcaagattatctccttatgagagaaaggaaaggtgggaagtttggaggtttgcaagtgcagagctggaattaatgctgtggaggaatggaaagagttgtctaaagaaaacaggattaactgggtgcagtcacttgtgcctgtaataccagctactctggaagctgaagtgggaagatctcttgagcccaggagtttaagactgcagtgagctctgatcatgccactgcactccagcttgggcaacagacttgaggcctcatctctaaaaagtataaaaataaaaaatgaaaacaggatttatgggcaacaccaagagaccaaaaaaaattgtaacctattacaaaaaaaatgaatctattatagcactggactatctgattgcaaataatatttttctttctgagtgcttagctacctagtgctgacatagggaagggtagtctactagagtaagtaaaatttaagttttcccagataggcatgacagaaaactttaggatactataaaaagtgggtgacttgatgttctacggtatctaaaggtagaaaaggaagtgaagacagtagtggtttagagttaagcagaaagtggaacaatctttggacttaataaagttaaataaccaaatttgaaagtaaaaaaaaaacaaataacaaaatttgggagtaaaaaaataaccaaaaaccaaatactaggagtgaaagttattttactagagaagaaaggttattaaaggtcactagtcagtgtgagtgtaaggcgattaatattattattgagatggagtaagttttggtccagaaggactgaagtggtaggaaaacattatggcagatatgttaaggaactgaaagaccaggataatgcatatgtcatacatgtgaatcatgagggtacccaggatagtagcaggatttgggtgaggacacaaagaaagactcagttagaaagactgagaagggacctggatgtccatagataaacagcaaaagagagaggtagaggacactacagtcaaatggaatgaatcactaaggagctgggcttcttgtttgatttgtcttgtttgcttttatgtgcaggaaatgtaaatgttctggaagtggcaataaaaaaataaaatgataaaaatcaacctcttgattcacaggtatgtgaacaatggaagaatagtttccatttaagatggcttcaggaaagtggtgcttgtaagaagaatcaagttccaattaatgtcaagaggtaaaattaataaagcgtttgggattaactgggttcaagggggatataaaaagatagagagggaaggaaatagcaggagactagtccatgaaaaaccaaagataatacagaataatatgggcataagtgtttagtggaggacctataaccaaatgggtcaggtagggcagtgagaaaagttaacaggaatgtgtagtatcttgaactacctttatctcaaaactgcaatgagtactcaggcctctccaggagtcagctgtagccttggtaaatggaggagtccccatccctccaggaaaggtcagctggctagaattcagcaccacagaagaaagcctcagatctcaagagtctagttagtaccacctattcattgggagcaactggagggtccagatcagtatttgtcaaagtatggtccataatcaccattagagttgtctgggatactcatgaaaatgcatattcctgggccccatcacagtcctactcaatcagaatcttaggggctaaagtatatggatctccagttttgttttgtttttaaatttcccatgtgattactgccaacattaaagtttgagaaccattgattatctttttaacaaggtcacaggcaattcttttgcatattagcatttgagaaacacagctggaagtagatgggaggcctgagcagggactgtgaagcccttcagcctctctggtggaccagcaaggcctggttggggtggcatgatcaaattgtggacgtttctaatgatcccctgaaactttagactttttctgaattcagtaggaaaacataaaaggatttagtgcagtgaggtaaccaaatcagatactttttaataagattagaaagactaggaggtttgaagttaactaagtaggctagaaaaatgcagctaagttccaaaagtaatctaccaagtgataaatcaatgcaacaagtagaaaggaagttctatttggtgttttactttttagaatataggaacagcttggatgggggcaatgaggcagaggaaaaactgaagatgacaatgtttttcaattttagtgatagttagctaaaatacaaagtccaggcctcacccttcaaaaatacccagtcaataatgttggggagtggctaaggaagcagcattttgaataagcacttactccctgccagttttcaaattcaggtggctagtggaccatacttggcaaatattgcgttagacagatggtaatgtcattaacaaaaacaggtaatctagaagtaggtatggggtggctgacgagggtggaggagcattagaaatctacattacaaaatgtttaaaacaagaaataagaaaacaaagcacttgtttttcccaaaacctaatagaattaattaatctaaacataattatgtcacaaataacccagcccccaccaaaaaatacccacaaatattttacttacttttattttaatgcttttttaatgcacagattgttgtggcatctggacacatgacacacttgaaaacaacacattaaatttatactgcctggaatagacaaaaagctgccttgtaagcatcatcaacaatgctcatcattgggggaggggtgtgctgcattagctgggtcccatggaattatatttttaaattctaaacttttcacaaatataaaagggataggcatttcaaatctgaaaggccacatgagggagataacttctattaaatagcaattttttcaagtacgaaaatgattgttatgattcaccagggtttgacttcaacagtatgggaaatgtacttgagttaatcttctggattatatttgtaaaagaagataggttagttaagctaggattggtctataatgtaactcttagtagtcaaactaaaaagtaattaatcgcataaattacactatcctttaaataaagatttttttatgaaaactgctctttctaaaagttttaaaaactttctaaaagttgtgcacatgtaccctagaacttacagtataataaaaaataaaaataaataaataaataaattttaaaaagattacaataggctgggcacagtggcttacacctgtaatcccagcactttgggaggccaaggcgggcagatcaccagaggtcgggagtttgatatcagcctggctaacatggtgaaacacccccccacccacgtctctactaaatatacaaaaaattaactggtcttggtggtgcatgcttgtaattccagtcactcaggaggctgaggcaggagaatcgcttgaacccgggaggtggaggttgcagtgagccggaattgagccactgagctccagcctaggcaacaaagcgagactaggtctccaaaaaaaaaaaaaaaaaaaaaaaaagattacaataatatgataccaaacaaatgaaactgcagaccctgttttcaggattacaaagtgctaatacaagaagaaacacatatccaaacatgtaaaaagaacaaacatctacaattatgatgtaaagccagtaagggaggcagcttgtaccactgcacgctaagagcttaatcaaacaaaaggaatgagaagaagcaagggtaccattagcttcagggattctgaggttcacaaagggcagtttcatatccacttgactattacccgacaaaccttcagactgcttttcctgatgagacaaagagtaattgaaaacggggttatgatctaaagatcacaaactttgagttttcaatgcttacaatccctctaaattggattattttaagaaaattaaataaaactcaagattgtttgaattatcacaggaataaaaaaactttatttcatccagctggtaccaaaaactgggctaaaaaatgaaggaaaacaataagctctagaggtaaacatctcagatggtatatacttttatctctgtaattcctgactaaatggatgtaatttcttttatcataattcctctatatgaatggccttttcttggctctaatggaatattagtgaattcttatgactcagaattttcaataaatttttctgaaacaaaaatttactagcaaaaaagacactgcctttatgtttagcccaaatgttaattgcatttgactaagaatttctgagtaatacatctgtgttcagtgtaaacaaaatgttctgatacactttaagtcttatcaaaatcactactaataaccaagtttgttttatccaatgttaaaatttttatttttcttaatttatatgcattttacattgaaacaaaacgtgaaccaagttgccaaaatttggtagttttaggataaaactactattaataagtttgggaagtctactgaaaaccttttctgagtctctacatgcatgtgctctgtcaatctaagagggggcttacataagtcacattacccaatattacttgcccgatttctcaaacaatgcacattatcatcccaagaagcatctgtttcatgtaaagtttgggaaatagaggcctagattattggaaagctaattaaaatggatcataacagaacaaaataagcattttggttaacgaataaaagatatcaagaactggctaagagacatgcttatcaatcatttccccagcttgtgataaaggaatatcctgtcatcagagacctataataggatgaccatataacttaccatccaagccagaacacttttgagagtcaaagagggccccattcattacagcaagataaacttaaaccaggaccatccaggacagcccttgccccaactatgaagcacacaaggacagtttaccatacaccatagctcagttagttttatcacccataaggtgttgcggtaccaggaaagaatggcaagtcttcttttaaaatactgcatttcagaaaacagattaatattttaggcaatacctgaaacagatatgagaatatcacaatagtaggttatgctgagatagactgtccttatttacaaaatcatcctctggcacatggcactactgaatactctgtcgtcaaacttcaagccgtcagcttccaagtcagcactttcctgattctccttctacatttcaatttcttctttacctctttcattagcattcttcctctaggtgcctatgaaactatggcgtttgtgttcccgtgttccccataattcattcactttatatattacgccctccttgggtacctcattccctcaaatatattccaaggtcctatataactacccctaacttcttcaatcatacatctagcatcattctaacaaagcataatcaatgtgaatttcttatttttcctttaactagcaagtttctcctgttttctaccttttttgtttgttttaactaaactgaccaatacagtgttctcattgcatgctatcctcttttgacagtgttaacttggatcacttgattaaggtggtacctgcctaatttctccactgagagagaatttagtcttttcccctttgtaattaataagtatttggtgtggaggtgctttgaaactatgtaaatatcctattcatcaaatttaccactacttggttagcatttattgatgtttctcggttgaattaattatattctgacaggtgccatgtgatgattttataatttcctcatttcttccatatttattcgttagtatcctactttattaaaaagcatttccttctctccatttatttattcatatatgcgtttatagcagtatgtactcatagatatttttattcaattagttagaattaatgtatatcatttttaaaattttgattcccaaattgtcctggatttggccagtgaaagttccttcaaggtggtttgtgtccttttggcatatcaccttttttaagaacctctttattttctgacacacagatatttacggtttagcgtgtgttttccctgctcctgccctgggacctgccatttctctaagggcccacttcccctttagtagagaatgttttttagaaagcaagatctggggacaagatatgctcatttctaataaactgatactgttcacaggccttctaaggagagagagctaggaaatatatgtattggtgtgagctcagtacttccaatttccaatccaacatcacacagctctcattctactacgccctttccacatttatattcatagctttcctctctaacattaggaaacctgtcagacattattatcaatgaaagttttcatgtttaattttttgtataatattttacaaaacaattaatacctaatatttctaaaatttgtgagtcacctatgaaacaaaggataagaaccgatttgaattaaatctacagaataaataacctgtgctcatatagaccaacttggtgataatggtaatatcaaatattaaataccccatagaggtctatcaccttattttacaccttatagacatatgctccacgctatggcaaggaaaatgagactgtgcttaaaccaaccacacctactgctgaagctggccatggggtctgtttctcctaaacatatgactgtctgcaaaatgggtagataaaagaataaaaccagtgttctttgaagataaggcataaagattctagatagaaaactaaaagcatcagtcctatgtgtagccacatactgtatgtttacatgggtatttatacatttaaaaatatagcttgtctatatcagattgctaacattcaagatatatattgtgaaatcatgtttctgtatattgattcatcacttaatctaaggtttaaacacaatgattctcacacttctgactataaagtacacagataacatatcactcactgaatctccttgatctattttagcggcaagcatcacttatgctaatttttagtcatttctatgtgtattatcaatttcaagtaattaggtttccaaattcaacaaaaaaatccttaagtgactagggaaagtcactcagttccacacagagagagcaggagagaaagtgtgaaagaaataaaaacctctattatttttgtaatggtggctatttcaatggtgaactgaaaaagcaagttctagtttggtacatggatagtttccaaaagacgttcaatgattatcccttgactaaataaagaatagtagggaaatgtaccagacaagaaggcataaaaccttagccacatcttttcaatgaaagactagatgacattgacaaagtcaatcagtttcccttcttacacaattgctaaactctcttccagtttaaaaaacatagaatacataagcatatgtatcaggctaagggtaattattttcatgccgagaaacacatccttaaatattaagacagaactaacaataagtacataacttttaagcatatatatcttaaaactaatggaaattatgtgtactgaaataagcttaagtatataagaggaaacaaagagctcaagacaacaataacaaggccctttatggaaattttgcttccaatgtaatagcttcaaaatgctgtatgacttatttaaaagagctttattagtaattaaatgtcaaaagtataaaaacaactggtctatatccaatttcatagaagttgtactaaacgcattcattatatcgaagtcccaggtgattatagcattagcactttgttagtatttgcagactgctagttttcaaacagattgtggtattataacatgtatttatcagctatgatgcaaattatgcttttaaaataccaccgaatttttccactagagaaatacaataaagatttttgagcttaaaaaattgagaaaacaacatggaaaaaggttaatggaaataagcactaggctattagctaatataactctactatgtagaaacaaataaataagtaaaaatagatggaatagtacaatacgaaaaagcataagtagatttcctgttacaatggattgatggagaaaagaatttcccaagttaaactgtaatacaaacaaaaaaccagaagttctactttgtgccagctttttatcttccatctcctattccctaattcccactctatcaaatctgtaatgcctttcataaggtatttcatttaaaaagatgtcaaagttctgcttgatagttaattgtcggcctttttaagagtattcagtctcacaaaaaataacaaagaaaagctagcaaatgaaaatacgaaaaatatacttttgaataaactgttcaagataataaaagattccaacttgatcaatgttgtgaactacaaatattaaaacacttcaacagcaaatgtttagaaattattgctaaaataaaataatcagggttttggttaaaagcgtgttcattctgtgaaaattcaccgtctacatattctgttttgtgcacgttcctttatgtacagtattatgcatcaacagaaagttttgaaaaattagtaatgtagctaaagtgataagtaagcacaaattagaaaagacaaaagattgaaaaataatgaaccaaaaaggaaataatagaaaaagaataaagcccttcaaattacaaaaagtcataaactaaaagcaataaataattaaatttaaaaaacagagtcaaaagggatgatcaacatagacaaaaactgagcctttgaaaaataataacatggaacaaactcttgtcctgacggaataagaaaaaaatacacaaacagtattagatatttaaaaaaagactcaatattcagcagagattaacattatataacaagaagattctattaaaaatgccatatcaataaatttaaaaattaaaacacatttcttaaaaaacagacttaccaatagcagctgaagaaggtagagatcaaatagaataaaattcagtggaactataattttttaagtcaatcaatgtttaaaaatctacccttaaaaaataagacatacacacacaaaacaggtaagattaaatggtcaacaaggaagttttattaaccattcaaggaacacataatccctacaacaagctttatcaggtatataaaatattaaactattttgaagcctaaaaattggcacacttctcaactcatttcataaggctaatagaatcttgaaatgagaacaaggcaagatcattatgagaatgaaaaattacaagccaatcttatttatgaacaaagatacaaaaatcctaaacataatattagacaaccaaatccagtatgtataatcataatgataaaatattccatgatgaagctgggctaatcacaaaaatgaaagggcaatttaacattagatattatcttagtagtattcttgttaactgattaaaggaggaaaatactgacagacctcaatcaatacagaaaaataaaagttacattcaatacccattcattattacagggggagagagaaggaagaaagatagaggatgaacagagggaggcaggaaggagaaagcaaggaatttagtatatagaaatagaaaagaactttttaccctgttgatacataggcaaacaaacaaagcaaagattatcctaaatagagaaaaattaaaagttctcttttaaaaatcataagcaagacaaagacattgcagtgagacatccagatagcacagtaagacaaaaggggaaagagcataggggattggaaaggaaaaagaaaacattatgattcacaaataatatgactcccaggtggcaaagtggagagaaactacagacaaatatttgaatctgtatgaaattatttgtaagagctcagccaggttatgatatataaagtttatatataaaattctaatttagtatagcaacaaaatctataaagcagctataaatactatggaatacctctaaaagtatatgcatgactacttattgaactgttataggagctcagattattacaataagttaagaagagtaattaataaaatatttgagggagcaatgtggcaatacccagtaaaattaaagattatgtacctacaagaaccattaatcaactgctagttatatgaactagggaaacaattctatatgtgcacaaaaacactagtaagtacactcactgaaaatgtttttaataacagcaaaaaaggaaaataaaactctgtatgtctacataatttattcataagtgaaatataaagcagttaaaatgtgtgaacaaagacacatgtatttatacacttacaaaacaacttaaaacatgaaaaatcaatagtcaatattatttagggaaaaatatacctataccaacacacacacacacatgcacccaaatgataaacgccaaattctgtggttatatagcaggaatgaggaagtacaattaagatcgcttgcacagggttatttatttaatcagatttcttgacagtatattgctgggtcttgcttgttttacccagttgaaaacatgtgttttaaatgtacaattaagatcattttatttaatgtaattaaatatgtttgcatttatatccctcatcctacaatttattttctatttgtcccatctgctgttacctcatcttctttgttttttttttttacttgcttctttgggattaattgagcattttttagtattttattccatcttcacttttattagtcattcctctgttttacatttttagcagttactagaatttataatacatattatgtaacctttcataatctatcttcaaataatattatactactctacatattatataagatcttgcaaaagtaaacttccaatctcaaccctctatcctttgggatattattgtcatatgtttcacatctatgtttttatcaatataaaccattgataatatttttgcagtaaagagtcaacatatctttttcaaaaccttaaaaatgataaaaatgccttttgtatttacctacatatttactatttccaatactctttgttccttgtgtgatgtttcattttccttttttctgaagaattccattaacattacttgcagtgcaagtctttgggcaacaaattctctcagcttttgtttagagacaaaaacttttattttgtctttaatttttgaagaatatttttcttcaaatagaattctagggttctagggtcacaactattcttacagtacttgaaagctaacactcctttgtctaccaactgggatagttttgtggaacagtcttcaaacttatctttaggtttacctttttatattttaaaatttttaattgagatatatatatatattcgaggtgtacaacatgattggatatatgtatacaatttgtaatgattattacaatcaaattaactaacacatccatcaccaaccattttaaatttgtctttagtttatattcctcacccatacttgctacttttaatgatttttgcattattgttttcaccaatttaattttgatgtgctttggtgtctgtgtgtctactattatactggtcagacttctctgagcttcttagatgtatcgttttgtaattttcatcaaatttggaaaaacttctgacatgatttcttgaaatactttttatttcttcccctgcccctgccactattctgagactacatctacacatatatgagaccatgtattgtctcataactaaccgaggcactgttgatttttgttgggaggggcaattattcactctgcctttcattttggatcaatgttactgcaatatcttcaagcacactgaacttgtcttctgcagtgtcctatctgctgttaataccataaagtgaaagttgtgactcaaaaattatacttttcaccactagaagttcctttgattctttctaatatcttctatattcctcttatgttaaggtttttctttaaatatttaaaaatataataactgattacattttttgctggtagttccaccaaatctatcatttatagatctatttctattgactgtttttctcttggttataaatcacactttcctgctctgtggcatgactagtaatttttaccagataatggaactgcaattgttacattgtttaatgtctaaatgttattttactcttttaaaacaattggggctttttgttgagaggagaaagagagttaaaatcagtatggtcaggttttacttaagttttttctaggttgcatctaagcaacctttaatctaggtatagatcagcctacttctaaaacattatccccagtggggtctcaactaaatgccctggttgattatgaagacgtgccattctgagtggtccaaaccttaatatctccccactctgtgtgagctcacagaattgttttatttgtgaatttgagagaagcaaaggggatagaatggcttgacccagcagggtaaacagcagctccacacagccaaaatgcctacccaatgactccataaggcaggaagactcccagcttcatggatgtcagagacatgaagggatatcagagaaggaaagaagccacactggctttgcccaggaaggtaagcaatggctccacacaaccaaaaagctcaccctacaacctccccaggcaaagagatgtcctcctccacagatctcagagaagcaaaggggctatacctatttgacctgggaaggcaagcagtgtggctcaacacagccaacaaacccaccctacaaccctactcaggcagggagattcccacctctatgcatttgggagaaatgtaggcactagtcctgcttgatccgagaggtcaaacagccactcaattcagcctaatgcccatcccagggtaccatacccagagggaagcaaaccctcatcatgcattcctaaggagcatagcctcaggtcccacctgtccagagcagcaactccacctaaccttgcagcctgcacccttgcccaaccacagatcccaaatagcagaattacccagccaaggaatatgtcttatatctgggctgaccagaagccactgcagtacccagccagcagctccacctaataggagagcccagtcagtggtctcaccagtcagcagaacccagagagtagcattatctgacatcacagcgaaggtagtggcccagccaactagagaatacataaattctcttcagggtcatcaccagctgacccttcatgaatcacaggctagacaaaataatgaaattctatccatgtcaaagaactcctgtaaatgtgagaagccagggctgtcttctcaaatgtacagacctatcaataatcaccttaaatgtaaatggattaaattctccaattaaaagacttagagttgctgaatagatttaataaaaaaaaaaaaaaaaagacccaactgtatatactgtctgcaagagaatcacttcactgtcagggacacaaacaaactgatagtgaagtaacacaaaaagatattgcatgcaaatggaaagcaaatgagagtggagtagctatacttatatcaaataaaatagactttaaattttaaaaccataaaagagacaaagaaggtcattatataataataaatggacttgtccagcaaaaggatttaatgtttgtaaatatatatgcacccaacattggagcacccaaataaataaagcaaatattagtagatataaagagagaaattgactccaacacaataatagcacaggacttcaacacaccacttacagtaatggacagatcatgcagacagagaactaataaagaaacattgaatttaggctgcactctaggccaaaagaacctaacagatgtttacagaatattacaaccaactgctgaagaatatacattctactcaactgaacatggaacatttcccaggatagatcatatgttagatcacaaaactagtcttaataaatttaagaaaactaaaataatatcaagtatctttctgaccacaatggtataaaactagaaatcaataacaagaagaactttagaaactttacaaatacatagaaattgaacaacatccttctgaaaaatgaatgggttaatgaagaaattaaaagggaaatttatttattatttatttatttattttgaggcagagtctcattctgtcacccaggctgaagtccagtggcgtgatcttggctcacttcaacctccgcctcctgggttcaagcaattctcctgcctcagcctcctaagtagctgagatgacaggtgcctgccaccatacccagctaatttttgtattttagtggagtatttattttgtattttagcctccctgttggccaggctggtcttgaacttctgacctcaggtgatctgcccaccttggcctcccaaagctctgggattacaagcatgagccactgcacccagccaaaagggaaatttaaaaatttcttaagacaaataaaaacacatcaaaacctatgagatacagcaaaagcagttctaagaaataagtttagagcaataaatgccagcatcaaaaaagaagatctcaaataaacaacataacattgcacctcaaggaactagaaaaatgaagaaatgaaacttataatcaatagaaagaaggaaataaaaatcagagcagaaataaataaaacagaaactaaaaaaatacaaaaagtcaacaaatgaagagttagttgttttttgcaaagagaaacaaaattaacaaactcttagccaaactacatttttaaaaaagagaaaagactcaaataaattaatgatggaaaagaaggcattgcactgaaatcacaaaaatgcaaaaggtcacaagagataattatgaacaagtgtatgacaacaaattggataatgtagaagaaatggataaactagaaacatgcaacctaccaagattgaatcatgaagaaatagaaaatctgaacagaacaataataactaaccagcttaaattagtaatagagtctctcatcagtgaaaatcccagggcatgatagcttccctgttgaattctacaaacatttaataaagaacgaacactaattttactaaaattattccaaataattgaagaggagggaatacttccaaactcattctatgaggccgtaattactctgataatgcaatcagacaaggatggaacaaaaaaagaaaactactctgatggttatagatgcaaaaatcctcaacaaaatactaggaagagcccatatcattaattctgatcaagtgagattcaccccaggatgcaaggatggttcaacgtatgcaaatcaataaatattatacatcacattaacagaatgaatgacaaaatccacatgatcttttcagcagatgcagaaaaaacatttgacaaaattcaacatcccctcatgataaaaactctcaacaaattagatatagaaggtacgcacctcaacacaatcaaggccatatgtgacaaacccacagctaatatactgaatgtggaaaagttgaaagctttcctctaagatctggagcaagacaaggatgctcacttttaccacttctgttcaacatagtattggaagtcctagccagagaaattgggcaagagaaagaattaaaaggcctccaagttggaaaggaagaatttaaattgtgcccgtttgcagatgtcattatcttacatggagaaaatactaaagattccactagagctgcaggatttgaattcaacatacaaaagtcagtagtatttcttctttgttttagacagagtatagctctgttgcccatgctggagttcagtggcaaaatcttggttcactacaacctctgcctcaggggtttgagcagttctcctgcctcagcctctcaagtagctgggactaaaggtgcctgccaccacgcctggctaattttttgtattttagtaaagacagagtttcgccatgttgctcagtctggttgaactcctgaggtcaggcaatctgcctgcctcagccttccaaagtgctaggattacaagcataagccactacgcttggctgacaaaaatcagtggtatttatatatactaaaagcaaactatctaaaaatgaaataaggacaacaatcctatttacaatagctaaaaaaaaaaaaatgggacacttagtaataaatttaaccaaggaggtgaaaactctccgcagtgaaaactatttttaaaaactgattaaaaaattgaagacatacataaatggaaaagcattccatgtttatgaattggaagaatcactattgtaaaaatgtctgttttactcaaaatcatctacagattcaatgcaattcctgtcaaaatcccgaagacatccttcatacaagtggaaaaaaactatcttaaaattcatatggacccagaaaacaccctgaatagccaaagcaattttgagcaaaaaagaacaaagctagaggcatcacattacctgactttcaaatatactatgaagctacaataaccaaaacagcatggcattggcataaaaacagacacacagacaatgaaacagaatagtgaacccaaaaataaatccatacacttacagccaactgatgttcaacaaaggtgccaagaacacagaatagaaaaagaacagtctcttcaataaatggttctgggaaaagtggacatccacatacagaagaatgaagctagattcctgtctcttgctatatacaaaaattaaacaaaatgaattaaaggcttaaatataagacctgaaacaataaaactgctaggagaaatgctaggagaaaacagggaaaacaccatattggacacacattggattgagcaaggatttttttgggtaagatcccaaaagcacaggcaacaaaagcaaaaaatagacgaatgggattctgctagaagctttttagaagaggaaaaagcagaggaaacaagcaatagagtaaagagagaatctacagaatggaagaaaatatttgtaaactatgcatctgttaatatccagattatattaggactatatatccagactatattaggaagtcgatcaactcaatacaaaaaaaaccccaaataatctcattttgaaaatgtgcaaaagacctgaatagacatttctcaaaggaagacatacaaatggccaacagttatattaaaatatcattaatcattaggaaaatgcaaatcaaaacaacaagacagcaccttacacctgttaaaatggcaattatcaaaaagataattaaaaagtagcaaatggtttgcatgtggagaaaaggaaaactcttacacactgtcgtgggaatgtaaattagtacagccattatggaagagagtatgaaggttactcaaaaaaaaaaaaaaaatagaactactatatgacccagcaatcctactgttggatatatattcaaaaacaaataaaatcagtttgtcaaagaggtatcagcacttcaatgtttataacagtactattcacaatagccaagagatgaaatcaacctaagtctgtataaacgaataagtggataaataaaatgaagcatatatatggaatgaaatactatccagccataaaaaagaatgaaatcctggcactcatggcaacatagataaatcttgaggacactatgttatgagaaataagccaggcacaggaagacagctacagcatgatctcacttacatgtggaatctaaagaagttgacgtcataaaagtagaaggcagaacggtggtcaacagaggctagcaagggaaaaggaggagggtacaggtaaattttggttaacagtacacagttacagttagaaggaataaattctggtgttctattgtagattaggataactaaggttaacaaatatggtattgtatattttaaaataggagaattttgaatgttctcaccacaaagaaatgataaatatataaggtgatggatatgccggctaaatgccctgatttgattttgcacaatgtatatacgtattaaaacatcttactgtaccctataaatatgtatatttattatatcttaataaaacaaagttaataaaaaaattaaatagataatgagtgctgactgtggtgtaggtactgtcaaaggcatatttacatatgataaataatttttaaagaagctggccagatgcaatcattacccattatcctatgttgggcccaatttatgtatctcacccaattcactacatactggactttcagtcacttgcccaatggacagcactggccattaccttcaactcattttccagtaccactgattgacgttgcttcccctgtagtgaagatgaaggcacagccctatcaccactttcacagctacagcaatatctacaccctgacacatggaagctcagttcctcctgccacctccagattccagtgaagccacaaagcatacggtgtaggatctaacttccccaacaattgcctactggggtcaggggatataatctgaaagtatagggacagtaacataccataaggtgagctttgaccaatgtgaaatgagagataggaagatgttggcagataaattatttttcttcctcaatctaactgacttgtcctgtacagcctgtctgtagatgcttcacatgactaagcaacagtctgtgtttgctcgtgcagctgtggacagcttagtgaccaacttacatttgttttttcctccttatgtaccatataggtatgtatatagatacatatttgttcaaagattatatgcatgtgcaggcatggatattcattctagttttagcatttgccccaagaggtagctatatgtattaaatttaggatataaaatacagttaattatcaattaagttattttaaaaagtactaaaacatgtccagaaaaaagcagcatttctaattaaaaatagaagcaaagaatagaatataaaaagaaaaatatatatcttaacttaaataatataattaagaactaaaaataaagttactttcccagtgaaaatatgctctgggcagaaaaaaaaatgactaaaatatcaaaacggaaaattagaaagtggtctatttaataataacaaaggctaagccttaatgaaagtctactacatttcctaggatactttgatgatatacagaaaataatgagtaaattatttctcaagtgtgatatatctaggaaatagatcagtgaaacaaaaagagtaatatcacagcatacaaacagaaaattcacatatagatggaaaaaatcacagtttacattgcattcatgtttaaaatcaaacatcactttttcacattttgaagatctccccccctaaatatggaaagaaaaacaagccagagctttaatataatatttttttccaacctggaacagctgcaaaaaacaaatcttgctggagataagcttggttataaatatcaacattccctttaaataagggagtccagttttcataccatctgcctctttcttaaagggaaaaagtatgaaactcataaaccaggacattccctttcaaataaggcatttaaaaatgaatgtaataaaaaggcgatgaactactctgaacccctgtctttaaaattgccctatttagctcagatcagaaaatgagatttttttgaaagcaaacaacttttattcaatgaataaactgcctaaagcaattaatatttttaagtgttgttttctaattttttcacattactagccataataataatctctgattgaaccatatttctcctttatgtgtcatactccctaccatttattttttattttttattttattttacttttttttttttttctgagatggagtctcgctctgtcgcccaggctggagtgcagtggtgcaatctcggctcactgcgagctccgcctgctgggttcacgccattctcctgcctcagcctcagagtagctgggaccgcaggcgcctgccaccacgcctggctaattttttgtttttgtatttttagtagagatggggtttcaccgtgttagccaggatggtgtcgatctcctgacctcgtgatccgcccgccttggcctcccaaagtgctgggattacaggcgtgagccactgcgcctggctcatttattttttaactacgtgtgtcacctctactttttctaaaaggtttttagagcctattctaaagacctccatgttatctctaacagtacaaaaatctagttattaagagactggacttttcttttaatacagattctatcctctgcaaaaatccttcctatgcctctctcaacagtgtttatatatatatatatacactcaagtttggactttatcttaaagccttctttcgtggccgggcgcggtggctcacgcctgtaatcccagcagtttgggaggctgaggtgagtggatcacctgaggtcgggagttcgagaccaacctggccaatatggtgaaaccctgtctctactaaaaatacaaaaaattagctaggcatggtggtggactcctgtaatcccagctactcgggaggctgaggcaggagaatcacttgaacgcaggaggcggaggttgcagtgagccgagattgcgccattgcattctagcccgggcaataagagtgaaactccgcctcaggaaaaaaaaaaaaaaaaaaaaaaaagccttcatttttcttttgcccttcactatttttcattctttaatccttgtgattgaacatttaattttttcactgtaccacaccattactatttcaataatgaagcccataaactacatccattacttaattctttaaaatattcacaagaaagcattaatacaagatggtttaccaaatagagcagtccagagggttatactggttgcatctaacgtaaaggaatattaagtatagtaacactgagatgacttgagggacggtagaagaaaactaagacaggaaaaaaatggcatcttctattttaaaaatatatatgtttagtcaattccttgaattacaatgataggattctgaaaggcaactgaaacaaatgcacatagggagccctgacataattaattctccttttcatattcattctctcccttattctttttctcacacacataaaaacacacccatatactgcaaacaaaaagaacaaaactgaatttttaatcatgagcatttgtagtaaaggcacaaagattatgcttacatttgtccttcataggaaaaatacatcctaggaccattttgtattttttaattcacttttattctgttttagctatggaccacctaggtctgtaattatagaaaacaaagttgctctacaaatggcaaatgacatttaattgcttacttggaatgctgcatcttcagtaaagaggaaggagacagagaaatttcgccacagtaatggttaacaacatttaatctctaagtatttaaaacaaatgatcattttacagcaatcaatatttcttccttttcatgattaatgtagatattatgaaatgaaatgaacaatgagattatcatttcattgcaacaatgaattcattgcaacaatatgattatcaatatcatatcattgcaacaggaaagttgttttaccttatacctatcagctagtttaaaatatttaaaaggttttttcttattaaatttagtccactgtttatttcctcacttccctgagcaagaatgcagggatctttgttttgtacactgaagaatctcaaacaataaggacaatgtctgcacatagtatatactcaatagacatttttgagtaactattctccaaaagacaattatgttaatttgaaacttacgtatttgatgtttaattattgtaaacttaattgaaaatgctttgagttttcaaaaataagcaattgtcaagtttagcccaatgctgcctccttatatattctaaatgtgacctaatggtttctctgtgcacagtaaactgtaacctttccatgtgtaaacagactgcaaccgacttttgtgccaatcactgagttttggccaaaggtggccaactgttcaaaccaggctcaaatgaggcaaacaccaagctgtaaccaatctggctgtttctgtacctaatttctgttttctgttacataactttcctttttctgtccataaatcttccaccacatggttatgctaatctctctctgagcctattctggcctgggaggcttcctgattagagaattattctttgctcaattaaacttgttaaatttaatttgtctaagttttttcttttaatgctatattttatgagaatctgagcctgataaagggtaggttaattcttccctacttgtttcctttctgattttgatcctttttggtgattaactaagataggcttattttccattttcaaaataggtacagtaagaatacctatctcacatggctatgttgtaatggttaaattaaatagttaatttatattaagtgcttctcacatagtaagtgctcaataaatgttatcatcatcattacatcatgctgatgtaaccaattactattgaggcagtatgcagtcaaggaagaaaaagaaagaaagaaggaaggaaggaaggaaggaaggaaggaaagggaaggaaagaaagaaagagatggaaagaaagaaagaaaagagaaaggaagggagggagggaggaaggaaggaagaaaggaaggaaagggaaggaaagaaagagaaggaaagaaagaaagaaagaaagaaagaaaagagaaaggaagggagggagggagggaggaaggaaggaagaaaggaaggaaagggaaggaaagaaagagaaggaaagaaagaaaaagaaagaaagaaagaaagaaagaaagaaagaaagaaagaaagaaagaaagaaagaaagggagagaaaagaaaagagaaaggaagggagggagggagggaggaaggaaggaaagaaagaaaaaagaaaaaaatataaacttgatctcacattcgtttttgagctccatttatttaagattcttaggatataagaatgctctcagaatatactaagcctataacaacttaattacatatacgatgtacaatatctggtattatttgatcttttaaatatcttctatcatcagctaagtggcttctacaaaagtatctttggataacttttaaaatgccaaattatgtatgctatcttattgttcacacatgtttgaaactctggattagtagagtaacagttacatttagaaagtaagttttttatatacactagtttctcttgaggagagacctttttaagaacagagtgctgtggtgtatttcaaaatggttccttttcccctcccccagggatttttatcagatatttactgtgagaacctagtctcacaatatgtatgtatttacatacttagtgcatgtacatatgtacatacaaaaggcttacacactagtccccatttttaaagctggcaacttaatctctaatcgttgtaggaatttgcaaattatccttcagtctaagaaaaaatttctcaggtaaacacttccacaattctttattctgtattctctttaggagttgtaaacttcttgatgttttttctactaagtctgtaagtcacaattccttttatatatccactacatgcattgtgcaggttaatactgttcctcttactagagcaatagcctgactttagataaaactggttctgccataagagcctcaaacctttaatttccaatgataagtttagcatctcaaatatttaaagtaaccctaggtctaacacataatagcaaacaagaaataaaattttagaaaagcccttatagtacattccaacgaatatcttccaaaacctttaagaaaatttccataaatattctacttttctattttctttttgaatattaaactttagtataacattatacaggtctccctccatagccatcagggattggttccaggactcctgtggaaaccaaaatccacaggtgctagaattccttacataaaatggtgtagcatttgcattaacctatgttgtacattcccctgtattctttaaatcatctttagattatgtataatatttaatacactgtaaaagctatgtaaacaattgttttactgtatttttctgttatttttttattgttgtatggctatttttattgctttttttttatcctgagtatttttgatctgcaattgcctgaattcatggatgcaaaacccttgatatggagggccaactgaaaattttttactaaaaaaatctatgatctaaaaaatctatcataggcttccagtttccatttctgtatgtaaggagcttagaagtcactactccatcccttttccaagtaaaaagttaaacagactgaaaaatcagcgctctttttggattcttaagaaaaatgaggacacagagcacaactctgactctcaaggttggagaaataggcaaatgcagagagtcacagcttaccagacagaaacccgtgagaggaaatcgtcacaggaaccagtgctgtggtagaaaaacctgaactgtaattgacaaattgctagaggctcaggatgaaaaagtctgaatgaaaaactctaggggaaccaagacagagaaggactcccacactctgtgagttttacccccaggagctcgactagcttctcacagtaaatacttgagaaaaatcccagtgggaggggaaaaggaaccattttgaaatacactacagcactctgtcattcttaacaagatctgtcctcaggagaaactagttaatcaaaggctaacttgctgggtactgtcagagcctaactgatctggggaaaggaaaacccccaactctagcccactctagctttccatgtggaggaagagaaatactcaactccaggcatcctgtcttcactaaaggaggggaaaacacttgtgaagttcacagtccaaaagccaatgctcactaaatgactaagacctaataataggactacagagtgtaccacatagctccatactttaccaccatgttactagaggcctatttacagcagttccttttacccagtacatcatatctggctatcaagaaaaaattacaaggcatactaaaagggaaaaaaaaaaacacaatttgaagagatacacaagcatcagaaccagatatggcagggatgttgaaattatcaaactggaaacttaaaataaatatgattaatatgccaagggctctaatggataaagtagacaccatgcaacaacagatggagaatgtaagcaaagacatggaaatcttaagaaggaaccaaaagaaatgctagtgatcaaaaacacaatagcagaaatgaagagtgcctttgatgagcttattcatagattgaacactagctgaggaaagatctctaagcttgaggtaaatcaatagaaacctccaaaaccagaaaacaaagataaaacacacacacacacacacacacacagaacagaatacccaaagattgtggtacaactctaaaaggtataacatacgcataatgggaatatcagaagatgaagaaaaagagataagaacagaagaaatatttgaaacaataatgactgagaataaatgtcagacaccaaaccataaatccaagaagctcaaagaacaccaaaaaggataaatgtcaaaaaaaactatacctaggtgtatcatctgaaaatgcttttaaatatcttttacctggatatcttatactcctttaaatcagtacaaaggtatgacagtcattaattcaactcattaatcttacaattcccctttccctctggatagaaggcaatactgcacttcatagttccccattcaaaatttagcaatttgctttgaccaatgaaactctaaatgccattgcataacgagccacactcccttcccactgctgcagtgatcatggaagtatattcagataaaaccttcaatatcttgggtccagaaccattctaccaacttattttggatatgtagtctgtgtgttgtgttaagacattgaaatttgggcttgcttgtttctacagcataacctgagctcctctgactgatacaaagggttacttttccccagcagcctttcataagtacaacatagtctgatttaaatgctgcttctccaagtgatgacagcattctattcatgctcttattataacacaatactatagtaaaatggctgctggaattatccatttcctttgtaaactatactcctgaaggtaggaactgttaatgcctagctcatagtaagtagttaaaacacattttctggattcattgatcattcatatgttcactcatcaagggccaggggccactccggttactagagatagagtgaaaacagagcaaaccaaaattcctgccttcatatgccttatattcttatgaaggataatgataataagcaacacaaataagtgtaaatatatagtttaatagatagtgataaaaattatagagcaaagaaagaatataaagctttggatggtcatcaggtaagactccatttagaaggtgaaattttaataacgaccaaaagaaaagtaaggaaattggtcatacaattgctatatatggatgaagagcaattcagtagaaagaatagcaagtgcaaaaattctgagatgagaaaatgcctggcacgttcagagaacaaaaagggaggcagtatgcccagggcaagagaataacgatgagcagagttgaagatgaaattagagaaataacaaaggttcaagtactgtagagacatttagaccagtttaagagctttatttagatttgatgttgagtaaaatggagagctatttaaaggctttgagtagagtgaggagtgggaaagaacagtaagcgatgaggtcagagataaacagaggcccatattcttccattttatgtcatatttcctctctccacaatacataagaaaaatggatgtatcaatttactaagaaatattgctgagtaaatgatattttatgatgatattaatctgtttattacttaatatgcaggaacagtgactaaaaccaatacataattatcaaaatattgcaatataccaaagtataataatgtactgaacatcaagacagaccaagcatttaatgtagcaacaaatctttaacagacaattgataatactaaatatttaacaaataaatcagttataaatgtatagctttataaatgttactacatttatttggatttgctgaaatatcacaaaataaatacaagtaaaaacatttccttattgtaaaactgccttccataagaaaaacctatgcttggaacccaggttcattgccagaaaaaaacaacccaaagcaataagtacaaagtgaaagaaaacaaaccacaaatcaaaacaccttttgcaaaatgttaaatcaaataaacacaccttgcgttgtgtctttgatgctgccaagtctaaactctggagagctgccaaggggtaagatgtttccaaagccaaggtctttagttaggtagcagtgcttgcattcctggcaaattcaattccaaataccaaaaataatattcttggtgatttttcttactgaaattcaaaacaaagtatatagaaatagtaaatggatgatctccagttccctaatagtccacaaatttaaatcacagggaaatcatttccaaaaggtgtttcttggtttgctaactctgttatttattccatctgaatacgtttctatgccaaatataattggaaaatgttgcatattatgccccattttaacaaggcacatttttatattattatgaaggctctgagaagtcctgtaacagaagaatctatttaaatttatgtgacccagtgtgtcttaaacaattatctgaaaagtagcaggagatacttccactgttttctaaagtcaagcataaatgtaaaaatactgatataaaattattttctgttattttaatttgcacaaggttgactttaaaaacaattgtatttattcagtcgtaaatgtttaagtatatgttactttctaaatgcacattttaaaagcaacatggaataataagcaggtaatgcatgatttattcatttttgttcagtgaatatttaccaaatacatattaaatgtcaggcaatgaacttatgtcaagttttacactgcaattgctctcatatggataagagtataaaatttaagtatttccaaactgggatctaataataataccaacttaaaatttaaccccaactatttgggaacacaagctttactttactaattctaatgagataattaaaaatagcaattttggggttacttttaaatagtgttaacaatacaagtcaagagtaataatatgaaagaataatcctttttaacaaaggtgctacaaaataatacagttggacccttcctcacaccaaacacgaaatttaattcaagatgaatcacagaactaaatgcaaagactaaaactataaaacatttaaaggaaatcgtaggaataaaactttattactttgagtttgaaaatagtctcttagatacaacaccaatagcacaagcaacaaaataaaaaacagacaaattgaactccattaaaataaaaattttatgctttaaagaacatgaccaaaaaagtgcaaagacagtctgcagaatagaagaaaatacttgcacaccatatatataataaaagtcttatatccagaatatataaagaactctcacaactcaacataaaagatcaaataatacaatttttaaatgggcaaagtatttgaacaattttccagagaagacatacaaattgccaaaaagcacatgaaaagatgctcaacatcattagtcattaggaaaatccaaataaaaaccacaatgagataccactttactcctagtaggatggctattttaaaaaaatgcaagtggagataaggaatgtggagaaattggaatcttcatacattgctggtagaaatgtaaaatgttacagccacactttgaaaagtttggcagctcctcaaaaatgcacggagttaccacgtgaccagcaattttagtcttaggtatatatccaagaaaaatgaaaacatctccacacaaaaacttatatacgaatgttcatagcagcattattctaatagccaaaaagtagaaataactcatgatgaacaggtatataaatgtggtatatatctatatggtggaatattaaaaagaatgaaatattgataatgctgcaacatggatgaacttgtaaacatgtatctaagtgaaagaagtcagtcacaaaagtccacttaatacataacttttattgttccctttatatgaaatgtccagaatgggaaggtcaatagagaaagaaaatagattagtggttgcttaagggtgcagaggcagaaggaatgggaactgacataatgggtacagaatttctatctgagataatgaaaatattctgaaattagatagttgcacaatattgggaatattgtaaaaattcctgaattatacactttaaaatgataaactttatgattgtgaaatatagctcaataaagctgttattaaaatacaagtgtcataaaaatacaactctacagtccttatctaaaatgtttgggccagatatgtcttgaatgattttagattataaaaatgtaataaacctcatctaccataattacataacactcctgaaaggatgtgggggaagcatattaatacttcatagaaaaatcttatgccatttaattacataaatagtcccatgtcatttcaagtctgttttttgtctcaattaagtttgtaaaaaacttgacaaagtttaattttgaagaacttttggattttgaaaatgcaagtgatggttgttgggagccttattaatgatgattgttaatattagtaataatagcagctacgcatttgttgactagcaactactgtggcaaacactgtggtaagcacatcacataccacaaattttcataacatttctgcatgacaggtacaatttcccaactgaggaaattgagtttcctaatgattaactgacttgcccaagcatgcaaagttgacagggaaagtagcagagattagaactcaaatctatctgattatagagcttactctctttcctctatgtattagagtatgttcagaccactcaccagaactacagactctacctctgtaaaatggagtaagagcctttttacatatacatacatgtgtacataaccatatatacatatatgtaagtatgtatataaatatacatatgcatgtatgtatacataaaattaatgtatgtacataaaatatatgtatatttacgtatacatacacatacagatacacatatatacacatatatatgtgaagtaagaatgaaatgaagtatttttatgaaaatgtgtcaaatataaagatctacataaatataagacaatatcatctgagtaactattttcattatatatctaaatcaaggttcaaaggggatatgttttcagttaaattttacaaaggcattccaaacaaacgtattaattttagtagaagaaatgcaaagtgttaatttaaacattggttttaaatatctaagcaaagaaaatctaaatatattcaagtggtctataactaaacttctatcatctcaaactttcataaagtttttggggtgcagtatgcaagcatatacattatgttttgtcttaaagcagttagttctatctactcaggagaagccagaacagattacgtttttactttataagtaacttcttaatattctaaaaaagtttaatgatttacgtttatttaacagcctgctcacataagtttacctaccacgtaagttcctagggtaactaggggattgtttatatattcccccttaaaggaaaacctgtgtatacctcagtacaacttttattccatgaaagtataatcatagaattaaagaactttagaaagtgtggtacagtatttgaaaaagcttcagaaccatttcaaaataccaatttgatcatgttgctctccatttgaaaacctgaaatggatcctcattgcctccaagatgcaaatagttttgcatgtcatataagagcctcctcagcctttgccagcaggttcatactgcctcaactctagccacttttctctagattaggccccaatcactaaacttcttttgattttccaatcacaagaacccattgacagcttaatagctttacaaatcttattatacttatttcaatgttgctcagccctagccttgtctaacttgaattcataggcacccttcaagaccccatttcaatcaattacgtactttctctgtacaagtcacctatacctgctggacaaatctttggttatctgattgatatgtaactcataactcacttattaaatattgtacatacttatctctataaacatctagatttttggcatataatagtatccattatttcttattataatattgagatattacctgattttcatctttggaaataaaactgtaaaatatttacatgaattttgtttcatttatggaatagagatggaaaagagaagatgtggattataaaattcaaataataatagattcctgaggttaaccttaacccatataagaccaaacagatgctggggtaagtcaaacactgaagggcaaaaattgaataaatctgagtcccttgaactgaaaagaaaagtacactatgtcttacaattcaggtcaggagttggaaaacttcttctgctttctagatacaaatattataggctttggatgtcaagagggaaaatcaaattataacaatgtgactatgattttagtgtgctgagatgcagagcaaggcaatgaaagtgcctcatgtgcacctctgcggcaattacacaactctgctgtattgtattgtactgtaaaagcagccatagacaatacgtaaacaaatgagtgtgattgttttctaataaaactttatttataaacaattaaatttgaattttacataatttccacatcacatataaacaaatgagcgtgattgttttctaataaaactttatttataaacaattaaatttgaattttacataatttccccatgtccacattatccttttgatttttttcaaccgtttaaatatgtacaaaccattccaagctcacggatcataggatacacaaggtgagccagatctggcttgctggtcgtagtttgctattcaatggtttggggatattttttaatctattcatactcttggattatcaggtttcctctctggcataaatgagtcagaagttcacaaaattttatttaaatctaggtcgttcttattgaattaattgtgtagtattatcttctcatgcaaacaatgttttatattagcagtcaatttttagctatatttaacaaaactatttaaagtctggggtataccatcagttatatatatgcatacacacacacacacacacacacacacacacacacacacacacaaaatggcttttgtgttgatattgcattatctcataataagctggtatcttcgggtctttttcctcaaaaggaaacacgaagtagtttagattcctttatacacatgctcctcaacttaccgtgggtgaaaaatatcttaaatcgaaaatgcatttaataccccaataaacccatagtaaaattgaaatattgtaaatcaaaccatcttaagtccagatgcttttcaacttatgatagggttacataccgataaacccatcatgaagttgaaaaaccataagtcaaaccattgtaaatcagggacggactgtatacgtaagagtggttttctgttgccatcacacaagaattacaaactgcctgggaatttttttaactataaacatgttgctctgttgttttctggcatttcatactacagaaaagaagtctgaggccagcctaataacatgcttttttcttttctttcttgatatggaaaacatttattttctttatcatcataatttgacaattttgtgatttttgtgtctctttaagttgtcatgccttacataaaaaaggccctttcttccttcataggtctttttcagctcaggaaagttttttctcctatttatttttaaaattatttttctttcaaatactctgttcttttcttcaggaacaactatttgtctatctatctatctatctatgtatctatcttcttgtctctttttcagagactccaaatatccacacagtggactctattctttattctccatatatcatctttttatgatttccaattttttaactaaaataacctctcaaatctattctctacaccgactaaactttgtacaacgacatcaattctatttgttactgcctcaaatatagatttttaatgcttttgtgataggcaaaataatgttcccccaatccaaaaatgttcaagtcctaattcccataacctacaaataagttaccttagattgcagaagggactttgcagacatgattcaatgaagaacctcaaaatggacagattgtcctgaattatctggatgtgtcttcaaaagtagataacccttccagatgtggtcaggagacatgacaacaaaataagtcagattgctgcaatgttgctggctttgacgttggaagaaggaggccataagccaaggaatgtgagcagcctccagaaactacaaaagacaaggaaaccaaccatctctcctagagcctccagaaaggaatgcagccctgtcccgaccttgatttcagcccaaagtgacctatatcagacttctgaaccacagaactgtcagatactaaatttgtgttattttaagtcactaaatgtggggtaatgtgttataagaggaacaaaactgatacggctctcatattttcagtttctcatcattttgttttctcttactatcttctctctgacacttcatcactgtctgttatttttacatgaagttctcctatccatagaagccatgtattcttgaatgtgttggacggcaaataactccccgaaatgttcttccttccttagcttaaaattatttttagagattcataggtatgcctctgagttttctactgataacctctgccttgattttgtaggatgtcttgtttcacttgatttattttcaaatgttaatttatccagaatattttagcactgaaaaaactgtatagataatttctacataagccagtgttttccatttatcgataaaggggacggtgttgaggggaggcagaaaatgaactccctaggaatgcagacaaagcagaatcggaaactgggaggttctttttaaaactgtaccttcccatcctgaaaaaaaaaatctgatatacctcctctgcccagagagattcagtactatatactgagtcactgtgaatgacggcaacgtattataatgctcaagcatgttgttcaaaaaaaagaaaaatcttcaaccttttccacatagataattaacttgactggaaagttattaatacccaacaaaggatatttctacctacagagctaagtctaaaactttcaatacagtgcaccttccacctgctataggtaataaactataatccacaattaggactttgccacaggtatccatatagttcattattccataccctgcaatatttgaatattttaacattcaaagtatgtaaaacaaatgttatttggattaacctatctttcttttgtcattgtcaaacttttaaattgttcaatacaattggtctgttatttttgcaactacgtcactaaataatactactacagaagaactaagctagtttatgctgttgtcattctccacttcagtggcttaaaagtcatgtgactgacaagagtctttcattaatggaactgtctttgccttttgagtcaaaaaaactgttaaaccactgaatatggagtatttacctttttattgtttaacatttcaaaattacgaattaagtaggaatcatttatttttcatggaaacatacacctatctcactctattgttgcaaagatgctgaacatttctaccatataaaaaaggtataaatatatataatggtatgaaaaattagctctaggcctacatgatccttatctgtttaataggaaatttgagaatatcaaatatgatcaaatatgtatcactattttccattagtattattttagtcactctggatgaataccaaaaaaccacaaaattctaagtaatattgtttaagacattaacactttgagtcaaatctactgatatcaaaaacacagatacatatgcacaaagattaaggagaaagctggctgagtttcgcgtttctacatagaagaatgtccactggagcagggactctcaaaagatgctttggcattggagtgagacaaagaaattctttattgagctgatagatctctacattacacaatatttatcatctctgaacttcaggatcccaaaagccagtagtacttcctttaaagaaattagaataattttaaaacaccctggcatatttcaaataccccagaggtgtcacccagaatggaaaaccattctggaaatggaaaaccagagcactagattaacagtcctggcctcagatcccacttcttcttcacagcttaccaaaaagagacgtatctgaccggttcacattactccaccggtagagctaacccattataaaccactaagcactggagattttccatcttttattagacctctgccctacaccatgaaaagcagtaattgtaagtaagcgtatctgttccgcaatctgaaatttttctctcagctgaactaaagtctaggttctgggaaagagagtaggagtaaaaggggataggaagtactagtactcatttttggtctcatttttgcataaagcactatccccactcgacttgttattgcaagttgaagttgatatggcaggcgccacatgtctgtttacaaacgcaagagaggaaggaaagagctattattgagcccctaaaaatctctaaatccattgtaatgctctctctaagccatttgtctttatccctgtttctctaccagaaatgaacagagttgaataaagaaagagtcaagtaccaaacagttcaaataaaattacaagtactaacgaaataacaggtgcatatatacatttatgcgttttacaaaagcaatagctctttacctcttcaagtttttccttatccaataacaactttttatatctactactgatatccacttttattgataaagctagatagggaatcagaccaaagaaaataatgaactctatttacagatttctatatgaatatagaaatcaggaaaagagccacagtgaaaacaaccacaattctttttagccacaaattaaaatgttataaaagattattcacttaagtttaaaaaaaaaaaaacagttctaagtatcaagtaatgatattccagtggcatgtactaaaaataatcagcttttctttgtccaaaacggacctcgatagatgagaaagtttatggatttaatgttcatctcaaaagtacaattttggccagacgcggtggctcacccctgtaatctcaacactttgggaggccgaggcgggcggatcacctgaggttgggagttcgagaccagcctgaccaacatgaagaaaccccgtctgtactaaaaatacaaaattagccaggtgtggtggtgcactcctgtaatcccagctactcgggaggctgaggcaggagaattgcttgaaccaggaaggcagaggttgtggtgagctgagatagcgccattgcactccagcctgggcaacaagagtgaaactccgtctcaaaaaaaaaaaaaaaatacagtttcacatttttctcaaaatatttgacaatgttctttttacttgtttaaataccagaatatgctttaagaggttatgatcaaagggcatttgggataaaacatagattacatggttttgtaagatagcaacaaataactgaacattagtagttcccgtttgttagtgctcaaaaaaacaaaaaagtacaatgggaaagggggccccaaaagggaactgcagatgactgaaggccttgaacaaaggtatgttatggtaagaggcactgtggaagaaaggcaaaagccccactctgctcccagctatgtagccttgggtaaaagttacttagtctctctgtaggatgaggcaagtgggagagaataatttccttatccctaaagaagttgaacaaaaacagggtccatttaggcttaaaattgtgcatttttctgaggagcaagtcaatagctttccttggtttctcaaagtggtaaatgacaccaaaaaggttagtcatcctcgcattaaaaggtaatgtttcccaatcttttcaggtatatatatatatctatatatatatatatatctagtgatattaaagaggaaaaggtgtcattcaagacattacaggttctacctaaccagaaccaacacagaatcaataatgaatagatgagttaatttcttccccatttctaaataaccctaagattaaaaaaaaaaaaaatcacaagggaaatttgaaaatacttaaagctgaatggcaatacttatacgtgtttataaatttggatcatatacacaaaaagattaaaagtgtaatcaataatgctttacatttgtgtggatcattactttaatgatactttcacaaccaattattcctccttttttaggaaggaagggcatatcctagagtctccaatttacagataacgaaacaattattgcccaaggacaaacatttcttaaccatgccagtttcctgacttgtaggccaatgctcctcccaatgttaacaagcagcacaagcttccttcctgggggtttgcactgtaaacctgccagaggaaaataaaagatttttacctcttttgttttttctctctggaatgtttgttgtgctgaatcattaggagacagagtatatgagcaaacaaaggcagatttaaaatggttatctgaggttaccatctcacaccatacttgttgatcattaagtatgagccgagtgaagcaaaaacagctctacaggtttagcacacctctccacagtagagaatgaaagggagattatacattggggctcctctagcaataaattgcttcaacttcttcaggaggcttattaagctcaaacaagcagcagagaactccaagtagaagaaacctaatctccaatccccttttcctagtcatccacgcggacaccaacatctgatggattcaggaatacaccaagctccaagaaaaatacccccgccccacaacctcaccaccaccgataaagccacctaatcctgtctgaatctcttctctgcaaatgttttggtatgcaaatactcgttcattaataagaggaagcaggaaaaagagtgaagaggagtaccatgggaaagggggccccaaaagggaacggcagaacccagagagctgcactgacaagtaagcgaccgcgagtaatcggtcagcacaaaggagccaatcccgagccgcgtggaagaccttgggaggtgggcgggactaacgtgtccagggcccagcggctggcgccagacacgctggcagggcgggaaccgcgcgttccttagcaaccgcaatggccacgcccaccgaacccagcaccctccatcccccatcccgcagccagcgccctactcaacgggaacgggtccttcagtgatcaccgtacctactgggtttcccggactccgggtttctcttgcagagcctccctccgcccagccccaccaagtgccgctcccagggacggaacgatcgtctcccaaacgctttagggctcgctaaagaggtgcgcccgctttcattcccggaccccgagcttcccgggcagggtctccccaatcccctcgcactcgccggacacacacctcagctctgccaaggcaagggccgacaaac

SEQ ID NO: 572 - DNA, 82616 bp, Homo sapiens; identical to SEQ ID NO: 566

SEQ ID NO: 573 - DNA, 53847 bp, Homo sapiens
gtctgcccaagtaactttattcgtgtcttctcaaacatttcagatcaaataatgccattttctaatcttgaaaccagcaagattagaaagagaatgaggccatcctttcactcagactttcccagttactcaagattgtattcaggaacgaagtcaaactcggcctcacttcttaattagaataaactagaatcaggtccattgcataactgctaattgttttgcaccagggagccacaaaggaagctaaaactagcctttctaagttatcctaagtttttactatctaaccagcacttctgattttttttcccttaaaactctaaagtacaggtgttgtatgtctgccgcatctgaaaggctgccccggaaatcagagcctatctagcgggaatgtctgggcagtcacccccatcctgcgcgcagatagcaaagggctgctggcaggtgtcagacacacggtaccgcaacagcagtcccgaggtctgagattctgaatgtcagcaggtggctggagagtatcaccagagccactcaggaaccagccatgcggaatggctgggtttcttattgaacatgaaatgcttcctctttggcctggactgttttgctaaaattgttagtgggttttggggcaggccagtgtatgggaaacttttttttttgttggggggggcgatggagtctccctctgtttgcccaggctggagtgcagtggcgcaatcttggctcaccgcaacctccacctctttcttgggttcaagcgattctcctgcctcagcatccctagtagctgagattacaggcgtgcgccaacaagactggctaagttgtgtatttttagtagagacgaggtttcaccatgttgggcaggctgatctcaaactcctgaccttaggtgatccacccgcctcggcctcccaaagtgctgggattacaggcgtgagccaccgcgcccagccgggaaacatttaccagggacaataaaggcttagaagaaccttttggggaaactttgtgaggagcacaattccagagggcccacagcagccacagcctcctggcgtgacaccaggcacactgccggctgcacaggttgctgggcacaggcaggcacagccagtctggaagagcagcccgtcttaaatctttggtttctttccaaccaggagcaaacattggtagaaagagccagggcatatttactctttacacccagaattttcattcattattgaaccatttggcttgcacagtgctctctgataatgtggtccataaaaaccaccattaaagctgccctttcacctgatctgggtggggctaaacgaggaaacgagaagtttcctgtatgcttcaaaatataaatcaatgccaggaaattctgaaaatggatgctgcctgttaaacatgaaatcactaagggagcttctgcaaaacccacccggcagcatgaggaacggtgtctacagcgtgctccaaacggccacggccccgctccttacagatcaaagtttaagccgcatattctcatatttcaaacaaaactacgttacagacatcatctacgtgggcacggatacacactaaacaaggacgtagtacacaattgaggggtgccccggggagcgcggcaggaatgccttccgggaagaatcctctggtcgccggagccctcgcgctgcagaggaaaccagcgatccatcgtggcttcgaggcaaaagacagacatccgagacgcagtttacactactctggcttaaaaggacaagatgttcaataaatatagagaactcagtgtgaagaaaagacaaggacaaatctggaccacgtgtacagacttcaggccctgcctcagaggagtcctgcgggagtccaggaccggcccctcctccacggatggccagcttcctcctgactgcccccaagcccggctgtgttaagcacttcgcgtcgatataaagcattggtatttgacattttaacagtaacaaacttgccagtgctttacacactgccagcttccagagcttatcatccgtgctcccagaacagacgccaaggtcatgctcccagccggattgtcgtagcctcgccgccgtgatgaggcaggtgtggaggccccagcagccttcccggcgctggcgtggaggcccctcccgcggatcacctgaagcagggccacgttgcattgcagttgcacagtattgtaaggatcaagcagcgatgtcctaaccgtaaacgaagaggaaggtgaaatgaaggcaaagagaatcaaccacttcccaaaacttggccacaaaccgttacagaataagtcctgcaaagtggatcaaagtgacccactgctacctcaggcccagatggtgtgacctgcgtggaaatcatataatgtccctaacattattgcaatagagccactaacgggccattttctaaactacactgttgacatcgttaaaacctaagaggccagtgcccccaagtgagcagctgcatccgctgagagtaagcggcgtgggctgcaacccgcagatgcgtacagaactgaaaatgccaaatatgtacacaaaattgttgacaaaagggttttcttctaaaatcaagatttaactatcaaaaataaatttctacatttaaatgtatatatcaacataattggtctgtaataattatcttaaatagttttcacactttcccagtttgtgagcaggacgccggcttctcagctgtgtgagtctggcttcggattctcttcaattcctcgtgcaaagagtcgaaccagctggcagtggactctgcagagacaagcggccacgtgtaaaccccacgtgtccctcactcaaagctggcctgagccccactcctggacaggggctgcagtaaaccccacgtgtccctcactcaaagctggccctgagcaccgctcttggacaggggctgaagtgggggtccatcccccatggaacggtcagacgtcaccgtgggctgtaggagtccagcccacaatgacgggccctgggcgtggaataattcacttagactcccgggatgccgagtttgtaaaggggttgccaatggccaggtgggaaatctgggcatcggtagacctgactcgaactccagcacccccatggaaagcagagcgtccgctccagtgtctgcccactccacccacccacccacctccattttctcagcagtactgagcgcgcaaggcctgcgaggagtctgtgcggggcgactcaatgcgtgtaagagatgtgtgaggaatgctcagatgagaaggacaggtggcccaacgccagcaagagccttcgggcttgaggaacaagttgggggtccctggaggtcccctgcccaggggctcggtggccacagtgagtccgtgggtgagtgccatcttcccacacaggacagctctatttatctcatttattaatgatatcacagcctcctcagacgtatttcagtaacctaaaccccttcattaagtgacaggctggggcagggcacagtgactcacgcctataatcccagcactttgggaggtccaggcgggcggatcacctgaggtcaggagtttgagaccagcctggccaacatggtgaaaccccgtctctactaaaaatataaaaattagccaggtgtggtggcgggcgcctgctacttgggaggctgaggcaggagaattgcttgaacctgggaggcagaggttgcagtgagccgagacctcgccattgcactccagcctgggcaacaagagcaaaactctgtctcaaaaaataaaaaaatagaaataaataagtgacaggctgtttccatggagctgagctcacacacacacaaattatatttttaaaagcgacgtgctgctcaaggcatagccatatttatcaagatagacaggacgtatttcaagaatgcctgtcctgattttcaaattattctatttctttaataaatacatacaccaatattaaaaataatcccacttcccaaacttgtcaaatgagttgacagaggaaagtccctgtgcacggctgcctggggtggccggtgttcctgggacctttcgacagcctcttgccatcaccaccgccctgacagaaagaaagggggcgcgtggccctgggcctggggaggggcagagacctcctcccttaggcttgttcggatgcgaatgggagaagctttcttagagccgcagctggctggctgaggagtcactgaaagtggggcgctgtccacagagatgcgtgcatcctcttacatgctgtgacttaaggcacccaagggccatctgacacccagctttcgttgcagacaggcgtgggcctgctgaccagcctgctatcgctctcacgccagccacactctgttaacgagcgtcaagctgggcttccttgaagtagaccgagctcttaccaacatctgccaagagttcagaatccacctgagctctaccgttccccagtctcatgtaatttgcacgcccacacctaattcagtggccttttgaaaaaatcaacttgcttgttactgggtctttccatggagaaacaattttctttgcactcagattccatctggttatgtgatacatcacagacttccaaatacaatgggccccagtgggtgtggggaggacaccacttcccaccctccgcccagccagccagaggaggggtgtggcacctgccccagggagaccgaacatccgtgtgtggccacacctgcctccccgcgtcccctaggctgcgtggcctccagcacggggcgtccctctggggctcctcctctccttcccatcctcggggtgcccttcccagccctgctgcctcctgcccctccctgcacggagcacctgcacttggtgattgactgtggcccttgaggccagcggttccctggtggattcagtggacaaaggactgcctgtaaaggcggtttcctttgtttgccttttgaaatttttttgagatggagtctcgctctgtcaccaaggctggagtgcagtggcatggtctcggctcactgcaacttctgcctcctgggttcaagcgactctcctgcctcagcctccggggtagctgggattacaggcatgcaccatcacacccgactaattttttttgtatttttagtagagacggggtttcaccatgttggcgaggctggtcttgaactcctgatctcaagtgatctgcccgcctcagcctcccaccttttgaattatttaggagaagagagagagaatgccagggcaaagagcccaatgccagcctggagcacagggtgtggaagaggaaaagaatgaaatggaggagcttcaaacacccatgaaaattatctgcaaaacaaaatgctgaggactcggcaccctggcatctttccagaatgtgggtaacggcatctcattcgatatttgacatagggagagaaaagtgcatttataaaacattcttacgttttgtgtttataaagccccagggaaccccccaccctgggtggggcagcttgtgacagacacctcagggctcaaggggatggcgctggtggctggaggacccctgcacgcacctgacctcgatggcagggctgtgcaggacctccccgtcgcagttccaggagctgttggagacggtgcagcagcaggaggggtggctgctgcaaatgtgcccaaagcgcttcttccccccctccttgaggtcgctgtcctcatcctccatgtgcttcgacgtaaactggaatttcttgacgcgataaacttcaacaaaagtgaagtcaaactaccaagaaacagtgagagggaccattcagctctaaacgtcatcgtctgggtggggcagcagaacaccccaggcctgacagcgagcgctgtcaggcctgggtgcacacacggcccttctcggaggatgcgactgcttgtgcaggcccctggagttccctttccagctgaactgacagctcagagatgaagggaaacctggcacccacctttcccggcgcccaccttccccggcgcctaccttccccggtgcccaccttccgcggcacttgtcaaaatgacttctaatgcttttagaaaccacagcttatctacaatgacgaacgctttttacagaattctgataaataattagcagtgattattagaattttgtattctctttttaacaagcactacttaaaaagccacataaaaatagcattagactagatcttaaatagaacttaagtaaaaaaagaaatgtgactaaatttggagactgtgaccaaaagttccgcttcccccaacatgactagactcgggtcttcctctgcataggctacagaaagatgtggtagaagggtccgaacagaacccatttctgggagcctaaagagtctattttcagtggcctgcaagggccacttacatctttactgtgtcgctttgttctgtttttaaataggaagagaaacaacgggtaagaagttgtattataaagattcatacctcttagtttctgtgctcaaatacatgtgtgtgtatatgtatgtatgtatgtgtgtgtatatgtatgtatgtgtgtatatgtatgtatgtgtatgtatatacacatatatgtatatatacacatacacacacatgtatacatacatacacacacacacacacacacacacacacatatatttgagatggagtctcactctgtcacccaggctggagtgcagttgcgtgatctcagctcactgtagcctccacctcctgggttcaagcgattctcatgcttcagcctcccgagtagctgggattacaggcgcacgccaccacgcctggcttttttgtatttttagtagagatgaggtttcaccatgttgcccaggctggtctcaaactcctgacctcgggtgatccgcctgcctcagcctcccaaagtgctgggattacaggcatgagccaccgcatctggcctcaaaaatttatcgttttaaatgatattttacaaggagtagttgtaaccaggagtttaaagtttgtgaaattaaaaaaaaaaaagtttgcccttccttcccttgaattaaataatgaattcctacaacacataaaccagggactgctggaacataaattactcgccagtggaggctccatgcaagagcaccccacttacctggtcctgctggttggtgtgcctgatgagaaatctcagaaaattgaacctggagcatttccggatgaggatgaggtcagaagacccgtctcccaagtgggcagccggggagaggcccctggggctccggcgacaagcacaggacatgtttgtggcattgatggccagaaacttcccacagacgacttgccactcctccacgtcctctgaagcacaaagaaccacggagatgtcacagttacaatggcgccgggcagcgccctgcaccaggacggtgggaggccattcgggctctcacctgctcatgcatttagcagacacttcatgcaatcgactcttcagctcaacaccaaaaacatccaccacggaactgtccgctccccgcaggaagtggtacccaaaggatcacctcccagaaggcaggactgttgtccctctcctcacttggtgacttttggacaatttagaacaagggtcagcaaaccaaggctgtgtgtcagatccggcccgccgcccgtctgtgtgtggcctgagagctaagaatgcttttcacgtttttaaatccttgaaaaaggtctggcgcggtggctcacgcctgtaatcccagcactttgggaggccgaggcgggcagatcacctgaggtcaggagttcgagaccagcctggccaacatggtgaaaaccatctctactaaaaatacaaaaattagccaggcgtggcggtgcatgcctgtaatcccagctgctggggaagctgaggcaggagaactgcttgaacccggaaggcagaggttgcagtgagctgagattgcgccattgcactccagactgggcaacaagagtaaaactctgtcttaaaaaaaaaaaaaaaaaaaaaaaaaattagccaggtatggcggcaggcgcctgtaatcccagctactcaggaggctaaggaaggagaatcgcttgaacccagaaggtggaggttgcagtgagccgagatcgcgccactgcaatccagcctgggtgatggaacaagactctgtcccaataaataaataaatattattgactgggcatggtggctcagacctgtggtcccagcactttaggaggctgaggcagtcagatcacctgaggtcaggagtttgagaccagcctggccaacatggtgaaaccccatctttactaaaaatacaaagattagctgggcatggtggcacatgcctgtagtcccagctactagggaggctgagggaggagaatcgcttgaactcgggaggcggaggttgcagtgagctgatattgtgcccctgcactctagcctgggcgacaagagtgaaactccatccaaaaaaaaaaaaaaaaaaaagaagagaaagagaaaaaaatcaaaataataatattttgtgacatgtggaaattctatgaaacttaaatttcagtgtccataaataaagtttcatcggcagatggccatacccactcactgtacactgcctaggctgcctctgctggacagagactgtgtggttgccagggcctgaggtggtcaccaagcaagccctcaatgggacatctgctgcccccacattctagagcacctgggacaggagtccagactcagcaccacaacagcgtttcagaaagggtaacggggcctttcacaaaacccactgctccacacagccacacacggcaagtaacagtgacctgacgctgcctggggctaagaagaaatggatgcctggtgccagacaggaaaaaggaaaagcacaggtgggcagggagaagaggcagtgccctgagagaggacagaaacccgcactccagcacacacagtgacaacactgagcctgtgttttaggaattacccgcagcttccaaaccatacagtgctttcttctgctcctcctccagctgctgcttgctttgcctgcaaacaaagcatctgaaagacaagaatatcatcaccttttaaatatggagctgcaggtgcagtgcgtatgcttggcacatatagatgtatttacattcttttcacatacgaaaaaattccatttcaaaggcttaacaaaatattttttggcatattaattagaggtttcagaatgagacctacttttacaatgacacattcaacatgtccttctctaaaaggtttggacatgaggagaagcacagcatgaggacgctgaggtgccacctggagacggtttctgcctggccctccagctaacatagcctggctgggagaaatgactgaggcactggttcccccagcggactcctggggtgaggactcatttactttcagaaaacaaatcatacagggtttatctgttacagtcaataacaagcaaataactcagaaccatcagcttagaacttagtcattcgtctagcacgtccttctgatcttgggggctgccggattcacgctgtcaaacaggacactgtttgcactgatggaaatcgctcatcagcagccgagttctttaatgcactgacgcaaacagcatctgcctctacatattctgattttatggtctccaattcttcacttaaaaaaggaaaggagctagaaggaggttctgaagtctgcatgacttaaaaggaaaggacgtgagtgtccttcacaaaggcgcagctgtctccacagccccgtgtcctcagccccaggcagagcagagacaggatgaccattcaggcgccctccatggtcactagggaggtcatgcggcctgggacaactatgtttagatttatttaaggttctatttacactggtcgcatattactgaatacactgtgtgggggtgggggcggagatatgccaggtgaaaggagtccctgcttgttcagtggcgtagccaccattgcagagcctgcagtggccaaactgggggaccaaatgtaaggggagagcgcagcgtttccagctgtgttgtctgcactcagcctcccctccccggtggggcgcctctttccctttgcatcccctctccctgggcagctgccctggctctgccccccaacccctggcaccagcccttgttgccagcccgagccttcttgctgagggtccctgccttcctgtggggttgaaggcgtggctggcctgggctctgctaaccttagagtgggctcctgccttggagcatggggctaacatgggtgagggtctcagccaggggtgtggacaggagggtggctgctgagagtgcacacttcagccagctctaccaacggtcctgccaccagtgccctgcacacgcacagtcactgataaggtgtctgccatcctttcctgcctgcatttctcctccatcaggcccctgcagggggtaaagggaaccccagcagggaaagaccctgtgctcagcccccactccaacagtgggtgtgggaccctcccccagagtcctcatccctggcacagcagcagctgcctgcgcaggccatggggacagagatggggacagcaagccccatgcacgcctaggccatcatgggcatcataggcatcgtgtgtctgggcacgctacatccggcaccttccaccacatttggaaaatacttctgcattcaccttcctaaccgtcctgcttcatttcccgtcatttgcaagagaaacacacaaagcaatgcacttaccctgcccggcagggcttcctatcccttggagatcccaccgtgtgttgtgcagggaggaaggacactgtcccttcatagcagtggtgggagaggaaggtctttaaacctgggaacagagtgcagtgaagaaaaaacatccacaagggtcattgcttggttaggatgctgtgctgggcagcttcagaaatgtcgctgagcgcgcatctgcctaaaccgtctgcaggagggagaggccgggcctgcttcaggccatgtcaccattgaaggcagtggcagggtctctgccctccctcaggacaacagcacgtctagtcatagtgctggtgccttctgacacccagtgatgctgggacagccagggctatggccactcttgacgctggcaaagtggggcctttgccattagccacccctcatagcctcgatgatgtggcctgtgggctccagtggctcagggtcatcccctccacctcttcatgagggtcagtgatgcccccacctgcctcagggcttggcccccactggggtcagccacagcccctgtgacgtcctgaacagctcaggacagaggccagggccgctgccacccaaagtctggggccaccctccaggcaaacgtgtgcgctgtccacggggctgccagcagcctggcacccgggctgtctgggaaacaccacccagcaggacagcagggactgggcaggaggcaggagaggggccccagggtgtcgtgggccacaccaggagccaggccgtgtcctgtgagtctcagggcgacttcactcctccgtgtctgatgctggggctggtgctgccctgtatgacatctggtgtggcagtgacggcctgcagggccgtcacacacaaccttacccccgacacacagaggcctcacatcctcatccgcagatggcaagcccacagccaagtgtgcaccgcccaggggtgggggaagctgccggcaagagcagtctggctcctaggacatctgtgtgcctgaaagtcagctcccgactgtccctaggacagccccgtctgtgggtcttgcacctggcatgggccaggtgcctggaatgcactcagcgggcgggcccttccaggtggctgcagctccgcctccctgcagagtggctctggcctctctccctgctcctcccatgggggtcccacaaggacgtcgtgtccacggccctgggaggaggccgacccactggtcagcaaccttccaagccggctcctctctcaagtgcagggggcaggggggcagctgcctcatcacccagacgcagcctccagggtggcgcctcaccgacatctgatgtcccggtttctgtctgcccctagatgggccccagatgtcctaccggcacctaaaactccacgtgtctcaacagagtgtgtcatttccacacgctcattctccttccatgccctctgtgctgctccagaacaaccgggtgctttctgcctcacagccacagaacccaaacccgctttcctgagagcatctcaggccctgtggccaggatggggatccagagacccggaaggcgtctcctgcctcggggctctcatcctggtgggagggacagagctgcagccactgcctgtggtgatgggctgagggcaaaggggggggccaggcatgcaggggggctgcccaccaccccaccccagcaggcagggacagggagggggcatcccaggggcattctaggcagagccacactgggctcaacaaagggcagtcgggagaatggcacaacccaaaccgcttcctaaaattctcgcggcttctctaattttctcggtattccctttcttaataagccttagataaatacctcactttgccatttcttaggttttaattttcaagccacactagtttttaatttcattaaatcttttcaagcttcgtaaagtttgccaaatcactatttctttctctcataagggttaagattttagtatcaggaattactcgatttaatttgatacagatttatctgaaagcgaactgtaaagaggcgggaaagtcgaccgggcagcgagaatggcacacctcatggtctacatattttcttctttctttcttttcttttttttttgagacagggtctggctgtcgctccagctgcagtgcagtggcctgatctctgctcactgcagcctccaccttctgtgctcaagggctcctcctgcctcagcatcccgagtaactggggtgcccggctaattttgtttttaatttctgtggagatggggtctccctatgtcgcccaggctgaaattctacttttctttttttttgagacagaggtctcgctctgttgcccaggctgaagtgcagtggcacgatctcagctcactgcagcctctgcctcccgggttcaagcaattctcctgcctcagccccccgaggagctgtgactataggtgtgcaccaccatgcctgacttattttgtatttttagtagagacagggtttcaccatgttggcgaggctggtcttgaactcctgacctcaggtgatccacctgccttgacctcccaaagtgctgggattacaggcgtgagccactgcccctggccaattctatgtatttttaaagttctccttttccagcgtttaaaagctggtgacgtcgcacccactgcctgatgtgtgcagactgcaactcttgtgtctgaactggcaccagccttcatttctggttcattctaaactctgtggtcgggtaacaggtcaccgccgcctggcccgaggccccagcagcagccccgggagcctggaggacctgcatgttccgaagcccacccagacctgccgtgttggatgctctggggggtccccgcagcctgggttctaccaagccctccagaggatgcaggtgcccaccacagtctgaggaccactgggctcaagaaagagtgaggcaggatgcgggcaacctctttgtgcctgttttctccgctataaagtggggcaggagcacctgctggggtgagaagagcactgtggagaatgaaagcttttgggcttcagggagtgcggcgtggcattcgctcccactcctcctcctctgtgcccactgcggccgagccgcaggaaggcaggatcttgcctgttttgttcatggacacgtccctgcctcaaaaaccaggcccggcatagagcaggggctcaacaaatacgtgctgagtgtatctcacttgtatggctagctacggtgtaaccccaacaaaaccacgcaaccttgttgaatgaagtaaaggatacctgtgcctgaagttacagaagagcttccacacagatatcccaggctgaatttctgcacaaagttcttgccactttgactaataagctcagagtgattataaaactattgttttacaggccaggcatggttgctcatggttgtaatcccagcactttgggaggccgaggtgggcagattgcttgagctcaggagtttgagaccagcctgggcaacagggcaaaaccctttgtctacaaaaatatacaaaaaaaaaaaaaattagctggtcacggtggcatgtgcctgtagtcccagctactcgggaggctgaggtgggagaatcacttgagcctgggaggtcaaggctgcagtgaaccgtgatcgtgctactgcactccagcctgagtgacggaggaagactgtgtctcaaaaaaatttttaaaaaatatattttaaaaactattttttttccaattaatacttccacttgaacagtttggggtggcctctgtcacctgcctaccagatgtgagaggctggtggcctggcgtcttggggttccagcacctggggttctggagtgaactgcgtccgtcatggtgtctactctgtggcttatgcttgggtccagggggcaggatctggtttagagcaatccaggttccagtccagaccctgccacgttctggccccggcacatttcatgaggcccttagcttcccgtctgtgagcaggtgggggcccacctctgacggtgctcagtggattcagtcaggtaacatctgtgaaggcagtcggggcacgaccagcggggagcgagtctgcattattctgagttacctgaaaagtcgtatctggcaagacccaaccaccgtttcttctcactgtccttgatgatgtccccgtagaagccgtagcccagcagggacacggagtagcgaaggagtgtgctgttgtggtggactgaggacacatccatggccagcgagtcccctgtgggagagaacggccgtgagggaaggcagcccccctccagccccgccccatccactccatccccttcaatagcactttgcaaacgtgggagttacttttaaaaagtgtgaaacaaacagaacgcattcagtgcaaggattctctctcttggggtgttggatgccatattttttattcaaatgactgaactccactcaaatttctaaaacaggctcggggagctatcctgtggggactgaacaagagtgtatccgtgaggctcatgaaatatctttaactgaaaggacggtggttttagaatgaagaaaaagtacatggcattttaaaatacaaaatcaagccgagtgcagtggttcacgcctgtaatcccagcacgtggggaggccgaggcgggcagatcacctgaggtcaggaatttgagaccaggctggccagaatggtgaaaccttgtctctactaaacatataaaaattagccaggcatggtggcgtgtgcctgaaatcccagctagtggcgaggctcaggcaggagaatcgcttgaacccgggaggcggaggttgcagtgagccgagatcataccactgtactccagcctgggccacacacagagtgagactctgtttcaaaaaaaataaaataggccaggtgcggtggcccgcgcctgtaagtaaccccagcactttgggaggctgaggtgggtggatcacctgaggtcaggagttcgagaccagcctggtcaacatggtgaaaccccgtctctactaaaaatacaaaatgagctgggcgtggtggcaggtgcctgtaatcccagctacttgggaggctgaggcaggagaatcgcttgaacccgggaggcggaggttgcagtgagccaagatcgcgccactgtactctagcctgggcaacaagagcgaaactctgtctcaaaataaaataaagtaaaatagaataaaataaaatgcaaaatcagaagtaggccgggcacagtggctcacgcctataatcccagcactttgggagggcaaggtgagaggatcacttgagcccaggagtttgagacacagggagaacctgtctctacaaaaaacacaaaaattagccaggtgtagtggtgcacttctgcaatctcagctacttagaagactgaggtgggaggatcgcttgagttctggaggtcgaggctacagtgagtcaagatcatgccactgcactccagcctgggtgacagagtgggaccctgtctcaaagaaaaaaatatcctgaccaggtgctgtggcttacgcctgtaatcccaacactttggaaggccgaggcgggtggatcacctgaggtcaggagttcgagaccagcctgaccaatacggtgaaaccccatccctactaaaagtacaaaatgaactggacgtggtggcgcgagcctgtaatcccagctactctagaggctgacgcaggagaatcgcttgaacttgggaggtggaagttgcggtgagccaagatagcgccactgcactccagcctggggacaactgggaaactccatctcaaaaaaaaaaaaaaatcctaagtggctattttaaaatatacagtttctgtgacttcaggtgaggcacggtaaccctgtctactggggtgaggaacaggcgaaggcacaaaagatctgtcctgccagagcccaccgtgctgagtgccatgggcagccccttctgctcttcctgaccggggctctgcatcctggactgaagcctcgaggcctcacagaggcatgcgttccacagctggcagcccaggcacagctgcccgtgcccactgccacaggcagtatggcgggacgcgggtggtttccgagcctcggggcagcagcctctggaggaggaactgagcaagagtcaggtgagctgagtacgggcatcgcgcatgtggtggattccgtgggaaagaactcggcccacactgggcgtgcccccaggaagcccgtcctgacaacgtggcctcggagctgcgtgctgagtgggatcacagcgcagcgagcagagcaggggacacagcgtgacccacggccaggacaggacggcaacggctggaacacgcgacggggaccagagtgggacaggcctgggggcgcaggaggcccggctgccaccgtgcgcatgcgcagaggaggggctcaccaacaacgatatgcagcgccgaggtttctgcgtcgctggtgcccacggtggagtaacacacgcagtccgttgaccctgtaaagggaaaaagaaggtcccaaatagcatcagaataacagaattgtaatcgcctcccaattcagtgagtggtacctcattcctttccttccatggccctagagtcaacactaaggaataaatagaatttacctacaaaatgaatatagaaaatactagcgttgattcctcaagaatattgagattgggccgggcggtggctcacgcctgtcatcccagcactttgagaggccgaggtgggcggatgacttgaggtcaggagttcgagaccagcctggccaacatggtgaaactccgactctactaaaaatacaaaaattagccaggcgtggtggcatgcacctataataccagctcctcaggaggctaaagcaggagaatcgcttgatcccgggaggcaaaggctgcagtgagtcgagatcgcgccactatccagcctgggcaacagagtgagacttcgtctcaaaaaaaaaaaaaaaaaggagccaaaaagttaaaaaaatatatatatgtgtgtgtgtgtgtgtgtgtgtgtgtgtgtgtgtgtgtgtgtgaacatttacaattataggcataacaaaatttttttttttttttccgagacggagtcttgctctgtcgcccaggctggagtgcggtggcgtgatcttggctcactgcaacctctgtctcccaggttcaggcaattctgcctcagcctcccgaggagctgggattacaggcacgcgccaccacgccctggcttacttttgtattcttagtagaggcagggtttcaccatgatggccaggctggtctctaactgttgacctcgtgatccgcccgccttggcctcccaaagtgctgggattaggcgtgagccaccacacctggccctcgtaaacttctgaaacagctggatgcggcaaaggtcacacacagccattacttgagatcttaataccaggacagccaggacaggcagctcaggtccctgcttcagcccgatgttccccgtgaacggggccggctgcggcttatgcatctttttatcctgcgcttcactggctcagatgaaagggaagctgcagctgccccggctgatcgcacggccttccctctgaggaccatgctcaaaagaatgatttgcatccacaatgaccacccatacctgtgggagtagctgtgctggttctcaacattccccacacaactgaatacgggagttcctcatccacccggccagcactgccgccacccgagtaacgaccaaccacatgctcccgttcacgcgagaaggacggggctccaggggggttgctcccaggacatgcgcatcatctccttgagcctctctgtgcctaagtcattagcaggcaatgctggctgaagttacaagcagcagatgcagttacaggctaacacccgatgaaggaccgaatgaatgacgatctcttcttcctatcaatttgctaatgcatctatactaatacatatgtggaagagacttggaaggtaaaacatgctacatcaggtctcaaagcagccggagccatgcctttcagatgctccagtgacatctgtcccggaggcagccatccacgggaggcagctcaacaccctccagatctcaggaccccaacccccacctgcccctcctgcctctcctgcccccagccagcaagacaagcagtgacctctgcaccttctagcggctggaaccctggagcatgagtgagttcaggtacctgctgccaccaccggccgtgcgcatccaggcggcctcccacagggtctgtggctgtcaggtctcactcacaactcttgtgcccccaggctgctccccaggttgccatggtgaccgttacagggccacccttgggtgtctccctcacccttactcctccactcaaggcgatgctgcggagcagagactccacacagccccccaccagctacaccccggagtctcagaccccatgcagcgcccttaccgtccaagccaccagcgttctcaccggggcccacatgctcttaggaccaaacgcagagagcgatatcggagcagagtcagacgtcaccccctgccgaaccaccgcctccaagacctcctgctgcatggcagagtggaactcggcatctccctcgggccctgccctgcccctccacccccacccccagccacactggcttccttgtcccgaacacccccagctcctcccacctgctgccctctgcaccagctgactcccggcctaggcccctcacctgtcacctctcagaaaggcctcctggacacccatggaaaggggccacaaagagaccctctccccagaccctcccccagtggcatttgctacaatgcgcacccaccctgggaaaggcttttatgcccacatttggtggggtgcctgctgtcctctcctggggcagaggccacagccaaggcctagaggagggcagggcacacagcggtacccccaccctgaccacggggcagggcacacagtggcacctccaccctgaccatggtgaagtgcagcctgcatccccacgagcactcctgagccgcaggtctcagctcctgaggtcgttgtggattttaagagctgaggattttagggcttagcactgccactggcaaatggtgacaaaagacaggtttcttgcaaacaaggtaagaaccatacagcatagatgagaatgcagaaaaacagaattcatggaatccagaacgcaccacatacaaagttaaaagaccaaaacctaatttggaaaagagttgcaagacacaaaaaccaatgaagggcaaataacgtataaacaatgttatggtcaattagaaagtgacaggccgggcatggtggctcacgtctataatcccagcactttgggaggccgaggtgggcagatcacgaggtcaggagttcaagaccagcctggccaacatggtgaaaccctgtctctactaaaaatacaaaaattagccgggcacggtggtgggtgcctgtaatcccagctactagggaggctaaggcaggagaattgcttgaacccaggaggcggaggttgcagtgagctgagatcatgccactgcactccagcctgggtgacagagcaagactccatctcaaaaaaaaaaaaaaaaaaaagtgacaatgccctcttgcttccccatgagaacatggactaagcaagggaaaggaagtttacaaaagcacacaatgcaaacagcaagaggacctgtgaaaagcagtgtggcctcacacataatgaaagaaatacaaataaagagagtaaataaagatagtgaataaggcagcatactcagtctatcagatgggataaaagttaaaccacagacaaacctccaggctgtgccaggcttggggaaactccccctcccagccccgtgggtggcctttatgggagaattaagtgggcccagagactccacgtcaagggatgtccacaaggaaatcatgacctggagcctctgagagccacacgtgcacaggggccagggtccttcacgagtgtggaagatgcagagagagtatggaaagaaggatgggagtgaggggcctggggtgaagacagcaggagacggtgccttgatctcaggcacttgtggccatagggagacagtgcaaggccatcaacattggttgtctgggtcattcaaagaatcggaacgggctgggtccagtggctcatgcctgtaatcccagcaccttgggaggccaaggcaggtagatcacttgaggtcaagagtttgagaccaccctggccaacgtagcaaaaccctgtttctactaaaaatacaaaattagccaggcatggtggtacacacctgtagtctcagctgctcaggaggctgaggcaggagaattgcttaagcccaggaggcagaggttgcagtgagccaagatcgcaccactgcactccagcctggacgacaaagtgagactctgattcaaacaaaccaaccaaccaacccaaagaactggaacgcctcttgaaccagcgccagccagcaagacaagtggtgggtgactggccaggcatggtggtgcacgcctgtaatcccagcactttgggaggcagaggctggtggatcacttgagtccaggagtttgagaccagcctgggcaacatggtgaaactccatctctacaaaaatatgaaaaaaaagttggccgagtgtggtggtgcacgcctgtggtcccagctacttgggaggctgaggcaagaggatcacttgagcctggggcagtctaggctgcagtgagccacgatcatgccactgcactccaaactaggtgacagagtgagacccagtctcaaacaaaaagacaagccgtgatctgtgcaccttcaggggctgggagcctggagcgtgtgagtgtgctgagtgtgtgtgaacacagagctcgaccttgcacagctgtgctcagtcattcaacagatatctaagagggagtttgggtgccagggctgggtgccccaccgaggacacatgagtgaaagccaacctccctgcctgtggggaagacagacatcagccaaggcccaggggccctcccgagccgtctgctcccggccagctcttccgctctccccactcctaactgcctggcaggaaccgagaggtcggcggcacacaggaggcctgagaaggatgtgaggaaatccagcagaggctcccccgagatccagcgggatgttgctataatgctttggtttatctgagagacttgttattggaaggggtgctgagagctttttctctattgagctatttctaaagaaccatttctccccttagtgtctcccagcctggagccaggctgttctcattagacaggactcttctcaggtgagtgacattcttctaaaactcatcaggcgatattatgaaaagttcctctctattaataactgcatcacgccttccctaaaagccaaagggaagggatcgtaaccagacgatcatcctttcctatatacttaaaaccatgaccatggtcaacttgttgctaacaattattagtaattcacgagatattatgctaacacaaatccccctaaaatgagtcttgatactgaaaacacccgcaatgtcaccatccgtggggaacatttgcctcacaccattattcacaagctctgtcattaagaaggagtaatgacttaagtttaaaggatgactccctcaagtaaacactggcccacaatgtcacctgtcggaggcaggttagagttgagagcggcacccacagagaaggtggctcagggcctgtccctcgtgagggctagcctttcccttgctttgaggcaaggtggcctctaaacctccaactctcgctcccatccggtgacctgtgacctcacccccagtcctcctgtcttcatccataaaatggggatgactgcggtgctcacatcccagagctgtgacgagagtgaaagtgtgcaccatgccgccaccctcggggccagacacagggccagagaggacagacacctcgtcccctgccaggtcatttgcaaagcctgcaacacaccacgctcaggccctcagcttgacttagcttaacactgtgatttttcaaagaacaaggtggttcctagaaggatgttgaatggaccaagccgaaccagcacttcaggacacagcccagctgttcccgggctcggctaggtcctgcccttggttccgcccccacctttcccactcagtctcctcccaactccccagcccgattcctgcccacacccacccctaactcccggttccttcaggtccagaagccacttcttccagaacgcaccccctgccaacctacccacctgctcccgggcaccgggggttccccactccaggactgcacccccagcggtggggttctcctgccttgcgtgaagcagcctttgggggagtcgggcaactttcctttccacgagtgtctatttcattggggtcatactctcaatgatatccccccaagagtggccctaatgttaggaaatctgtacgaactaaactgagtataattgggttattaagtgtccgaggtggctacttgtgcagaacaattcctaaggacgggaacgaagagaacagagaatgccaggccggctccatacctgcgggaatgattccaatccggaggctactggggaccagcacagcccgggggtggttctggtcgaccccggcgctcctctgcgtcctcccaatcagaccgtgcagcacctcgctgaacataccatctccgccgacacagacgatgctgcaggaggaacacagccggtcagggctcctgcaggtgcggccctctgagcgcagcaggcctgaggcttccagcttcaggaggggcagcctgcacacctggcccttggcaggcatctagaagtgcggctcctgaaatgtccctaagtgataaggtcgtgcctctgtgccagttggcctagaccacgtgtacaaataatgagattgatggcaaatactggctttccttctgtgagtctggaatttgggtggctaggcagagaatgcctgcatgcctgtaccccctcaaaaacactacactctgggtctcaggactcaagtttgcggggcgggaagagtacacctgtgctgctgcatttgtgggagcagagagggtgcactccaggtgacccgcactgcgggagaggcacagcagtctgcgcggggacgtttctcctttgctaagctggctgtgcagccttgctctgtcccgtcagaaatctcagccgagagcacgactctagctcaggcagcaaatcaccagccgtgtgggtggtcttgaggacccaaggcaagagcagaggggacggaataaatgcggacaaaatggggcatgagacaatctaaggagaggagatggagaaaggggacagtggctgaagggagaaaggacgggttggtttcagggtgtgctgtcctatgccgggggtaacccacagggaaccaacactgaggtggcagaatgagaggtgcaggcatggagacagacatgtcactgcagcccagagggaaggcagaggacagggctcaggtttcctggacatctctatagcctacggcagcccaagagctctcatcacccgggaagagagggttgcagggggaaggtccgccggtagaggagcggtgtgagtcgactagggggtgcagcctgaggggcctccctcaagcatgacagcatcaaggtgcctgcccattccccagtgggtctgtctgtgcaggcgcgaccagtctccagggctgggatctctgcccaccacccaccactcaggccacctgctttgggcccggctcccatgggaaggctctttgcccttccccgtagcctacaccttgcaccggggcagccttcccagcggggctgtggtttcgaggacagggcatccttgaatgggcagtgtagcatctgtgtgttagacagacagatcactcagacagacagctcagccgcaggaagagcagccctcactggccaggcctcccagcctcctgcacggcatgtccctgggtttggggagaaggcgtgccctcaagaggcgaggctgatcccttggctagggtgggtgcaataaggtgccagccccatccctgctgaaaagtgaagacgactgtcttcctgccaagctgctgtcgggtggaggtggtgggaagaagtacatggaggagctgccatcgggtggagttggggagatgtgcatggaggagccccctgcttcctggagcccatgaacagaacactcccgcattaggaggggagcaaaggggtctccctgtcagcacctgggggcaggggctccttttatttccctttctaaccttagcaccagcagagtgctgggacctggaggaccctcaataatgtttgtggaatgaataatgatttcaataaatatccgctgcaatttataacacattgctcaccgactccagatggaacagagagaagaaaacaaaaagccaaccaatgacaaggcaattaactacaggggaatagctaaactcaagatgaagagtgaaattttaagcataaagaacagcacagaagagctggacagacttgagtacatgaatttgaaaacttctactgggaagaattaatgccataagcaaaattaaaagacaatttcaaaattagcaaaaatatttgcaaaaatatgaatataaatatgaattgcctattatttgttggataagagaacaaatgactgaaattatggccaacaaaagaaaatgggccaaagacataaaaatcaattccaagaagccagctagccaataaacatatttcttaaaatattagagactttcacatgtcaaattagcagagaaattttatactgataataccaaacatgttgacaaagacagtaaataatatactataagaaagaatgtaaactggccgggcgcggtggctcatgcctgtaatcccagcactttgggaggctgaggcgggtcgcgtggatcacctgaggtcaggagttcgagaccagcctggccaacatggcgaaatcctgtctctactaaaaacacaaaaattagctgggcgtggtgttgggcacctataatcccagctactcgggaggttgaggcaggagaatcatttggacttgggaggccgaagctgccgaggtcacgccattgcactccagcctgggcaacaagagcgaaactctgcctcaaaaacgaaaaaaaaaaaaaagaatgtaagttaatagaatctctttcgaaagcaatatggctgtacacggcagagattttaaaatgttaatctcctatgactaatttcatttctaggaatttaccttaaaaatgtagatgtatgcagagagatttatgtacaacaatgctatcctaagagcaaaaattggaaagagcctgaacatctacaagtgagaggctaaataaatatggcatgcccacataatggaccatgatatgggcattaaaaatagtagttctgggaaatctctaggaattttggggaaaagaagaatcccaaactgtaaaaacgacagcatctaaacattcttgataatgtgcttggttgatttgcttctctgtctacacagcaccgcataagcacatcttctgaaagaccgaaagggaacagaaccagcaaacaaccattctcgcccagcccagccagagaggagtgtgtgactgcacttttctgccttttctttcttgccttcctgtaagaagcatgtttacttttacaattggtcgtgggtggaggcggggggcggatttaggaaaaggagctctcaaaactgagaggtgggtagaactttttcattaacaatggacttgatggcgatgaaagacggcttactcacccgtcgtatttgtctatgttaatctcatacagagtctccttggcctgattagcatgttcagtaactgtggggaaaaattacatcacacagtttatattcacatctgtgagtcctcacgtaaaaggcaaatcatccattcttttaaaatgagttcctgtaacaccttcaggcggatttcctagataaaattccctcttcaattctacatcgctcttatgggacgggatcaagctgacctcagggaacgtgaacatgaacctctctcgggccacagtctgcgcgatgacatgcagcgttcctggtatttaattgccggcaaataataatttctttgaaagagattacgtctcttttataatttttccttattatacaagttacttccaaaattgtacactataccaaagtgtagtaagaagatgttagtgcagtctctatacctgatgtaaacttctattgaaagtccccccaccccacaacaggccccggtgtgtgatgtgagattatttctaagacttattaatcctttgtgtctcctcttttgagaattttctgtccagaatcgttgcccttttatcttcctagtgtttttcttgattgccttctatgctgagaattggctggaaaatactaagttatttattttgtattcttcccattctggtatgtaaaaaaaagttctattttgtttaaaataatcttacaggataaaaatcttgggctgggcacagtggctcatgcctataatcccagcactttgggaggctaaggtgggcaacattgcttgagcccaggggttcgaaaccagcctaagcaatatggtgaaaccccgcctatacaaaaaatacaaaaattagccaggcatggtggcacaaggtgtggtgccagctacttgggaggctgaggcaggaggatcatctgagtcaaggaggctgaggttacagtgacccacaattgcaccactgcactccagcctgggcaacagagtgagacaccgtctagaaaaagcagaaacgtctctagtgactatacttgaatcattctcaaacttacttctacatagttaacatagaatttgttaccgatgatgtcagtggtgatggaggctaaggtgaacagtggtgccacttttctttcatatatccgcttgccttgtccttttcctccaaacgggttgataaataccagtaaatgctttggtctggacgctgtaagacaacaacatgtaaataacaacgaaaataacaaaatcaaaacgaagagctctgttactggacaaaatcaaaccatgagggttttagaattctgcttagtattacctgatggaaagtatttttaaatcttaaagaacaatgacaaagagcttcctgatctatgaaaagagaaaatcaacaggttgtccaactgggcaaaggctatacacacatgtcggacatcatgaaactcccacgaactcagaattccgactgagaagggctctctctgctctgaagggtgctgtcgggtacacatgctgggggcagcagcctcgttcttctgcaggtgaaggaggtgagtgtgcagacagcaggaagaaggaagcagacagagggaagagtcttaggaaaagcggaccagcaggtatggaaagaagaagccacacagggagatgcttgcagagatggaaagacagaaaccagtgacctcgtttccatctctccaggggccccgccaaactcccatgcctgggtttcctcagtcacccccattttcttttcttttctttttttttttttttgagatggagtctcgctctgtcgcccaggctggagtgcagtggtgtgatctcagctcactgcaagctctgcctcctgggttcatgccatcctcctgcctcagcctcctgagtagctgggactacaggcgcccgccaccacgcccggctaattttttgtattgttagtagagatggggtttcaccgtgttagccagagtcacccccattttcttataacaacttccacatttctgttttggtgggttcatgtgactctgctacttaaaagaacacatttaactaacaaatcaataaaagtaacaagacagtatctacccaaggaaactgaaaacctaagtccatacaaaaatccagacacagggccaggcgcggtggctcatgcctgtaatcccagcactttgggaggccgaggtgggcggatcacgaggtcaggagatcgggaccatcctggctaacacggtgaaatcccgtctctactaaaaaaaaatacaaaaaaattagccgggcgtggtggcgggcacctgtagtcccagctacttgggaggctgaggcaggagaatggcatgaacccgggaggcggagctggcagtgagccaaggtcgcgccactgcattccagcctgggcgacagagtgagacttcatctcaaaaaaaaaaaaaaaaaaaaacaaacaaacaaaaaaacacagacacaaatgttcatcacagcattcttcaccacagccaagcagtgggaacagcctgaacgcccatcacctgaagaagaaatcgagacgcagtccacacatcaacggagcatccttcagtcatgaaataagcaaactactgggtgcgaccaacatgaatcaatgtgaaaacagtatgcagagagactggaggcttccacccaggagcacacgtaaaacttctggggtgacagaagccttgatgggtttgagttacaaaggtatgtgtgtttcagaagtcattgattgaaacttaggattttggccaggcatagtggctgacacctgtaatcccaacactttgggaggccaaggcaggaggatcatatgagcacaggagttcaagaccagccagggcgatatagtgagactctgtctcgacaaacgatcaaaaaaaatcaggccaggctcagtggctcacgcctgttaatcccaacactttgggaggccgaggtgggcagatcacttgaggtcaggtgtttgaaaccagcctgggcaacatggtgaaaccctgtctctactaacaatacaaaaattagctgggaatggtggcaagcacctgtaattccagctgctcaggaggctgaggcaggagaatcacttgaacccaggaagtggaggttgcagtgagccaagatcgcgccattgcactccagcctgggtgacagagtaagactccatgtcaaaataaacaaacaaacaaacaaattagctgggtgtggtggtatgcccttgtagtcccagctactctggaggctgaggtgagagaatcacttgaacctgggaggtcgaggctgcagtgagctatggtcgtgccactgcactccagcctgggctacagagtgagacattactccagattctaccaatattacaaagaaaatgaaagaatttactaataagttcatgctaataaactcacgaatttggatgaaatggttaaacttctcaaaaagcaaaatttgtcagagataccagaagaaatagaaaatctgaatagtctgacagctaataaagacaccaaagctattaatgaaaacttctcacaaagaaaactccaagcccagatgatttcacaactgaattcttccaaacatttaaggaaaaaatagcctcaagattataggaacgcttccagagaacagaaaaaaacaaacacgtatgaactctttgtatgacacaccactgtgaccttgggaacaaaaccagacaaagatgttatcagaaaggggctcatattcagacatccctcccctgaacctacgtgcaaaaatcctaaacacaatatcggtaagtcaaatccagtgacacataaacagtactacatcacaaccaagagaggtttgtttactccaggactgcaacaatgagaaattaatgtaactcaacacattaattgaaaaaaaaaaagaaagtcatacagtcatctcaatagatgcagaaaaggcatttatcaaattaaatacccattctccacttaaaaaaaccaaaactctcagaaaagtaggattaaaaggaaattctgtcttaatctgatttttaaaatctattaaaaacataagaaacatcattcttaatggtgaaacactaaaatctttcccctgagatcaggactgagacaaggatgctgctagcacccctgtgttggtccaagccagggcaaaaacataaggaaaagaaataaaagagagaagaattaaaatggaagaaacacaactgttattatgcacagctgacatgatcgtgtttgacaaaaatctaaaataatcatcaaactattagcatccataagtgaagtttgcaaggtcattgaatgcaaggtgaaatacacaattctatcacatttctatacacaaacaataaaaaataaataaacagtgcagtagggaaaacgagactttcccgtaaatgccacagggtcaagcagatgtttatagttaatgaaaatactaggttgggcacagtggttcgtgcctgtagtcccagctacttgggaggctgaggcaggaggatcgcttgagcccactagttcaaggccacagtgagctatgatcgcatagctgcactgcagcctgggtgacagagcaagaccctgtcttaaaaaaatgaatacataaaaagaaagaggaaaatgaatcttgactgctcacctcacactggacacaaagatgaattccaaatggattacatagatccaaatgtgaagcggaaaacaatagagcttggagaataaaacgtcttcgtgactttggagtagacaaagatatcttcaataggacacaagcttaccagaaagttttttaaaatcataaaaataggccgagtatagtagctcaccctggtaatatcaatgctttgggaggctgaggtgggaggattctttgagcctaggagtttgagaccagcctgggcaacacagcaagaccccagctctatgaaaaaattttcaaaaaatcagccaggcacggtgacatgtgcctgtagtctcagctacttgcgaggctgaggcagaagcattgcttgagctcaggagttcaaagctgcagtgaaccgtgattgtgccactgcactccggcctgggtggcagaacaagacctcatctcccttttttttttttttttaaagatggagttttgctctttcgcccaggctggagtgaagttgcatgatctcgactcactgcaacctccacccccagggttcaagtgattctcctgcctcagcctctcgagtagctgggatgacaggtgtgtgccaccatgcttggctaagttttgtatttttagtagagatggggtttcaccatgttggccaggctggtcccgaactcttgacctcaggtgatccacccgcctcggcctcccaaagtgctaggattataggcgtgagccaccatgcccggccaagaccccgtctcttaaaaaaaaaaaatacgagattgaaaaggcaaattacagaattggtaattcttattaattacataaatttatgtaattaataaattcaataaaagattcagatccacaatatgtaaacagtttctacacatcattaagaaaaagatacaaccagctgggcatggtggctcatgcctataatcccagcactttgggaggctgaggcaggtagatcacttgaggccaagagttcaagatcagcctggccaatatagcaaaaccccctctctactaaaaaatacaaaaaaactagccaggcgtggtggcacacgcctgtagtcccagctactcaggaggctgaggattgcttgaacccaggaggcagaggttgcagtgagccaggatcgcgcaactgccctccagcctgggcaacagagcgagactctgtccccccaccaaaaaaaaaagaaaaaaagaatgaaagaaaggaaggaagagaaagataacaaccaaacggaaaaatggacaaaagacttgaacagaacctcacaaaaggcgatatctgaatggcccatgaacatatgaatgtgtttctcaacctcattaaccattagggagtgcaaactacaaccacagtgcaagactattaacaccaccatggctaagacgtaaaggtgtggctaagatgtggggcaaccagaactcccgaaccctgagggtggaatgcaggctggcagcgtcttctgaagtcaacacatgcaacaaacacctacaacccagcgactccattcccaggtatgcacccaggagaaatgcagacgggtgcaaaagacatgctctagaatgttcccaatgctactgttcatgacagcccacatcaggaagctgtccaaatgaccagccactgtaccatgggtgaataaatggccgtaacattcacatcacggaataccatacggcctagagaatggacaaacggcagccccacgcgagagcgtggaaaatttatgcaagactactcgccaccacggtggaaaacagcgtggaaaacttcacaagtgtcatgttgagccgagagccaggcacaaaaggtttcatactgtatgatctgatttctatcaagtacaacagtgaacctagttgtttagaagtcgcagcagtggttcccctttggggagtcatgaccacaggggcacggtgggggaccctggggctggcaatattctgctcctttatctgggtgctggttacacaagtgtgctcagcgtgaaaattcacccagtgcacactcagaatgagatcctctgggtctgtgatatgacaaatactaaaacagcctgtaatcccagcactttgggaggccgaggtaggcggatcacttgaggtcaggagttcgagaccagtctggccaacacggcgaaactctgtctctacaacaaatacaaaaattagccaggtgtggtaatgggtgcctataatctcagctacttaggaggctgagacaggagaatcgcttgaacccaggaggagtttgcagtaagccgagattgcaccactgcactccagcccggatgatggagtgagattgtctcaaaaaccaagaacaaaacaaagaaaaaaacccactaaaacagataacagggttagaagttaaaattgtagagtagctgaaacaatagaatcatatacaatttttagctacaaggagactatatcaaatgcacaattataaagatgaaaatgaacccacattctccagtgggaggcagggttcagaggactttctcttggagtctgcacctataggatcaggtctggaatccagtcagccaaagtctcatgaaaacaggtttgatgggaggaaagggaaggagaaagcaggacggacggaaagggggagtcgagagacaaacagaggaggggaaggcgggagaaacagatgcactcttctgaacagcctagtgcggaacgacatgcagaggaacggggcttgtggtggtttgagatgtgaggacggtcaggatgagcttttcacgacagcaggtggtggaggccaagtcccccaggattaaacagggaagtatggaagcacaggccctcctgccccagttgtaatcaagaggagggctccttcaagcaatgatgctgctctgaagcagatatatgggaatgcctccttttaataaactgaaattcactttcttgatgtaggtgccaaattcattcaaaaatatataaaactaacctaaacacatgccatttctattctatgggtgaagcctgtgctgagttgtcaagactgtgtattggctgggctcagtggcttacacctgtaatcctagcactttgggaggctaaggtaggaagatggcttgagcacaggagtttgagatcagcctgggcaatatggcaaaaccctgtctgtacaaaaaaaattagccaggcgtggtggcacacacctgtagtcccagctactcaggagactgaggtgggaagatcacttgagcccggaaggtagaggctgcagtgagctaagatcatgccactgcactccaccccgggtgacagagcgagaccctgtctcaaaaaaaattgcctattaaggttataagcaaacaacatgaaatagtgttatgaatacaaaatgaatgaacacctaccactttgtgtgtgtgtgtgtgtgtgtgtgtctaccatatgttcctttttttaaacttttaagttcacgggtacatgtgcaggtttgttatataggtaaagtgcgtgtcatgggggtttggtgtacagattatgtctctagccatcctaccactttttaagggtgacaaagtcttgttactcagcatgcaataactaacccaccaggctccaggctcctactacatttcagatgtggacacatccctggctgggcgtggtggctcacacctgtaatcccagcactccaggaggccaaggtggggagatcacctgaggtcagaagtctgagaccagcctggccaacttggtaaaaccccatctctactaaaaatacaaaaattagccaggcgtggtggcgcatgcctgtagtcccagctactcgggaggctgaggcagaagaatcacttgaacccaggaggtggtggttgcagtgagctgagatcgcgccactgaactccagcctgagcaaccaagcaagactccatcttgaaaaagaaaagaaaagaaaagaaaaaagacatggacgcatcccagacagatgtgaggtgtattcctccatgtgcccagtttaattctcacattcacctcgaatgtaaaagctattaccatctccgcttccagaaagagaaactgaggctcagaagggtaagtgacccgcccccaggcctcctggccagtgagcagggggctggactccatgccagggtccaggctgtggagcccatgccctttgcattcactgggatggtctgctcatgagaaattaagtcagcctgactcatcatgtccacctggggtatggccagctgcacgaaacggggagacacttcaggaagatcacccaatcaggcatgcgcatgccaccacggccatcctgtctctcagtccaaacacacacgtactcagcttctccagcatctcccgcagggtctgcagccacaagtgacacagctgctcctctggacaccagaaagtcacctgcgcccacttccagcggtgccgtcgtgctctctttacacagtgaactgcacagaagcaagcatgctcgttagtgcaaagtttgcagggtcactgacaaaacctcaagtgaatatgcaccaaatgcagctaattataggttcctaaccaaaatttcccaggggttctcctcccttctaattagtaactttcaaggtatattagaaaaaaacatccgatctttcaaaccttttaagtcatataagggaaaagggctggctgtgatgactcacgcctgtaatccagcactttgggaggctgaggcgggcagatcacctgaggtcaggagttcaagaccagcctggccaacatggtgaaaccccgtctttacttaaaatacaaaaaagtagccgggtgtggtggcgggcacctataatcccagctactcaggaggctgaggcaggagaattgcttgaacccaggaagcagaggttgaactagccgagaccgcgccactgcacttcagcttgggcaacaagagcaaaactctgtctcaaaaaaataaataaataaaaataaggggaaaaatgaccattaactaaaacattaactaaaggtagcatttggggaaaaaaataggaagatttcataaagataaaccaatgcattgagcttgttaaacaagtaacagaaaagttccctctcgtgtaatctacatagaattaatgaagaatgtgggagaagacatttaggcttatcacctgtaaaagcgtaaggcttttccattttctgccattttccactgccttgatgtttcccgtgaacgtctgtttcctcaacggcgatgatctcagatacaggcacagagcaggcatctgtaaaaacaccacgtccttctgtcaaagaattcgtcagaatccacacaggtaaaatcagtccaactccaagaagctgagaatattctgctttaatattctcattagaaattcaggctgggtgtggtggtgtgcacctgtaatcccagcactttgggaggctgaggagggaggatcgcttgagctcaggagttgcagtgggctatgatggtgacactgcactccagccctggcaacagcacaagaccccatctccaaaaagaaaaaagatatacatatatatatatatttttttgagacagagtctcacgctgtcgcccaggctggagtgcagtggttcgatctcggctcactgcaagctctgcctcccgggttcgcgccattctcctgcctcagcctcccgaacagcttttttaataccccctcccccaaaaaggaaggttataggtcacttttaaactcacaaataaataactgtgggcagctcaatgttaccagacggcgggatgttttattcagccgagtcaccaaatggaggctgtgatttttcacacgatttgctcacccattcaagcagcaaatgcggaccattccgggccagctaccatgtgaaatttggggaaacatgctcgagacatggcctctgtctgcaggacagtgcctggttcagaaatccaagtgggagggagacacgtgacaggacccgggacagctggaaccacggagcttgcaagtgaggcagagcccaagtgtggcgcgaactggagtgcagggggaggagacaggggagacttccaggggcccaggggatgacagcaccggacatgctccaccctgggaaccagcaaggacccattccacccgagccacctggggcgtgttcatctgctgggcagctgtaattacaggcttgcacatcaaagaaagttctgggctggcagcagagctgtgggaggtgacgggtaactgaagtccaaggcctgaaagaacttgcccaggagagcatgggattgaagacagcaaagccaagtttgaggaaggtggcttccaaaagcttattctggaattactgttaggcatgtatgatatatccttacacagaagaatgttataatttgtggttagcttcctaggttggctataaaacctgcaatatagctaaaataccgtatttttgccgtagctaaatgcaaaaaaaattgctataacatttgtggtaattttgcatcatttttaaagttgtggcccatggaaatcaagttctaggaacctgggagggtagtgtctgaactgggcctttgagcactgtagaaacctttgaaaggccagtagtggggcctcctgattccctctgaagtgaagccagccccaggggagcagacttgatggggagggggtgggttacagaggatgaagtctggctggagagcagaggtctcaggaggtgtctgtgtgcatcctcctcctgggtataggatgtggggtccagagtgactctcagggtccccaccctccggtgtgccccacctgggcctcccatcttttttttttttttttttttgagatgcagttttgctcctgctgcccagactggagggcaatagctccatctcggctcaccgcaacctccacctcccggttcaagcgattctccctcctcagcctcccaagtagctgagattacaggttcccaccaccaggtccagctgatttttgtatttttagtagagacagggttttgccatgttagccaggctgcaggccgtgccgtgccaggggtgccagcacaagaccaggcagtccacgtgcgtcctgccagaaggagcgacacaggtgctggggcagggaggtggtggggacagcctcactgtcagggtcagggttcagaggattccccgtgggtggaggaaggcgacgtaggggcaggagctggggagaggcagaggccgctgggaaggaaagggcgagcggctgcgagagggtggccactctgggtggagggataaggatcccacttgggtatgactctgaatagctacaagtgttcgggacagggcaagagactgaacaggaccaaggacgccctggggtgaatccaggcaccttctgccacactggacctgcagcaaggtgtacctgctcctctggcaagagaaaaagacaaagatgccagcagggtcattagtttacacacgttccttttacacacagattaataaatggaattattgtctctaaaaagggacagaaaagttaatagaggaacaaaattcaatattgtctgcacagctttattgaggaacgtcaagaataagaacacagggcggacacagtggctcacgcctgtaatcccagcactttgggaggccgaggcaggcagagcacttcgggtcaggagttcgagaccagcctggccaacatggtgaaaccccgtctctactaaaaatacaaaagttagccaggtgtggtggtgtgtgcctgtaatcccagctactcaggagattgaagcatgagagttgcttgaacccgggaggcggaggttgccgtgagccgagatcacaccagtgcactccagcctgggcaacaaagtgagactcagtctcaggaaaacaaaaaaagaagaagaagaatatagctgacctctgaacaacatgggcttaaccttcaagggtccactaatgtggggttttcttcttttttttttgtttttgaaatggagtcttgctcgtcacccaggtgtggtgtgatcttggctcgctgcaacctccgcttcccaggttcaagtgattctcctgcctcagcctcctgagtagctgggattataggcgcctgccaccgcacccggctaacttttgtacttttagtagagacgggatttcaccatgttggccaggatggtcttgaactcctgacctcaggtgatctgcccgcctcggcctcccacagtactgggattacaggcatgagccaccgcgcctggccagatttttcaataaaagtgacactaagctcacttgcctctcttgcctccccttccacctcctccgtcttctccacctccaccaccgctaagacagcacgactgatccctcctctcctcttcctcctcagcccactcaacatgaagaccatgaggatggagacctttgtaatgatccacttccacttaccagatagtaaacacattttctcttccttatggttttcttaaccacgttttcttttctctagcttattttattgtaataatacagcatataaatcaggccacataggaaatatgtgttcatcggctatttacattatcgcaaggcgtccagtcaacagtaggctgttagtagttaagtgctgggggagtcaaaagttttcaactgtgtggggctggggcgctaacccccatgttgtttgagggtcaatctgcactgggtgcggctcaggacaagggcttccttgctgactcaggagacctggagtggtgcggccatggtgggaacacattccccaggtggcaatgagtggctggacttggcgtggctttggcctgtatctggctgcagtcttactgtgggtaagccgctaagcctggagcatggtgtaaagggggtggagcgatgaaccccataggggattagaaactggaataagataaagggtgaaaaagtttcaagcacaaaaatgtccgataaatgatggcttcctttcttgccaaaaaggctgggctcagcagggcggggtggctcacacctgtaatccctgcactttgggaggctaaggtgggcggatcacgaggtcaggagatcgagaccaccctggctaacatggtgaaaccccgactctactaaaaatacacaaaaaattagccgggtgtggtggcgggcacctgtagccccagctactcaggaggctgaggcaggagaatggcatgaaccagggaggcggggcttgcagtgagccaagattgcgccactgcactccagcctgggcgaaagacagcaaaactccatctcaaaaaaaaaagaaaaagaaggctgggctcaagatggaggctctgcctccttcctccttcaggccattgtccctgtgttaagctgaggactccacagtgagagaactccacagtgagacgcctccagcctagcagcacttaccccttctcctgctctcctcacctcggtgtgtcatcggcattacgccctagtcttcgatactctcatttctaattaggagataaagaaccgggccaagaatctgagcaaacggagagcagctccctgcgggggctcaggaaacacttgccagcgtccaccggttggagagctggcgcctgctcatctgagggcaggtcatgtggacggcagtgggaccaccgagggctggcacacagaagaatgcggacggtcctctagaagcagaaggaactgccctctgagggttagtctcaaattgccggcaccaagcagcatccccgcacagcacgtggtgtgtggacatgccacagcatccgcgggagaaaacacacctgacccaggtggacagatgctgtgggaacatcttgcaaagggcggaaggtgggaattgggggcactttcatattcttttgctgacagagataaattctcgtgacagaattctcgtgagacaccacagtgactcgtattgacatgcagtgagctcttcaatagaggtaatgatcaaatggccatcacattccagaaaaatcaaatgccatgtcagcgagtgaggctggcctcctggttctcgtgcggctcacgcgtttgctgactccctctctgcagaccactgcagcatttgccacagtctgggtaatgcctgctaggggcagctgagagcacgctgacttccagctgcttctttttccattctgttctctgtgctttttagtgcttgttgtgatccactagaattaaatttatttcatgcttgtgacttacagatgaaaacagtgcctgctgtcaatcagctttgatactagaagttcccggattaaactgagccacgcgcagtggcctcccatccagcaggagggcccacgggtttcccgtgtgtcacggggcactgagtgtctgccagtgacatgggtgcacgtgtgtgggcacgctcatggcagggcagggtcaaggtggcagaacatgccgctccagacctcacgcagccgtcgggaggccccagatgtctttcgcctcttgggcatatgcaacgagaacaagagcgagttcccagctaagagcacaggggagcacagcggtccctgggactctccctaatgcaagctgccacgtgaggaccggcagagggaacagggtgagagagcaggccgctgcccactgcgcccactggagcagtgccaagtacagtgtggaagtctgtggatcacacccacacacactgcaggggatgctgaggcccagaagtggcacgggccacactgacctccacatgcccggcccgcttagagtccaagcagtaagggtcaccccagaggaagaacacccaagagatccgagtggctgggaggcctgattccccctgcaatgacatgcaatgcaaacgcatttccctggcaacccgccgctcagtaaacatgagctgtgtgaacatctgatcttcattaaaaattaaaggtgagtgcttgcctatgccaaggaagaccaaaaaccagccctgcccaccactgccagggagagtccagaaatctcacgtgcaggaaactcagagatggtcaaactgtcccccgcccctccccgcccaccacgtccaccctgacacagcccttgatgggtctgatacacagatggaaggtgggggaagccagaacccacgtgacgcccacaggtcagccctgagctgcgacttatccagacgcgactgcgtgtccccagcccttgcctccgctgcggctgctgctgtcatacagggatgcgcccaagtttcgtcttttatgggaaaccttctgattgtaaaacattagctacaattttaaaaggaagagaaaaactcaccatgcaaatctaacaaagaaaaaaatctgtggccaaatttagcccaaagacctctgctctgcaacccagtgaggctgagccgtggtttttctgaccgcacggatgatgaagaaaatctcacagcaagcccccagagttcatgatgctgggataaggtacctgccaatcataacttactgctatttcatgccataaaatgtgacctttgacccttgtcagcacaccattagtagccaccaatgtctcctcttctttttttttttgagacaggtctcactgtgtcacccaggctggagtacaggggtgcaatctcagctcactgcagcctcgacctcccaggctcatgcaatcctcccacctcagcttcccaagtagttgggaccacaggtgtgtgccaccatgcccagctgtttctttttttttttttttttgagagatggggtctctctgtgttgccctcagagacctggttggtctctctaactcctgggctcaagcgatccatccactcagcctcccaaagtgttgggattacaggcgtgagccactgtgcccagtcttcttagttctagggacacatctcaagtaaacagtgtccattccctgtggaacccaccccagaaatccttcctcgtcctaacgtcccgataccagcctaagggtgctgtggtccgcgtgccccactctcaggcaggggcctggtcagcatcccacaggaccacccggtgaccacccaaggtccatgggcttctgaacatcctgcacatgccgccccaacactcccctggcccagccaccccccccggccctgccacccccgcggctccttagcatggatgctcccttagcatgcacaggaggcctggacctgaggatgccaaatcattcctctcaggaaacagggctgtggcatgtggacgggcatgtcacctgcacagcccacgtggcagccaacacacaggactttgcttttcctgttaagccaggaggttctggagggcagggtggaattacacacctgcgcagcccctgtgtgtgggttcaggaaatgaatcagactaatcctagacctgcttagacgacacccgcagaactgaagtccataccagctggcatctcaacacagaacacccgccgtccccactccatgctgtcaggtcgcgggaaacctgcatcagcctcccgtcctagggatgagacggggtgtccaagggctccagggaccgtacggtgcctcagggaactttgtcatgggaactggactgattttgctccaggaaccccgctcttccccccgtgcaccctgctatgaaaggccacgggggctacttaaacaaatcccagagtccctgcctttgaagagggagctcaccccagattctggagcagcctcgctctgagtccccactccccaacctgtgagctcagctctaagtcccacatctccacctctgagaagataacaaggggcgtctcagagggctatgaggatcccattgggtgtgaagcccgcagcactgcagggcacagtacacgctggcctaaatggaaagcagcattcagacatctagttctggccagaatgaaccaagcccgaccgcctgtctctcccacccgctatgactgatagctctggacaagatacaagaaacaggcagtgaaccggggacaccagagatccacagcagcaggcccgctggctggagaggccagcgtgcagagtcagcagctgggagctgggtttatctccagctctggcctcggggacgtctgagctatggggcagcagggtgggtgcaggcccctgtcccagagaagccagggtgtgctgagggcagaggggtgctcagaggagagggggctggagcaggaatacttggctctgagaatgaccagatgagtccagcctcactcctgaggggccaaaacagggcagccagggcctcggaggctggacagccagggcccacctccctcgccacatgagacagacctgccatctgtacccagccaggctgagcacctgcttttgaaaaagaaaaattggctgggtctggtgtctcatgcctgtaattccagcactttgggaggctgaagcgggaggactgcttgaggccagaagattgagaccaacctggacaacatagtgaggccctgtctctacaaaataaattttaaaaattagggagaatgatggtacatgcctgtagttccagctacttgagaggctgaggtaggaggacggcttgtgctcaagaggctgcagtgagccaaaactgagccactgcactccagcctgggaaacagtgagactgtaaataaataaattaattaatttaattaaatagaaaaattgtccaaatgactttattttttattaattttttttaagagacagggtcttgctctgtcactcaggatggagtacagtggtacaatcatggaacaccgtaacctcgaattcctggtgtcaaatgctcctcctgccccagcctcctgagtagctgggactacaggcatgcacaacacccagcctccaaaaaacattaacaggacttggccttacaaaataatgtaccaaatatccaggaaacaacccacaataaatcagcacaccaagaaccaggaaatgttaacgttctcaagggaataatcaaaagacgtcaaacctgagatgacccagatgttgatgttatcagacaaagacttcaaagtagtctttggccaggcgcggtggctcatgcctgtaatcccagcattttgggaggccgaggcaggtgaatcacgagggcaggagatcgagaccatcctggctaacacggtgaaaccctgtccctactaaaaatacaaaaaattagccaggcgtggtggcaggcgcctgtagtcccagctactcaggaggctgaggcaggagaatggcgtgaacctgggaggcggagcttgcagtgagccaagatcgcaccactgcactccagcctgggtgacagatcgagactccatctcaaaacaaacaaacaaacaaacaaacaaaaaacaaagcagctgttataaccatgctcactgagacacagttgaacatacttgaagttttcaggaaagaggctgggagtggtggctcacgcctgtaatcctagcactttgggaggccaaggcgggcagattgcctgagctcaggagttcaagaccagcctgggtaacatggcaaatccctgtctctactaaaaaaaaaaaaaaaaatagccaggcatggtggcaggcacctgtaatcccagctactcagaaggctgaggcacgagaactgcttgaacccaggaggtggagtttgcagtgagtcgagatcacaccattacactccagtctgggtaacagagtgacagtctatctcaaaaaaaaaagaagttttcaggaaagaaatggaaactattggaaccaaaaggaaaaatttaaaactggaaagtacagtatctgaaatttaaaaatcaccagataggcttagcagcagaatgaattagatagaggaatagtgaagttgaaaataggtcagcagaaagaatctattctaaagagcagagagaaagaaattgttttaatgcacaagcaccttctgcttctgggaggatggattagctgtgcttttcctactcctcctattaagtgaagccctggacgtcacacatgaaacaaatataagaagactctgacaggcagagaaaaggcagctgttcagggcctgggatctgagaaagacacacggcatccccctgggggtttcctttgcctcgtctatcttggatttggaactggagcagcctgaaacctggaaatgccaacaggtacaaacgcagagccccagtgaaagccaactcagtctagccagggaaggggcagctttgcaagacagaaaactttgagacaataacaacctaccccagaaaaaaacgggcccagccctccaaccaagcccaagtggccaactagcagcttagacttccacccttgagaggctgtgagcaggcaccccacaacctctgccagggctgtacaggggaggccacgcaggaagctggaacccccatcagcgccagctggtaaaaagcctcatgcccactaggcattggtggagacaaaggggcagcccagcccgggcccccaccctgcactggcgaggtgccccttcctccttgctggagtggagtaagaggaggcctggtggggagacagggctttcactgccactgagctgcaaggtgcccacactccacccacgtgctgttaggggagtgcatgtggggagcggcaaggaagcacctccaccccccgccaaggtggccttagcagaggcctggcgggagctgtaccccccacccacccggcaatgacaagcagcccctgactccgctgccaacaaggctgaggggaacctgggcttccacccccacctggcagtaccagcgccgttccctgctggagcagtgccagagaaaccagctaaacagaaggtgtaaacgctgcccagtcttggaacatactgcaaaataaccagtgctaggtgagtctgggaaggagggctgggccttggtgaggctgaggatagaggaaaacatgtcaggcagggagggcagagggcacctggggaggcacagggcatgcgggagataatgacggctgggctggtgagcacgtgtgccccgggagcaggtgggggcagggccagatcgggggaggtcaggaatgcaagccaggccacaggcacgcatgggcgagcagtgcctggaagaactttgtagcagggcagggtgtctaaacatcaatggggcacacaggctggctgtcaggacgggccaacggcactggagaagggattagtgaccctcagggtgctctctaaacttccaatccccatcatccagggttcagccgccggggtgctccctaaagaaattcaaaaggcagcaggaggggtcgggaggggaagaccggggccagctggaggcagaagtcatctgacccagtctgtggcaaaaaggggaccaaggtcagcgagaaaggagagaagaggtatgggatccggacagccgaatcgagaacccagcagacgtgtgggatccggacagccgaatcgagaacccagcaggcggtgagggtgggccactggcctaggagagaggccgagtagctggagcttgtatgcgggtgacaggctggctgtctccaggacagaggagaactcgtgcctggaagtccacgctgggctaatcgctgaagccattaagttgagatgcatcctggaccagctacaggttcctgagataaccctcaaaaggcaggactcagctgcatttctcatagaaaacgctgttatgcaaaaatctagactgttagagaagaaaaataaattgggtgggggggacgggaagtaaaacacattaggagtttcttaaacacacagaaagtgtatcttctcgagtatgaaagtttcttaaatactggtggtttaatttctctgggatagataatcaaaaatggaattgttgggtcaaaggatatcactttttttttttttttttacagtttgaaaacactgccagattactttccaaaaacaccctagcagttcccacttcccattcaccgggtctgccagcccagaagcgtcctgaaacttccccagcacagagctgtgctttcgcccttccccatcccttgctggttgagagcagcatctcatcattgccttgggtcagtatctactcagacgctcagcatccacttccgaatgttttcttccgtgaatcgcctacttatatccattgccatttgtctaatggattgtctgccttttttcctatcaatttttatgtaagtttaaaatgttcaaaaaatgttaacctggccaggcgcggtggctcacgcctgtaatcccagcacttaaggaggccaaagagggaggatcacgaggtcaggagattgagaccatcctggctaacacagtgaaaccccatctcttctaaaaatacaaaaaattagccgggtgcaatggtgggtgcctgtagtcccagctactcgggaggctgaggcaggtgaatggtgtgaacccgggaggcggagcttgcagtgagctgagatcacgccactgcactccagccctgggcgacagagtgggactctgtctcaaaaaaaaaaaaaaaaaaaaaattaaccctttctctatcctatttgttgcaaatatcacccccatcattttttatttttattttattattattattattatttgagatggagtctcgccgtgttgcccaggctggagtgcagtggtgcaatcacagctcactgcaacctccgcctcccaggttcaagagattctcgtgcctcagcctcctgagaggctgggattataggcgcacgccaacatgcctggctaatttttgtatttttagtagagacagggtttcaccatgttgggcaggctggtcacgacctcctgacatcaagtgatccacccgcctcggcctcccaaagtgctgggattacaggtgtgagccaccacgcccggcccttatctttttttttaaatttatgatatcttacaaaagaaattttaaaattatttcgtcaaataatctagctttttctttattctttctggattccatcttggttaggagagccttttcccattccaatattataaactgtcctctattttcttgtaagaatttacagccaggtgcagtggctaacgcctgtaatcccaacactttgggaggccgaggcaggcagatcatctgaggtcaggagttcgagactagcctggccaacatggtgaaaccctgtctctactaaaaatacaaaaattagctggtggcaggtgcccataatcccagctactcaggaggctaaggcaggagaatcacttgaacccgggaggtggaggttgcagtgagccgagaccttgccacttcactccagcctgggaaacagaggaagactccaaaaatataataaaatatgttatatatacatacatacatatatatatatatatatatacattttcctataatccagctttctactcttaaatatgcacccaagaggagcaaaagcatagcccctaaagggtcagggtgtctttatccacatagtcaaggtgaatggactgcaaactgtccagaagcccatcagcaggtgaacggatacactagtgcacccacacaatgcaatatgacttagtaaccagaaagaaggaactgctgacatgatgaatcttaaaaaaaacaaaatgagataaagcagccgggcacaaagacgtgcacatggcatgattccatttacatgagataaagcagccgggcacaaagacgtgcacatggcatgattccatttacatgagataaagcagccgggcacaaagacgtgcacatggcatgattccatttacatgaaactctattagcatcgtgcctgtccctggtgagaaaacagcccagggcccaggagaaggtgctgggctgctgcgatccgggtgatgtttacacaggtgcacacaattatcaaaatttaaccaactatgtgccttaaaatgtctgagttttattgcatgcaatttagaccttgataaaatcgatttttaaaaatcatgtcttaggagaggaattagtagcgtggaaaacactctgcagtatgttttctcagcttttctttcatgcatatttacatatacacaaataccaaatattaatcacgtctaagtcgaagagtgactttttgtgtatgcttttctgtgttttctcgatattattaaatcaacatgacttacttttgtaagcaggaaaaacatttttttaaagtatctgtggcatgcctatgttttgccaggcactttgcagggtgtgctgaggacacgctttataaacacagtactgacctgcccaacgagttcaccaccagcctgggacatcccaagtggggttggtggaaggaaggggaggatcctcccacaaaggtagagcctgggcagtagtcccctcaccccccaacacacacacacacacacacacactcttcccattcccaactctaaaggaataaatgcagggtttgtctaagtgtgttttgcgacagtcaggggaaataacccagatatcaactcagtgtttccagttcaacgagcatgacccacttcaagttcctgttttcgtcctgccctacttcccaccaggctggcggcccagggcacttgctgtcgcggcttcctcaggtgcagacctcacccaggcccaggaagctgcagcgatccaaattgctagtccttgtctgtgctcttgtacagtcagtcactgtcccagcatgatgacccactgacgaaagtgcacgtgcctgggttcaaagccagctccctctgtacatcactgcctctgggcccagtcaattcccactcctactgtccacatctgaaataggggtgatgctacggagaaaacaaaggagtcggaataactaagcggccaccccagcagggcacacacagtggccttggctttgtctttagcccattggtcacctggagctccagggctgctcctgcctcatctcacaggtcctcctagggccagtttttgcacaattctccacctctcatcattcctcaacctaatcaatcccagtgtgcccagatacacctgggggaatggggagggctgggcaatgccaccttgctgaccaaattaaatgtcctgtgagctggttcacattcttctgccctactatggccctactgacctcaagcatagaagaatcgaacctgggcctgattccttttggggactgtaaagctatgagaaaaaaactagagacagtgtggctgtattcctgaactcattcacaacttagcgtttcccaacttgttgatgttttcccattgcatgggagagcactcctgggtggagagggcaggctgcttcctggaggaagcccaccagccagggccaccagccagggccccaccatccatggccccacaaaccagggccctccctctccaagagggaccaagctcctggcaggccagtcaggcagctcaggatgaacccgcacaaaagcaccttggcttagcaagagtgaagcaattagcatgccaagaggcaaaccccagcaggctggacaaaagcagacgccacaccacaccaagccctgacctgggggaccagaaaccataatgggagctggctggggacgccaaggcagaaagcagtgatgactgacctcccacacagatgccctgtaagggtctggcgtctctgcggcggctggagcctgagggaagccttacagcccagtggctacaagcacagcagctaattgggccagtcacttccagcccctgcagatcggcccctgcatccctaggacgggagcagctgcctctcaggaacccatccggtttgaagcccagtggcccgcacttaggaagtgcttgggggaggcagtcatcttcctgaagcctagggatttacaacaaagtacaaacccttcgggcccaggtcaggcacctgttctccttgtgtgtgggccctggtgggtgatatttggggtgtgacatttctaccaaaggggacatgagaaataccttaggaaagtcaagtctcagatgcccagccacagataggtgaccccagggctggaaaccaagtgttggtcatgggtctgagaccacccctcgaccttggccccacctaacgttcaactctgtccccaccagaacccaacccacagatcctcaccactcagcaccagaaagcgcccagaagaactcctgacctcgactgcccacagggtctaaaggtgtcatcccaggctccgaatatccaccagagaatcttggcctccgccacacccaccccattccagctccgcacatccagcatgaatcctggcctctgccacacccaccccaataattaaaaagaaaaaaggctgggtgcggttgctcacacctgtaatcccagcactttgagaggctgaggtgggcagatcacctgaggtcaggaattcaagaccagcctggccaacatggtgaaaccctgtctctactaaaatacaaaaattagccgggcgtagtagcgggctcctgtaatcccagctactccgaggctgaggcagggagaattgcttgaacccaggaggcggaggtgcagtgagccaagatcgtggcattgaactccagcctgggcaacagagcaacactccgactcaaaaaaaaaaaaaaacaaaaaacaaacaaaaaacaacaaaaaacaaaaacaaaccctctgtcctcctgcagggctctctccagggtgggctatgcgtcctccatgtttaccaaagtcactcttctcctcatccggagggcctctgcggggcaagtagccaacccgtggcacggaaaccaattcccccatcccgagcagggagcacaccccacagaaagtcaggggccccttctttaacttcttaacaggaagtcctcaccctgcaagggcgcctctcaggtttcggatccctgctaaagaaaagcatctgttcttggagtaaactgcaatgcgcgcggtggggagcgcctggcaccccccctcgggatccatccacagtccgtcttgtccagaggtgccctgcggacagaccgcaccgggggccacgaccccgcgccccgggtcccacctccccgcggggatggggcgccggcctcccctccactgcgcggcgctttgtcctcgggttcccggagcagacggcggcgcacagcccggcccctggccccggcctccctcccgcctgccccgacccctccctggcgcctgcgctcccagggcccccggccttaccacagccgctcgctccctgcacccggtccccccagccgggtcccccaagccgcccccgctccctggccaggtccggccgaacccgggcggcggcgacactcacccgcgccgggggcgccggctccgggccccgggctccgccaccagcgcagcagagcccgcgcgggctccaggctcacggcgcagcgctgctgcttcacccacagcacggattgcagcggctccgccgcccccgtcgcccccatctccgccgccgggctcgtccgccaggctgggggcgcgcggacgccgaggggcgccggaccgttagcggcccctgcagtggcccgggcggcgggcggcgggcggcggg

SEQ ID NO: 574 - DNA, 9968 bp, Homo sapiens
gttgcagcttagtaatagttttacttattaacttacttaaaaagagataatgaacatttgtgaaattgtttacaattgagatatccatacacacaagtcatgtgctgtgtgatgttttggtcagtgactgcatatatgatagtggtcccataaaattatgatcctatatttttactgtacttttctgttcagatacacgaatacttaccactgtgttacaactgtgtacagtactcagcacagtgatgtgttgcacaggtgcgtagcttaggagcaacaggctgtaccatatagcctaggtgtgtaataggctataccatctaggtttgtgtcagtgtactctatgatgttcacgtcacgatgaaatcacccaagacacatttctcagaatgtatccccatcattaagcaacacatgactgtatatatacatttactaatgtttgttatttttaatacagaaaagtttcttctttgctttttagaaattttatcagttacaaaaggaaataacatttagaaaacagtttcaactttcataggcaaaacatacacatgaaccacacatagggctgagtggatgtttccttattgctaagtccatagcctctagtatgatgcccaagtgtcataactacactcccacatcagcaaactcctccctcttaatatgctcagtgatttctatctcacccttccttacttcctttgcaattcaagtaagaaaacaaacaatttagatgttcgagtataggaaatatttgccgagaccagcttggtcatggagaccctaacccagaggcgctagagaaattaaagacacacacccagaaatatagcatgcagagtgggaaatcaggggactcacagctttcagagctgagagccccgaacagagatttacccatgtttattgacagcaagccagtgataaacattgtttctatagattatagattaactaaaagtattccttcccaaacgaaacaaaggcatggggtctggctagttatctgcagcaggaacatgtccttaaggcacagatcgctcatgctattgtttgtagtttaggaacgcctttaagccgttttcccgccctgggtggtccaggtgttccttgctctcattccggtaaaccttcagcatggcgtcatggccatcatgaacctgtcacagtactgcagagattttgtttatggccagatttgggggcatatccccagcaaatattggttaagtctgtgcttcagactagatttttcaagtctactggcttgtttgaaaaacgcttttagacaacacatcaggtttgtaacttttcacaagtttaaaatatttcaaaggtctttgaaaattataaaatcttgaaatatctctattttagttttccgaggggtgctgttttgacagatttgaaatttttttatttgaataaaaagccatcactctttcattcaatttagtgcctagatgtttccttagagcctgggttgttgttccaagaatctgtggagagtaccaacttagcctgctgctgcaaagacgaaggaatcctttctcagagaaaactcaagactgaatatggtagactggattttccagagatggctgtggacataggctatcaaagggtttttgggatacacagtcccacatgccccttccctcccattgcattcacaatggatcacctttcgattaaatttcaccagctcatccccggtaattttttatttgactggaaacatgggcttttaaaacacacacagggctctcctttagcctgcagaatgtgggtatatctttactattttctcctgctcataaaaatacatgcttttcactaaacgagttaaataaccacccataattcacccacaagtttggtgtactttcttccagtattttaaatatgcaaaaatatcgttttatttgtatttactacctgtgtaactatatgcttagcctttttccccccattttgagtttatttttaattcagggattaggtagccagagtctggcctagtgacttctgacctttcacttgtgatctcttatccatcttcggccagaggcctctttttgtagcccagcctcatctcttgtggaccttgaacaaatttctccagctactgtcaaatgcctgagatttgttaaccacaccatttatttttgctaacactagttaacaaataagcttttctagaagagctaggtggaatatgtcatcagagacttggaatgaaaacaaaatacccttggtaacttacttgcacctgcgtcttcctcagactgcaaagtggtcaccagcaattcagagaggctccagtaacaagcagcttcactttttatcacgtaacctaaccatcttgaggttatgtgtcaaaggaagaagacatttccttttctaaaaagtcaactgctttcttctttactaaaacaatttaggggctgggcgcagtggctcacatctgtaatcccaacactttgggaggctgaggcaggtggatcacgaggtcgagagttcaagaccagcctggccaagatggtgaaaccctctctctactaaaaatacactaggcgtggtggcacgcgcctgtaatcccagctactcgggaggctgaggcagagaattgcttaaacccgggaggcagaggttgcagtgagctgagatcacactactgcactccagccttggtgacagagtgagagagactccgtctcataaaaaaaaaaaatgtaggtttgtccttccaaattgtttatcaaattttggtagattcaggagttgggtaacacacagtaactgggcagctgatataaagtctgtatttttataactactcaagagccaggaagccagctttctgctagcatctttctcctaacataccattggcacatgaagttattatttcagagcttaattatatttcctgactacacaaaaagccaatgcattaaaaaaaggcccacctttatatacgaattaaaatttatttcaaactgttttgtacatctttttaaaaaatgaaaattcaaaagtcttagaattaagcaatgagtctttgatatcataaagctgtgtataacaataattaaagtagtggtaacattttacccttgtaaaaatgtcacagaattaaaatctcaacttggatcctcaatgattcaactggtttatcttacacaataagcgtttggtcagtttcaagataaaatttccccagacatgctgtccttaagtccttcctcctcaccatccatcagctcacacattggggtagctggctgctgtggcgattccacagtggttgttcttgtctttggctatttttacatagccattcgagccccattctggaccccagctgaaagaggagcaggttttccattttatacaaggaatcaagggaaaattggctccattaataataatagctaatacttaaacagtgcttcccatgtgtcaggcactattctaaatgctgttaatatccatttataaatgtcctgaggctgggcacagtggctcacgcctgcaatcccagcactttgggaggccgaggtgggcagatcacttgaggtcaggagtttgagaccagcttggccaatctggtgaaacctcgtctctattaaaaatacaaaaattggccaggtgcggtgcatgcctgtaatcccagcactttgggaggctgaggcgggtggatcacctgaggtttcaggagtttgagaccagcttgaccaacatggtgaaaccctgcctctactaaattaaaaaaaaaaaaaaaaaaaattaaccgggcatgtaatcccagctacttgggaggctgaggcaggagaatcatcatttgaacccaggaggcagaggttccagtgagccaagattgcaccactgcacttcagcctgggcaagaagagcaaaactccatctcaaaagaaaaaaacaaacaaaaaaacccccataaaaattggccaggcgtggtggcgcatgcctatagtcccagctacttgggaggctgaggcaggagaatcacttgaacccgagaggtggaggctgcagtgagccgagattgcaccactgcactcttgcctgagtgacagagcaagactccatctcagaataaaataaaactggctgggcacggtggctcatgtctgtaataccagtgctttgggaggccaaggcaggcggatcacatgaggtcagttcgacagcagcctggcatacatggtgaaaccccgtctctactaaaaaatacaaaaaaaattagctgggtatggtagcacatccctgtagtcccagctacttgggaggctgaggcaggagaatcacttgaactcaggaggcagaggttgcagtgagctgagatcgtgccactgcactccagcctgggtgacagagcgacactctgtctcaaaaaataaataaacaaatgaatgaatgaatatattgattcttgtgggtccttaactatttaagatactgaggcagaactggaattccactgtagcagtctgtccccacatactaccttatgtcacatctcaattaaagaatgctaattgtgagaaaatagattctgacaaccttcaaagcctgagagctggggagtgaaattcgatgacagggcatccaatgacaatagaaggatgcacacagaccactggactcccggatgatctctcagacttaacaaagaaccagcagaggcagatgtttctgcttactattccttgttgaaaaattagacagaaaaaagcaatcagctctcaaacctacaggtccacagtcctttgtctgaaacccttgaggactaatgtgtttcagaatttaaaaattttcaaaacttagtaataaaatattacaaatacatagcaataactccaaaaagcttggtacggaatcttataatcaaacattaatatttctgtgttcactctaagtagaagaaagactttcggaattttgaaattgagcttttgtgaacttgtatccaaatactgatttggaacaaaaattcccttttcaattttgagttttatacctgtttttgacgagccaatacttgctgttattcgaatttgctccttcaaagccgtagccaaccaccagaacaccatgatccaggtttttgctgctgcagtctggttcaaaataaatgcctgggagagtaaaattaatgctggggtgagaagctccaagcgacatgtgacagtaacccaccctaccaccctccataagggaggcatctctaaattcagtaaaatgtcataaacaaatgccaaataaggacccaaacaatattggccggaaaacagtaatggctgataaaggaaaaaagtcaacctcaactcactagaaatcaactaacttcaactaagttcaagatattttctaccaaaaaaaatgaaaatccaaaagataaaacctattgtttacagctaaggtgatttagatatctctgagcccaaataccaactcgcataatccctttctgttcctaggatgtcagtctaaaatagcaccaaaataaacaaacaaaaacttgaaggggattctttacagtcctaattacagtagtaaaaaactttgagaaaaaaaggcccaacaactggaaaatagtttggaaaattaggttgtctctatacaattacatagccatttaaaaatatttatgagaagtttaacataactaagtattttctcatgtcaaatgcaaacatcactatgttaaatgctcactctcaaaatactacattcctgcaaagcaggatgtcatatccaagaatcaatcacagtgatgcttcccaattctgcctaaatttctataataaaatgacacttacctgatttgtagaactggaaggacgaatggcctgcatccatagcaacggagatgggccccacagttgcgactgctttcatcagggccttctcctttccaggtgcgaccactgtgaagccagtgtcattagcaacagaattctcaggtctgtacttacagatttcatccttttaaagttaaagggggagagacttgatcactaccatctacctcctggggaacattagttctagaaccgaaacactcagcaatttgcaacctaggatttccaaatcaacacccttataaatcgtcccatgaaataaaatgctatttgttgatttgaaaatgaaaaattagttgacatttcttcaatgagaacccctaggtcaatctgtccataaaaaatttttcacaatggataaagttctattatatgtagaatggtttgcttattctccatgttatgtaaaagcaagaacagctgtgtgttaaccatctaatggtacttatatggtaaccattagctgttgaccatctcaccagagaactgtgcaaaggctaataatttttttttttttttgagatggagtctcgctctgcggcccaggctggagtgtagtggtgcgatcttggctcactgcaagctccgcctcccgggttcacgtcattctcctgcctcagtctcctgagtagctgggactacgggcacccgccaccaggccgggctaatttttttgtatttttagtagagacggggtttcactgtgttagccaggattgtcttgatctcctgacctcgtgatccgcctgtctcggcctcccaaactgctgggattacaggtgatccaccacgcctggccaaaggctaataatttataatgacaatactcacggtttgcagatgtagattctaccatataaaatgtgaattctgaaaaaagtatctgttatctctgaaagtgttccactttccaaaagcagagcacgaatgacaagataaggagctccatttaccactgctacatatggataggattcctcagagtccaggcctccgttctccttgacatactggaaggccctagccatgaagccaccattgcagccctgattgccttgaggacgcgaacagtccaccagattctgctcgctcagtgagacaagtttcccagttttccggaacatctgtccttcaagagcaccagtcgcactaaaagcccaacaagaaccacactgtttctaaaaagggagaaaaaaaaagctgtaaatttacaagaccaatacaaatacagtaccccataattgaattaccttaatattctttaaaaaaaaaaaaaacccatcgccacactttgggaggccgaggcgggcagatcacttgaggagaggagtttgaaatccgcctggccaacatggtgaaaccctgtcgctactaaaaatacacaaaaattagctgggcatggtggtgagcacttgcaatcccagctactcgggaggtggaggcaggagaatctcttgaacccaggaggcagaggttgcagtgagacgagatcacgccattgcaatccagcctgggcaacaagagctaaactccgtctcaaacaagcaaacaaaaaaaacaccaaaaaccaaaaatacaaaaaacccatcaccatatgttgtgccaccatctaccacagcaatgacaccaattccttcttggctttcctgtggagacagggtctgaatctgacgctgtctcacctgattcttcactggcgtcacgtagcctttctttctccaatccacagatttgggaagatcaagaaacagaggctcacggaacactttccccttcctgaatttctggtttcgaaagcaacccatcatctgcctgaattcttcattggtcttcaaggagaagtaaataaaatgttaaaagcaagactattttggtgaagaactgagaagcagcacagagttcagcaatccttgccacactcaccatgtcaccaaaagcattcatggccattgtgaagccatgtttcccttggctgtattccccattgtgcagttcaatcattttcatattcttttcccacactgctctcctccatccttcttcattctagaggcaaacatatagctggtggactttatgtctacttacccaacccatgttcaccaagccgatttgcgggcagaaatggaagagaaaccatggccagggatgggttgatacttctctgggagctgttctccaagccaagacacaatggagatatatgcccatattgcacctataatgggtgctgttaggttattgcctggtaaggtctggtgtctagaagctactctctggctatcaactcccaacagcgaggaccattctctccagagtccctctggacagtttcagatgttaccaaccgcgccatataatcttctgtgtgttgccttccactggtaccactttgtatccaaattttggtcaaattttggaacagcggaggctattcccaagcaaaaggcagccaggacgagcgaaagattcatgtttcaaaacctagaaagagaaaagaaatgagtatctgattagaccaatcctaaaaagccatcttacagcccccgtggaatagaaatatttcaattattctccctagcatttccccaaggactgtggaagaggctgaaacaggccaagtggaggtatttgatgggcccaccaaaattaaaagcagcctgcagagttggaggcgttgaaacagcatatgcgataatttagggtatgagaagggtgtgaaagatacctgacgggtgagaagcttaaggcaacaactagaaaactaggaaagagttggtccaggttttgcaccaattgtactgaggtcatccaggcaaaacctcactaatgaagacgtaccatcccaagtagatgcaagcggatccccaaggaacaccacctcacaccttcttggctgatacacagcaggagatgagctatgtcttccaacctctccttttggaataaaacctttcgggaatccctttccaggagacactgggaaggagagcacccactattcccgccgtcccacacttgggtctgtgctactcgctcccctaaaccggggcagggtcacaaggccgcgccgctggaagccaggggccccagggccagggcccggaccgaggcaggcagctcccggagctccgggcgggccaggaccggggccgcaccgcctgctctcgccctctgcacgcgccgccgcgccccgagaatgtttgcggcggtgcagggagcgggggctccgcggccaggctgggggcatgaagccgcccggtccggtccggcttcagcccacaggatgactgacctgccccgcccgggccctcccagtggtgccggcgcctccctggggtctccaaccgccctcccccgttccccacctcgaggctggcagagctccgggcagaagctctcactcccagaagcgcccgcctcctctcagtgtccctaaaggggggttccctcctccagtcccccttcgccctgtccctcggtctggtcgggggcgctcaccagcagccgtcgcagctgcgcaggcaccctcagcaaacaagcctctgagattacagacgtccgcggtctggtgcaggttcgcccgcctcgggatttaagtttccaggcggccttccccgcccccaccgccttcccgcgctgcgattggctgtgccggccactgggcggggccccgggcgcttagagcccgcgcgtgacgcagcccagtcccaacccgtctcaggtctgggcgcgcctacctcaatacaccctggctgcgggaagctgggccgggcgcccgggggctgcgcggaggagggggaggcgcctccctcaagggctcagatctactgactatcccgacttactgcgctgagcgggtggtttacagcgagctctgtgtggtatttcagtccctactttaacttagtcctagagtttttggtgaaaatctgcagggccgggagccagggtactctcgttcagtggctcctgtttagtccacggcaaaggtgggacggagtggaagaacgcacagcccccagcagaagcattaccttccacttaagggtgggtgcatcagggctttagaag

SEQ ID NO: 575 - DNA, 9635 bp, Homo sapiens
gttgcagcttagtaatagttttacttattaacttacttaaaaagagataatgaacatttgtgaaattgtttacaattgagatatccatacacacaagtcatgtgctgtgtgatgttttggtcagtgactgcatatatgatagtggtcccataaaattatgatcctatatttttactgtacttttctgttcagatacacgaatacttaccactgtgttacaactgtgtacagtactcagcacagtgatgtgttgcacaggtgcgtagcttaggagcaacaggctgtaccatatagcctaggtgtgtaataggctataccatctaggtttgtgtcagtgtactctatgatgttcacgtcacgatgaaatcacccaagacacatttctcagaatgtatccccatcattaagcaacacatgactgtatatatacatttactaatgtttgttatttttaatacagaaaagtttcttctttgctttttagaaattttatcagttacaaaaggaaataacatttagaaaacagtttcaactttcataggcaaaacatacacatgaaccacacatagggctgagtggatgtttccttattgctaagtccatagcctctagtatgatgcccaagtgtcataactacactcccacatcagcaaactcctccctcttaatatgctcagtgatttctatctcacccttccttacttcctttgcaattcaagtaagaaaacaaacaatttagatgttcgagtataggaaatatttgccgagaccagcttggtcatggagaccctaacccagaggcgctagagaaattaaagacacacacccagaaatatagcatgcagagtgggaaatcaggggactcacagctttcagagctgagagccccgaacagagatttacccatgtttattgacagcaagccagtgataaacattgtttctatagattatagattaactaaaagtattccttcccaaacgaaacaaaggcatggggtctggctagttatctgcagcaggaacatgtccttaaggcacagatcgctcatgctattgtttgtagtttaggaacgcctttaagccgttttcccgccctgggtggtccaggtgttccttgctctcattccggtaaaccttcagcatggcgtcatggccatcatgaacctgtcacagtactgcagagattttgtttatggccagatttgggggcatatccccagcaaatattggttaagtctgtgcttcagactagatttttcaagtctactggcttgtttgaaaaacgcttttagacaacacatcaggtttgtaacttttcacaagtttaaaatatttcaaaggtctttgaaaattataaaatcttgaaatatctctattttagttttccgaggggtgctgttttgacagatttgaaatttttttatttgaataaaaagccatcactctttcattcaatttagtgcctagatgtttccttagagcctgggttgttgttccaagaatctgtggagagtaccaacttagcctgctgctgcaaagacgaaggaatcctttctcagagaaaactcaagactgaatatggtagactggattttccagagatggctgtggacataggctatcaaagggtttttgggatacacagtcccacatgccccttccctcccattgcattcacaatggatcacctttcgattaaatttcaccagctcatccccggtaattttttatttgactggaaacatgggcttttaaaacacacacagggctctcctttagcctgcagaatgtgggtatatctttactattttctcctgctcataaaaatacatgcttttcactaaacgagttaaataaccacccataattcacccacaagtttggtgtactttcttccagtattttaaatatgcaaaaatatcgttttatttgtatttactacctgtgtaactatatgcttagcctttttccccccattttgagtttatttttaattcagggattaggtagccagagtctggcctagtgacttctgacctttcacttgtgatctcttatccatcttcggccagaggcctctttttgtagcccagcctcatctcttgtggaccttgaacaaatttctccagctactgtcaaatgcctgagatttgttaaccacaccatttatttttgctaacactagttaacaaataagcttttctagaagagctaggtggaatatgtcatcagagacttggaatgaaaacaaaatacccttggtaacttacttgcacctgcgtcttcctcagactgcaaagtggtcaccagcaattcagagaggctccagtaacaagcagcttcactttttatcacgtaacctaaccatcttgaggttatgtgtcaaaggaagaagacatttccttttctaaaaagtcaactgctttcttctttactaaaacaatttaggggctgggcgcagtggctcacatctgtaatcccaacactttgggaggctgaggcaggtggatcacgaggtcgagagttcaagaccagcctggccaagatggtgaaaccctctctctactaaaaatacactaggcgtggtggcacgcgcctgtaatcccagctactcgggaggctgaggcagagaattgcttaaacccgggaggcagaggttgcagtgagctgagatcacactactgcactccagccttggtgacagagtgagagagactccgtctcataaaaaaaaaaaatgtaggtttgtccttccaaattgtttatcaaattttggtagattcaggagttgggtaacacacagtaactgggcagctgatataaagtctgtatttttataactactcaagagccaggaagccagctttctgctagcatctttctcctaacataccattggcacatgaagttattatttcagagcttaattatatttcctgactacacaaaaagccaatgcattaaaaaaaggcccacctttatatacgaattaaaatttatttcaaactgttttgtacatctttttaaaaaatgaaaattcaaaagtcttagaattaagcaatgagtctttgatatcataaagctgtgtataacaataattaaagtagtggtaacattttacccttgtaaaaatgtcacagaattaaaatctcaacttggatcctcaatgattcaactggtttatcttacacaataagcgtttggtcagtttcaagataaaatttccccagacatgctgtccttaagtccttcctcctcaccatccatcagctcacacattggggtagctggctgctgtggcgattccacagtggttgttcttgtctttggctatttttacatagccattcgagccccattctggaccccagctgaaagaggagcaggttttccattttatacaaggaatcaagggaaaattggctccattaataataatagctaatacttaaacagtgcttcccatgtgtcaggcactattctaaatgctgttaatatccatttataaatgtcctgaggctgggcacagtggctcacgcctgcaatcccagcactttgggaggccgaggtgggcagatcacttgaggtcaggagtttgagaccagcttggccaatctggtgaaacctcgtctctattaaaaatacaaaaattggccaggtgcggtgcatgcctgtaatcccagcactttgggaggctgaggcgggtggatcacctgaggtttcaggagtttgagaccagcttgaccaacatggtgaaaccctgcctctactaaattaaaaaaaaaaaaaaaaaaaattaaccgggcatgtaatcccagctacttgggaggctgaggcaggagaatcatcatttgaacccaggaggcagaggttccagtgagccaagattgcaccactgcacttcagcctgggcaagaagagcaaaactccatctcaaaagaaaaaaacaaacaaaaaaacccccataaaaattggccaggcgtggtggcgcatgcctatagtcccagctacttgggaggctgaggcaggagaatcacttgaacccgagaggtggaggctgcagtgagccgagattgcaccactgcactcttgcctgagtgacagagcaagactccatctcagaataaaataaaactggctgggcacggtggctcatgtctgtaataccagtgctttgggaggccaaggcaggcggatcacatgaggtcagttcgacagcagcctggcatacatggtgaaaccccgtctctactaaaaaatacaaaaaaaattagctgggtatggtagcacatccctgtagtcccagctacttgggaggctgaggcaggagaatcacttgaactcaggaggcagaggttgcagtgagctgagatcgtgccactgcactccagcctgggtgacagagcgacactctgtctcaaaaaataaataaacaaatgaatgaatgaatatattgattcttgtgggtccttaactatttaagatactgaggcagaactggaattccactgtagcagtctgtccccacatactaccttatgtcacatctcaattaaagaatgctaattgtgagaaaatagattctgacaaccttcaaagcctgagagctggggagtgaaattcgatgacagggcatccaatgacaatagaaggatgcacacagaccactggactcccggatgatctctcagacttaacaaagaaccagcagaggcagatgtttctgcttactattccttgttgaaaaattagacagaaaaaagcaatcagctctcaaacctacaggtccacagtcctttgtctgaaacccttgaggactaatgtgtttcagaatttaaaaattttcaaaacttagtaataaaatattacaaatacatagcaataactccaaaaagcttggtacggaatcttataatcaaacattaatatttctgtgttcactctaagtagaagaaagactttcggaattttgaaattgagcttttgtgaacttgtatccaaatactgatttggaacaaaaattcccttttcaattttgagttttatacctgtttttgacgagccaatacttgctgttattcgaatttgctccttcaaagccgtagccaaccaccagaacaccatgatccaggtttttgctgctgcagtctggttcaaaataaatgcctgggagagtaaaattaatgctggggtgagaagctccaagcgacatgtgacagtaacccaccctaccaccctccataagggaggcatctctaaattcagtaaaatgtcataaacaaatgccaaataaggacccaaacaatattggccggaaaacagtaatggctgataaaggaaaaaagtcaacctcaactcactagaaatcaactaacttcaactaagttcaagatattttctaccaaaaaaaatgaaaatccaaaagataaaacctattgtttacagctaaggtgatttagatatctctgagcccaaataccaactcgcataatccctttctgttcctaggatgtcagtctaaaatagcaccaaaataaacaaacaaaaacttgaaggggattctttacagtcctaattacagtagtaaaaaactttgagaaaaaaaggcccaacaactggaaaatagtttggaaaattaggttgtctctatacaattacatagccatttaaaaatatttatgagaagtttaacataactaagtattttctcatgtcaaatgcaaacatcactatgttaaatgctcactctcaaaatactacattcctgcaaagcaggatgtcatatccaagaatcaatcacagtgatgcttcccaattctgcctaaatttctataataaaatgacacttacctgatttgtagaactggaaggacgaatggcctgcatccatagcaacggagatgggccccacagttgcgactgctttcatcagggccttctcctttccaggtgcgaccactgtgaagccagtgtcattagcaacagaattctcaggtctgtacttacagatttcatccttttaaagttaaagggggagagacttgatcactaccatctacctcctggggaacattagttctagaaccgaaacactcagcaatttgcaacctaggatttccaaatcaacacccttataaatcgtcccatgaaataaaatgctatttgttgatttgaaaatgaaaaattagttgacatttcttcaatgagaacccctaggtcaatctgtccataaaaaatttttcacaatggataaagttctattatatgtagaatggtttgcttattctccatgttatgtaaaagcaagaacagctgtgtgttaaccatctaatggtacttatatggtaaccattagctgttgaccatctcaccagagaactgtgcaaaggctaataatttttttttttttttgagatggagtctcgctctgcggcccaggctggagtgtagtggtgcgatcttggctcactgcaagctccgcctcccgggttcacgtcattctcctgcctcagtctcctgagtagctgggactacgggcacccgccaccaggccgggctaatttttttgtatttttagtagagacggggtttcactgtgttagccaggattgtcttgatctcctgacctcgtgatccgcctgtctcggcctcccaaactgctgggattacaggtgatccaccacgcctggccaaaggctaataatttataatgacaatactcacggtttgcagatgtagattctaccatataaaatgtgaattctgaaaaaagtatctgttatctctgaaagtgttccactttccaaaagcagagcacgaatgacaagataaggagctccatttaccactgctacatatggataggattcctcagagtccaggcctccgttctccttgacatactggaaggccctagccatgaagccaccattgcagccctgattgccttgaggacgcgaacagtccaccagattctgctcgctcagtgagacaagtttcccagttttccggaacatctgtccttcaagagcaccagtcgcactaaaagcccaacaagaaccacactgtttctaaaaagggagaaaaaaaaagctgtaaatttacaagaccaatacaaatacagtaccccataattgaattaccttaatattctttaaaaaaaaaaaaaacccatcgccacactttgggaggccgaggcgggcagatcacttgaggagaggagtttgaaatccgcctggccaacatggtgaaaccctgtcgctactaaaaatacacaaaaattagctgggcatggtggtgagcacttgcaatcccagctactcgggaggtggaggcaggagaatctcttgaacccaggaggcagaggttgcagtgagacgagatcacgccattgcaatccagcctgggcaacaagagctaaactccgtctcaaacaagcaaacaaaaaaaacaccaaaaaccaaaaatacaaaaaacccatcaccatatgttgtgccaccatctaccacagcaatgacaccaattccttcttggctttcctgtggagacagggtctgaatctgacgctgtctcacctgattcttcactggcgtcacgtagcctttctttctccaatccacagatttgggaagatcaagaaacagaggctcacggaacactttccccttcctgaatttctggtttcgaaagcaacccatcatctgcctgaattcttcattggtcttcaaggagaagtaaataaaatgttaaaagcaagactattttggtgaagaactgagaagcagcacagagttcagcaatccttgccacactcaccatgtcaccaaaagcattcatggccattgtgaagccatgtttcccttggctgtattccccattgtgcagttcaatcattttcatattcttttcccacactgctctcctccatccttcttcattctagaggcaaacatatagctggtggactttatgtctacttacccaacccatgttcaccaagccgatttgcgggcagaaatggaagagaaaccatggccagggatgggttgatacttctctgggagctgttctccaagccaagacacaatggagatatatgcccatattgcacctataatgggtgctgttaggttattgcctggtaaggtctggtgtctagaagctactctctggctatcaactcccaacagcgaggaccattctctccagagtccctctggacagtttcagatgttaccaaccgcgccatataatcttctgtgtgttgccttccactggtaccactttgtatccaaattttggtcaaattttggaacagcggaggctattcccaagcaaaaggcagccaggacgagcgaaagattcatgtttcaaaacctagaaagagaaaagaaatgagtatctgattagaccaatcctaaaaagccatcttacagcccccgtggaatagaaatatttcaattattctccctagcatttccccaaggactgtggaagaggctgaaacaggccaagtggaggtatttgatgggcccaccaaaattaaaagcagcctgcagagttggaggcgttgaaacagcatatgcgataatttagggtatgagaagggtgtgaaagatacctgacgggtgagaagcttaaggcaacaactagaaaactaggaaagagttggtccaggttttgcaccaattgtactgaggtcatccaggcaaaacctcactaatgaagacgtaccatcccaagtagatgcaagcggatccccaaggaacaccacctcacaccttcttggctgatacacagcaggagatgagctatgtcttccaacctctccttttggaataaaacctttcgggaatccctttccaggagacactgggaaggagagcacccactattcccgccgtcccacacttgggtctgtgctactcgctcccctaaaccggggcagggtcacaaggccgcgccgctggaagccaggggccccagggccagggcccggaccgaggcaggcagctcccggagctccgggcgggccaggaccggggccgcaccgcctgctctcgccctctgcacgcgccgccgcgccccgagaatgtttgcggcggtgcagggagcgggggctccgcggccaggctgggggcatgaagccgcccggtccggtccggcttcagcccacaggatgactgacctgccccgcccgggccctcccagtggtgccggcgcctccctggggtctccaaccgccctcccccgttccccacctcgaggctggcagagctccgggcagaagctctcactcccagaagcgcccgcctcctctcagtgtccctaaaggggggttccctcctccagtcccccttcgccctgtccctcggtctggtcgggggcgctcaccagcagccgtcgcagctgcgcaggcaccctcagcaaacaagcctctgagattacagacgtccgcggtctggtgcaggttcgcccgcctcgggatttaagtttccaggcggccttccccgcccccaccgccttcccgcgctgcgattggctgtgccggccactgggcggggccccgggcgcttagagcccgcgcgtgacgcagcccagtcccaacccgtctcaggtctgggcgcgcctacc

SEQ ID NO: 576 - DNA, 96271 bp, Homo sapiens
cacgggcggccggatttgcccggaggccgcacccgcctccggcggggctctcaggtatgtgcgccgcgggggtccctcaggggggttgggggtagcccagggaggtcggggtcgggggctggcctctgtagggcgctcagaggccgagtccccccgagcgccgcgtgggtgaggcttggcggtctggtcggggaccgggtcatgtgagtcacgggcgcccctcctttccgcccgcgcgccctcggaacgggcggcccaccctggcctgtcctctggcggcctcaggccggggccgggcgtgcaggggctgacacgtgggcaggaaagcgaggcagagccgccgccgcgtaaggccgggctgagggctcggcgtcaccagccagggctgcagagagcggcgtggcacccggagttggattatgcgtggctggcgtgagctggaagggagtcactcgcccacaagctctcaccacgcgagcttttattgtcccgttcaactgctccgcagtgtggagatcgcatagttacgcacgtcgtggttgtgtcgccccacagtactgactgcttcacctttgcagacagaggctccggcccggcgcggtggctcacgcctttagtcctagcactttgggaggtcgaggctggaggatggcttgagcccaggagttcgaggctgcagtgagctacgatagctccactgcaccccagcctgggcaacagagggagaccctatctccctctgaaatagtctaaaataaggaaactagaaatgcgataatgcccccaggaaattctttctcaggaatatatgtatttgttaaatggttcagtatatgatttattttttattttatttatttatttgagatggaatcttgctctgtcgcccaggcgggagtgtagtggcaccatctcggctcactgcagcttccacctccctgggttcgttctagcgattctcctgcctcagcctcggggtagctgggattacaggcccgcgccaccacgcccggctaatttttgcatttttagtagagacggggtttcgctgtgctggccaggctggtctccaacgcctgacctcaagtgatccgcccgcctaggcctcccagaatgctgggattacagacgtgagccaccgcgcctggcctcagtatatgatttataagctttatgctgtatgagggttcagttatgtatttatacatacttgataggaaatgctaaagttcacattcctatggatagcttttggtgcttttcaaactaacgaggctggcacggtggctcacgcctgtaatcccagcactttgggggccaaagcaggctgatcgcttgaggccaggagttcaagaccagcctgggctcgtctctataaaaagaaaataaaaaataaagctctaatgacagtcattaaaactagctgccaaacaccacattactagcgttagcggtctcagtgtacttgggtggttttaaaatgacacccattggacctgcaaaacgatggtgcttcccgatatgttcatgttattcatcttttagaatatggaagagaaagttcttagttctcgaaatattgtgtaaaatataaggtgacaacctggatctgttaaatgacattcatctaagtgtactctcaaagtcaaaattatcttttcatacaggtggaacttatattttaccttacttgctaaataagtcattgtcattaattgtatttgcactgtgtttttcagtgaaaaatgtactctgacctgaatcctgaattttccttgatggtcaaaagattaaggtatcaaatttccttttttctggatgtattatcgttttactctcttacattgcaatcccccactcctgcaaaaaacccacggagtttcagaataaaatgattagcatcagtaaacatggaaatatttttctttttggattaaattatttgtttatgttctgaggaaaaatctttaaaagcttagttttattgtttttgttgttctttataaccttagccttcagaaaaataaatgtttaactttgcttcttctgtgacttgttcacctgaattcaagaaggtggaattgggcctaaggaggtggctcacgcctgtaatcccagcactttaggaggctaaagtgggcggatcacttgaggtcaggagttcgagaccagcctgggcaacacagtgaaaccttgtctctactaaaaatacaaaaataagccaagcgtggtggggggcctacaaaaattagccaggcgtggtggcggggagggggttgggcagtgcttgtagttccagctacttgggagaaccacttgaaccagggagagaggttgcagtgagccgagatcgtgccattgcactccagcctgggcaacagagcgagtcttcatctcaaaaaaggaaaggcagaattgaagaagctttggaagaggtgaggaatagagctgtggaaattactattttttttttaattgagaatctcctgtgtgtaggtgccttacaaactggcttcatgagtaccctataaaacagatgtttttatttttaaaatcatcatggttttgttttgttttgtttttttgagacagtcttgctctgttgcccatgctggagtgcagtggtgcaatctcagctcactgcagcctctgcctcccaggttccagtgattctcctgcctcagcctcccgagcagctgggattacaggcgcccgccaccatgccaggctaatttttttgtatttttaatagagacgaagttccacagtgttggccaggctgttctcaaactcctggcctcaaatgatctgcccgccttggccaccgaaagtgctgggattacaggtgttgagccactgcacctggtcattatgttttaaaattacatacaagttgttaaaaaaatatgaacagcagaaatagattttagaaaaacagaatgaaattatccatctcttcccccatttagtgaatatttggagtatttcttttcacactgtaggtattataattcctgatttattagaagcagggagtggctgggcgtggtggctcatacctgtaatcccagcactttgggaggctgaggcgggcggatcacctgaggttgggagttcgagaccagcctgaccaacatggagaaaccccatctgtactaaaaatacaaaattagcctggtgtgatggtgaatccctgtaatcccagctactcaggaggctgaggcaggagaattgcttgaacctgggaggcggaggtttcagtgagctgagattgcgccattgcactccagcctgggtaacaagaatgaaactccatctcaaaaaaaaaaaaaaaaacagggagtgaggcccacagaaaccaaacaaattgttgatgatcaccaagcttgtaaatagggtaagattcaaacctgtgtatctgactccaaagttatactatttatactattccaaggagtattttaagtatttgttccatttagttagaaattatttactgtgatataaagtctaatgaatttcaactttagatttatgattgcttttgtaaaatatacagataatttgcaaagtaaggtttttttttatttttatttttcgagacagggtctcactgtgtcacccaggctggagtgcggtggcacgatcacagtttaccacagcctggacttcctgggctcaggcaatcctcccacctcagcctcctgagtagctaggactataggcacctgccgccactcccggctaacttttgtctttttggtagaggtggggtttcactatgttgcccaggctggtctcgaactcctgggctcaagcgatatgcccgcctctgcctcccacagtgctgggattccaagtgtgagccaccatgcctcacacaataaagtttaattatttgtagtaatttcccattcaaacgaagaccaaaattcagcttgaagggaacattcaatagcattccacaaagtcaaatgagttttctgccttagagttttccttagctggtttaaaattccaggtctgtttttcttgatccatagcatgcttttttctctcttaaaaatattttagaagaagattgttaggatttagaaaaacatagcatataaattcttgaaccattcatttttaaaaataatttaatttgaaaggtaaaaatatactttctactttctgtctcactaaatcagtctattctggacttttcctataaaagatgtatgtggccctttgtgaccgtcttctttcacttggcagagtattttaaaggtttatgcgtgtagcatgtatcaggtacttcatttcttgttatggctacatagtttttgttgtatgactgtaccacattttaaaaatctattcatcattgatggacacttggattatttccactttttgactattctgaatgatgctgcggtgaacttttgtgtgtgcatatgttttcagttctcttgggtgcgtttatacctaggaatggtacttccatatttaaatttttgaggtactgccaaacttttccacagtggctacaccattttaattcttaccagcagtgaatgaaggttccaatttctctacttcttcaccaacacttgttatgtgtgttttttattataatcatcctagtgggtatgaagtatttatttgcagttccttgatgactaataaaatttagcatctttcatgtgcttatggaccatttttatgtcttatttggagaaatgtctattcagatcctttgcccatttttaagtcaggttgtcttttattattgatttgtaagagtttttttttaatatgttctagatgtaagttccttaccagatttgaaaatgttttcatccattctttaggttatattttcccatttttcatagtgactttgaagcacaaaagtttttaattttgatgaagtccaatttataaatgttttctttcgatacttatgcttttggtatcatatgtaagaaatcattgtctaattggacttcatgaagatttactcctttgttttcttctaagagtttcataggtttagcttttacatttaggtttttatccattttgtgttactttttccgagaaaaggatccagtttcattcttttgcacgtggctatccagttcatttgctcaaaagactatttctttcccattgaattgtcttcacactctatgaaaaataaattgacctaaatgtgaaagtttatatctggacgccagttcagttcatccatatgtctatccttatatcagtatacattgtcttgattacgccagtttttttttttttttcgaaatggagtctcactctgttgcccaggctggagtgcaatagcgcgatcttggctcactgcaacctctgccttccaggttcaagcaattctcctgctccagcctcctgagtagctgggattacaggtgcgtgccactacgcccagctaatttttgtattttcagtagagatggggttttatcatgttagtcaggctgatctcgaactccttgacccaggtgatccgcccgcctcggcctcccaaagtgctgggattacaggcatgagccactgtgccaggccgattactctagctttgtagtaaattttgaaattgggaaatgtgagtcttccaaattttttttttccaagattggttattctatctccatatgaattaggatcatgtttccaatttctgcaaagaagtcagctggaattttgatagggattatgttgaatctgtagatcaatttgggaattagtgtcattttaacaatattacatcttctgattcattaacatgggatatctttctgtatatgtaggtcttttaaaacttctctcaggactgttttatcactgtcagaggataagttttgcacttcttaaaaccaagtaagctaagttagcaattcccaaaaattatatgagatggtaactcccgaaattctgtggcataacaagattatttccttaatggcaagcatattctggccccagaataatttagaatcaagtatagaattcaagagaatcaaggctgcagcagtaatactttgagtctatacccttgtgtatatttggcttaaatgttttaggagaattggcctttgaaaatttaagatatttgttatttcaaaataaaatgtgtaatcaactaatacaaagcaagttttgtactttttgttgaatttattactaagtattctttttgatgcaattgtaagtagaaatatttatttattaagagatagggtcttactgtgtggcccagtatggccttgaactcctgggcttaagacatcctcctgctgcagcctcctgagtaactgagattacaggtgtgcaccacctcgcctggctcagaatggttttcttaacttcatttttagattgttcactgtgaatatatcgaattacaatagtttaggctgggcatggtggctcacgcctgtaatcctagcacttggggaggctgaggtgggtggataacttgaggccaggagtttcagatcagcctggccatcacagagaaaccttgtctttaccaaaatcacaacaaattaattagctggttgtggtggtgcatgcttgcaatcccagctactggggaggctgaggtacgagaattacctgaacccaggaggtggaggttgcagtgaaccgagatagttccactgcactccagcctgggcgacagaacggtttttgtatgcttcaaccttactgaactcatttattcattctgatatttactttagtggattctgtatgattttctatatgcaagatgctgtcatttgcaaatagagatagtttttctttttttgtttccaatctgaatgtgttttatttcattttcttgcctaatgctcctcattagttttcaatgttgcatagtattttattgcatggacgcaccataattacttttaccaatctcttattgatggacatgaaggttatttccaaactcttgtggttataacaatgctgtaatagataacctattacaaagaacagttctcaactcttttggtcttgggactactttacctatttatgtataagtttcaagtttgggcttagaaagaatttaataatcatgctaattttgttttgttttctttttttttactcctggacccaagcggtcttcccacctcaacctcccaagtagctgagactacaagggtgaaccatcaccctgggtaatttttaaattgttggctgggcacagtggctcacgcctgtaatcctagcactttgggaggctgagacaggcagattacctgaggttgggagttcaagaccagcctggccaacatggtgaaaccctgtctctactaaaaacacaaaaaatgagccaggtgcagtggtgcgtgcctgtaatcccagctactcaggaggctgaggcaggagaattgcttgaattcaggaggtggatgttgcggtgagctgagatcgtgccactgaactccagcctgggcgacagagcaagatttcatttcaaaaaacaaaaagaaaaaaatttttaaaaattgttttgaagagatacggtttccctatgttgcctaggctggtctcatgcgattctcctgccttggcctcccaaagtgttgggattatagacatgagacaccacaaatttaaacaaggactttttttattttttaaagagattactttttctgagtaaacaaggacttttaaaacaaggtactaaaaatctggctgggcgtggtggctcgctcctgtaatcccagcactttgggaggctgaggtgggcggatcacgaggtcaagagatcaagaccattctggccaacatagtgaaaccccgtctctgctaaaaatacaaaaattagctaggtgtggtggtgcacgcctgtagtcccagctgctcaggaggctaaggcaggagaatcacttgaacccgggaggcagaggttgtagtgagccgagatctcaccactgcactccagcctggcaacagagtgagattccgtctcaaaaaaaaaattttttttaataaataaataaataaaaatcttgaaatttttattaggtcctggtgtttctaattttaatatgatttagttctcaagtgctagttaatacttcattaatcagccagatggaagtggggatactatggaaacagcataggcaaagcttaaagataaatgagaccatggtttgaaaatatagggtggcatgcgctttggttcaaggcaatttgatcatcacaacaatttggcttaaacagcactttggttgaaaatgaatatcccctagttatgtgtttttcaagtattggtcattttggtatatcatgagttgttttgcaaacttttgtgccaaagttttcaggaaaactttctaatatttgcttttgtgtttctaactgattttcagagaagttgtaattttgatgttttttccttttagtgagcatgctttaacaaaaaacaataacagaaactgtgtcaaagaaaaggacctgtaatcttcagggtttgtagtctttttcctcttaaaaaacccttttcctaattaatggcagttacatctgcatggctggtttgggtaagtcttcattttgttgtattgctgagtaacagtcaacaaaggtttatcaactcttggttaagggttcctttcatgttgtgagtaaacatgaacaatataggatcttatccttttaagctatcatgcaagaaacatgtgaggtctcttaaaaattcactgtgctggccgggcatggtggctcacgcttgtaatcctagcactttgggaggctgaggtgggtggatcacttgaggtcaggagttcaagaccagcctggccaacatggtgaaaccccgtctctacaaaaatacaaaaatcagccgggcatgatggcgggcaggtgcttgtaatcccagctacttgggaggctgagacaggagactcgcttgaacccgggaggcggaggttgtagtgagccgagattgtgccactgcactccagcctggatgacagagcaagactccatctcaaaaaagaaaaaaaaaaaaaaattgtgctggctgggctcagtggctcacacctgtaatcccagcactttgggaggccgaggcgggtggatcacctgaggtcaggagttcaagaccagcctggccaacatggtgaaaccccatctctacaaaaatacaaaaattagccaggcataatggcgagtgcctgtaatccaagctacttgggaggctgaggcaggagaatcgcttgaacccgggagtgagccgagatggcgccactgcactctagcttgggtgacaacagcaagattctgtctcagaaaaaaaaaaaaaattaactgtgcttataaatgggagctaaattaggaaaaaaataaaaagtaaaaagaaaatgaaaataaaaatttaaaaaatatattaacaaattaactgtactaaggtaggattctttttttttttcttgagacggagtcttgctctgtcgcccaggctggagaggagtggcacaatctcggctcgctgcaacctccacttcccgggttcaagtgattctcctgcttcagcctcccgagtagctgggattacaggtgcctgccaccacgcccgcctaatttttgtactttcagtagagatgaggtttcaccatgttggccaggctgctcttgaactcctgaccttgtgatccgcctgcctccgcctcccagtgttgggattataggtgtgagccaccacacccagccactaaggtaggattctgatctcacctgtatgttatttattatgcctctcttaatctttattttaaaatagaggtcaggttttttgttttctttatatataaagtatggcacattcagttgttcatcattcaagatgccttgccattcagctctgtttaatgatgtggaccaccctctagaaaagaaaatctttatcctatcttgagcattttggttttgaaagttttagatcaattgtaatttcggtatggtgttagaggataataagaagggaagtgtaaggtaaaaattggggcacatctataatgctgttaaaaacagacataactgaaaaatacaccagagaagcaaaaagtaccttctccttgaccattctagaggtgttgcagaagaaacagactttaggtgaagcatatatgtgagtataattatgttgcgcttgcttcttaatgaaagacatgtcaatgaaggactaggcacaaggtagagacgctgataatgttgagtcagctcaggaaattggacctgaagtaagaagatagagattccttaggatgccttgaccctcgagtagcaatatccaaataaaaatggcttaaaggaaagccataaaccaagataacattatctaacaagaagtctgaaggcagggcttttccattgacagtccaaggactcaatgataccatcagatacctactctgctcttctctctgttacacattcagccagtttgtgatatctttcctaagggttttaaaagggcttcagcagttccagaggtcacatgtagccataactaagttctatggagaaacagcagtttcctcctgtgcatatcccggtattagtgaagaaaccttttccaaaggcctgccagctaccttcaactctcttagaccccagtagctaggattgggttggttacatgccacgccctggctgtaagggaggctacaaggaagacttactggcactttttggcctctgaagtacaggcagactgtgccagccaggaagaaaggtagaaaaggaataattggttttgtttgtttgtttgttttgagacggagtcttgctcttgttgcccaggctggagtgcagtggtgggatctcggctcactggaacctccgcctcctgggttcaagtgattctcctgcctcagcctccccagtagctgggattacaggcacctgctaccatggctgactaattttttgtatttttagtagagacggggtttcaccatgttggccaggctggtcttgaactcctgatctcaggtgatccacccgcctcagcctcccaaagtgttgggattataggcatgagccactgttcccggccagaaggaataattgttagacaactcacagtgtctgccatatttgccacagaaaataactgacttgctctctgctgtcttactgtgataatatatttttttaacgcaatttacaaaagggggggaacattcttaaatttgaaactaggaattatgatatttgcagtttcatattgtatacagtaaacagtcttcaaattctagttctccttgagatcttatacaatgataacagttttaaaattatgccttctgttttttgaacagctttttactattgacagcttttaaggaagtagttttcatgttgtcgtgtttactctcttactagacaggaagacagaacagaaatccatcctcaacttctggggataatctgaggattataatgaaatatcagatgcttaaatgatttcaacagacttttagatgaagttgccattagcaccttgttatcatcaatgtaacacataggcaagtggattaaaataagagggctaaactggcctttatgttgaaattagaagtttcgttgtcctacaggcagaaatgacagtttcattggattctctatgttatagtaatatatcagaaggatagcttgagatgagactattttgaagatacatggggtggatattcaaagtgccttttacatagttactgtcctccacagtttccccattaaatgtggaatccttgtgattgcattcttggagggccatcgaaaactagtgaagcacagagagactattttttttctatagatattaatctaaagcaataattggcaaaaaaaaaaaaaagagatttaaaatgtaggataaaggccaggtgcagtggctcatgcctgtattcccagcactttgggaggctgaggcaggtggatcaccagaggtcagaagttcaggactagtctggccaacatggtgaaactccatctctgctaaaactacaaaaacttagctgggcgtggtagtgcgcccttgtaatcccagctactggggaggctgaggcaggagaattgcttgaacctgggaggcagaggttgcagtgagccgaggtcttgccactgcactccagcctgggcaacaagagggaaactccttctcaaaaaaaagaaaagaaaaaagaaaataatatggtgctgtgctatgggataatggggaatacctactttatatagggtgttcagagaaggccttgaaaagaagaaacatttaaactgaaattaaaggctgagttgaagcaacctattaaagagctgtgggaaaggcatcctaagtgaaggaaatggcgtgtggaaaaactgtgatacagaaaagaccttgacatgttttaggaatggacagaaatccagtgtgactgtggttgtcctagtggagaatgttgtgattttggacaggtggataagcagtcagatcatataggcaagtgctttacatttttaccttttgtgcagtggaaaacccaattggaagtatagtaggcataaattttgtagactacatacttaaatatacaaagatgtaattttctttctttctttcttttttttttatttttagagatgactttttgtttgtttgttttttgttttttgaggcagtctcactctgtcaccaggctggagtgcagtggtgcaatctcagctcatggcaacctctgcttcctggtttcaagcagttctcgtgcctcagcctcccaagtagctggaattgcaggtacacatcatcacacctggctaatttttgttttttgcttttttgagacggagtttcgctcttgttatccaggagtgcaatggcgtgatcttggctcactgcaaccttcacctcccaggttcaagtgattctcctccctcagcctcccaagtagctgggattacaggcatgcgtcaccacaccaggccaattttgtgtttttagtagaggcgaggtttctccatgttggtcaggctggtctcgaactccggacctcaggtgatccgccctccttggcctcccaaagtgctaggattacaggcgtgagccactgcgttcagcctaatttttgtattttttagtggagacgggattttgctgtgttggccaggctggtcttgaacccctaacctcaagtgatccaccgccccttggcctaccaaagtgctgggattacaggcttgagccaccatgcccagcctagagatgaggtcttgctatgttgcccaggctgatctccaactcctgggctgaagtgactctcccaccccggccttttaaagtactgggattacaggtgtgagccattgtgcttggccaacttcatttctaaataactaaaatttccttagctctgtttctactaggtaatagagaacaatcctgctaaacaatcttgccactttaggataaaaagtcagtagcttctggcttaactaaattaattacatgttaatctaaacccttggtaaatacttggtccttttggtaaatgttcagtttcctcacagagcccaccccttccctttttttccctatggtagatggtattggtagagaaatcttataatttttcctggcattaagggagagtcatcttatctttgtgctgtcctctgtccttctgagccattgcaaatgactggcttggtcttgaatgggattgtctgcctctgccacttctgaggatgatgtccctgctactactgtagcccctgggcaacacatctgtgcatgctgggtcctccttaatcccaggctgttttgggtatactggcccagtggtgagtgctgatatgcttgggaccctaataaagcagcttttcaggaatatggtttgggcatgtcattggctattatgcctttagcaaggcatgatattgtattaggtgcaaggttttactaaatggctacagtccctggaccataacttgggaaagggaaacacaattatttcccattctgggtccttccccacaaacactggagatttttcttacccttccgcaaataagattttttttttttttttgagacagtttcattcttgttgctcaggctggagtgcaatggctcgatctcggctcactgcagcctctgcctcctagattcaagcgattctcctgcctcagcctcccgagtagctgggattataggcgcttctaccacacccagctaattttttgtgtttttggtagagacagtgtttcgccatgttggccaggctggtctcgaactcctggcctcaggtcatccaccctccccggcctcccagagtgctgggattacaggcgtgagccacctcacctggcccctcaaataagatttagctccagataggacaggaggcaaaaattctaaatttacatccactctttcttttaactcttgtttttctttgaactcttcccccaagtttttatgtcatcttgatcagtgtgagagaactgtacttatgtcatcacctgcctttcctctgtgctggagtctacatgacaaattctgccatgaaagttttcttgatttggttggtgatagttaaaatcacagttttagaatttaaaaagctgtcttggccgggtgcagtggtatggttctgaggattaattttatatacacacatataaacactcacacacacatttgagttcaaaatgtatgttactacattttacaaaggaataagtgatttcatagattctgtatcaatattaaatcttggctgggtgcagagcctcatgcctgtaatcccagcactttgggaggctgacacagttaagatcacttgagcccagaagtttgagaccagcctaggcaacatagtgagaccctgtctctacaaaaaatacaaaaattagctgagcatgttggcacacacctgtagtcccagctactcaggagactgaggtgggaggatcgcatgagcccaggaggttgaggctgcagtgagctatgattctaccactgcactccagcctgggcaacaagagagagaccctgtctctcaaaataagtaaataaataaataaaaagttctcttttggccaggcacaatggctcatgcctgtaatcccagcactttgggaggccgaggcgggcggatcacaaggtcaagagttcgagatcagcctagccaacagggaaaccccatctctactcaaaatacaaaaaattagccggaagtggtggcgggtgtctgtaataccagctactcaggaggctgaggcaggagaatcacttgaacccgggaggcagaggttgcagtgagctgagattgcaccattgcactccagcctgggtgatgatgtgagactccatctcaaaaaaaaaaaaaaaaagctctcttttctcttaagcctgtaggtcttatgattgaaattcttagctttcaagaattatcattttaatggatcaaagacctaaatataagaactgaaactataaaacgcttagaaggaaatgtaggtttaaatattcatgaacttggatcaggcaggtttcttaaatatgactccaaaagtgcaaaagaacaaatagataaattggactttattaaaattaattttttttttttggtgagatggagttttgctctgttgcccaggctggagtcagtggtgccatcttggttcactgcaacctctgcctcccgggttcaagcgattctcctgcctcagtctcccaagtagctgggactacaggcgcgcaccaccacgcctggctaatttttgtattattagaagagatggggtttcaccatattggccaggctggtctcgaactcctgacctcgtgatctgcccactgtggcctcccaacgtgctgggattacaggcatcagccactgcgcctggcccttaaaattaaaaatttttttaaagtttttatttttttgagacagggtctcatcatgttgcccaggctggagtacagtggcgccatcatggctcactgcagtttcaacctctctagactcaagcggtcctcccacctcagccttctgagtagctgggactgtaggcatgtgccaccacatcccagtaagttttgtattttttgtattatagaaatgggggccaggcacagtgctcactcctgtaatcccaacactttgggaggccgaagtagacggatcacttgaggtcaggagttcgagaccagtctggccaacatggtgaaaccccctctctactacaaatacaaaaattagctgggcatggtggcacgcgcctgtaatctcaactacttgagaggctgaggcacgagaatctcttgagtccgggaggtggaggttgcagtgagctgagaccatgccactgcaccccagcctggttgacagggcaagagtctgtctcaaaaaaaaaaaaaaaaaaaaagaagtggggtttcaccatgttgcctagactggtcttgaattcctgggctcaagcaacctgcctgctttggcctcccaaagtgctgggattacaggtgtgagccactgcacctggccaaaattaaaaacttctatgtttcaaaggacatcattaagaaagtgaaaagacaacctacagaacgggattaaatatttgcaaattgtgtatctgttaagggtctagtatttagaatatgtaaagaactatcacagctccataagaaaaaagcaaataatccaattgaaacaatgggcaggccaggtgcggtagctcacgcctgtaatcccagcactttgggaggccaaggtgggcggatcacgaggtcaggagatcgagaccatcctggctaacatggtgaaaccccgtctctactaaaaatagaaaaaaattagctgggtgtagtggcgggtgcctgtagtcccagctactcgggaggctgaggcaggagaatggtttgaacccaggaggctgcagttgcagtgaatggagattgcaccactgcactccagcctgggcgacagagcgagactccgtctcaaaaaaaaaaaaaagggcaaagaatttgaagagatatgtctccaaagaaaatgtgcaaatggccaaataaacacatgaaataaacacatgaaaaggtgttgaaatcattattcattagggaaatgcaaataaaaatcacagtgaggccaggtgtagtggctcattgcctataatcccagcactttgagagactaagtcaggaagatcacttgagcccagaagttagagaccagcctgggcaacatagggagataggcgtggtggtttgtgcctgtagttccagctagtcgagaagctgaggtgggaggatctgcttgagcctgtgccgtcgaggctgcagtgagcagtgatggtgccactgcactccagcctgggcggcagagcaagaccctgtctctaaaataataaatgataataataataataatagagataccaattcacacccactagaatgactataataacttaaatctcaaaaaaaaaaaaaacccaaaaaacaaaaccccaacaactgttggtgaggatgtggagaaatgggaacccttatagggttccttactgatagggatgtaaaatgatacagatactatgggaaacagtctggcagttcctcaaaaagttaaacatacagttgccatatgacacagcagttccattcctaggtcatcccaagagaaatgactacatatgtccatacaaatacttgtacatgagtgttaatagcagcaatattcataattgtaaaagagtgggaacaacctaaatgtagatcagctgatgaatggataaacaatatgtggtccagccgggtgtggtggctcacacctgaaatcccagcactttgggaggccgaggcaggtggatcacctgaggttggaagtagaagaccacctgaccaacatggagaaaccccatctctactaaaaatacaaaattagccgaacatggtggctcatgcctgtaattccagctacttgggaggctgaggcaggagaatcgcttgaacctgggaggtagaggttgcagtgagccgagatcatgccattgcactccaacctggtcaataagagcgaaactttgtctcaaaaaacaaaacaaaacaaaaacaaaaaccagtatgtggtccatccatacaattcagccacaagaaggagtgaagtacagattcatgctgcaacatggataaaccttaaaaacattatgctgagtgaaagaagccacgaaagatcacatattgtatgatcccacttatatgaaatgtttagaacaggaaatccatagagatagaaaagagataaatggtttctaggagatggggagggaggcaattgggaatgactgttaataggtatggggttctttttaggtgatagaaatgttctggaattagtgtagatggttgcaaaatgtgaatacactaaaactactgaattgtatactttgaaatggtaaattgtatgctatgtcaattaaaaaaaagtataggccaagtgcagtggctgaagcctgtaatcccaggctttgggaggccgaggcgagtggatcacttgaggccaggagttcgagaacagcctggccaacatggtgaaaacccatctctattaaaaaaacaaaaactggctgggcgtgttggtacatgcctgtcatcccagctactggggaggctgaggcacaagaattatttgaatccaggaggtggaggttgcagtgagccaagatcacaccactgccctccagcatggtcaacagaacgagactgtcttgaaaaaaaaaaagataaattatggtatttgctttggaattaaataattagtaacttttagtaaggtttggtaaaggtttagtaacctttagttaacccagttaacttctgtgtcttatatttgtctttgtactgaagtagttgaatgccactgacccacagaatgagttgccagagaactggagcaacattctgtttgtgggaaagagaatactctgttactaccttaatattagattcccagcatatcaattgaagggttttaaatagtgagtgatgtgtttcaatttatatttatattatatttacacttgatcttagccaaaaggctgagaaagcgattttatattatatttataaagatcactttagctttctcctggagactggattggtagggacaaggtgacattggtgaacttggttagaaagtcagtcaagcccgtgtgcagtggctcacgcctataatcccagcactttgggaggccaaggcaggtagatcatctgaggttaggagttcgagaccagcctggccaacatggtgaaaccccttatctactaaaaatacaaagattagccaggcatggtcgtgggtgcctgtaatcccagctactcaggagattgaggcaggagaatcacttgaactcgggaggtggaggttgcagtgagccgagattgcgccactgcactccagcctgggcgacagagcaagactcagtctcaaaaaaacaaaaacaaacaaacaaaaaaccagtcagtactctagggaagaaataacaatagctatattatgacatagtagtgagttgaagataactgaatagccaaaatatattttggagatagtttgatatgagaggtgaggaaaagtaagtagtcatgtgtggctctttgtttctggctttaataactccagtagttctggaagagacttagtgggaaacattttggataaactgagtttgtccaaatggggttgccaagtggagagttgagtaaatgaagctagagctcaggaaagatgtggaccagagttataagtcatatttatttatttatttattttgagacagagtcgtgctctgtcgcccaggctggagtgcagtggtgcgatcttggctcactgcaacctccgcctccggggtcaagtgattctcctacctcagcctccagagtagctggtattacaggcacgggccaccatgcccagctaatttttgtatttttagtagagacgggggtttcaccatgctggccaggctggtctcgaactcccgaccttaggtgatcctcctgcctcggcctcccaaagtgtttggattacaggtgtgagctactgagcccagcataagtcatatttaaaacaatgggaatgggtaggaacacctagagatagagtgtgggaaatagaatagggtccagtatacagctgtgccaaatttcacatgtacaggttagatagtggagtgggtcagttctgttgggaatgccctgaaagtttgaataatgataagcacgtccttttaacatcatgaggtagtggtgacgttgtaagaggagtttcagtgtagtgggttgtcatgggttaaaacgttcagattgtcatgggttaaaacgtgaattggatatgaggaagtggagtgcacaaagatagttttctgaaagttttacttggaagaggacaaaaaattgagacgacagtttgaggaggatgaaaggtcaagaattctaagctagtgataaaaatttcgtcaacatcaatgaataggtaatgtaaacacattaatcctgggatggatgtgagaagagcaaagaaaggaatcctgggggaatatcagctctaaaggttgagtagagaaggaaggagtgatctgagaggtggaaggaggagtaggaattatcatagaaactttaagcttcttgagggcttgtgactgtgtcatgttcatcattttatctgaagttcttatcaacaaagtagctttcagtaaatatttattaaatgaagataaaaattttaagagccatctgcaatgtcaaatgtagcccacagttgaatgaatatgaggacagggaagtgtcccttgattttggtgttaagcagctgattgccaccttctgtagaacagcttcagtggagtctccataatagaaataaatgccaggttgctgaggactaagcgtggatatttgttgagagtggagacagtaagtgcaaacattcttttcagaaagctttgctctttttgaagctttgctcatagggagatacaagatagtaggtagaggggcaggctgtgtttagatgagagagacttcagcatgtttatatgctaaatggaaaaaggaaaaaggaagggagaagttgaagatgtagaataaaggaggtgtgtgtgaatgattgtacattgtctttgaggttagtgggaatggagtgaagatactgggttgcagtacagatgagaatacagtttccactgaagtaggaataaaggaacaatagatggtgcagatggggaagtgtttgggtggcaggtgagaattcgggatatgaacactttatttttttcagtgaaggggggataaggtcatccactgagatagtggggaggaaatgatgattgtaggggactgaggagaaaaggagaatttcaagaaagcctctgagggaggtgagagggcaagctgagtgggaatacttagaaaaaatggaatcatggatttttcacggctgtggtatatatatttgtatgaatgatctcctccttctctcagggctcagcagcctgggtgaacacacaattgaacagttggattgatcttggcctggattttatgtgtcagtgtgacagagagggtaaggaggcaagatatttcagtagcgagagtgtttgaagtggtgggccattgagtctaggctgaatagggaacaaatgaaaccagaaggtggctgctgggacatgaagtggttggtgttcaagactggatagtggaattgaagattgaacgggaggagcagttgctggttatgacagagtacaggatccagctatggagtgggtttatgaagtagagacaacgttcccaagtctttagtgaacatcagagagtgtcatctgttagaactttagctgcggccgggcaaggtggctcatgcctgtaatcccagcactttgggaggccgaggtgggcggatcacctgaggtcgggagtttgagaccagcctgaccaacattgagaaaccccatccctattaaaaatacaaaattagctgggcgtggtggtgcatgcctgtaatcccagctactcgggaggctgaggcaggagaatagcttgaacctgggaggtggaagtttcggtgagccgagattgcaccattgcactccagcctgggcaacgagtgaaactcagtcttaaacaaaaaagaacttttgctcaaaggcaggtggtagcagataagagataaggaaaatttagtgaagaaaaattcagtttttaaaaacgttttaggctgggcgtggtggctcacgcctataatcccagcactttgggaggccgaggtgggcagctggcttgagcccaggagtttgaaaccagcctgggcaacatggcaaaaccttgtttctacaaaaaatacaaaaaattagtcaggtatggtggcatgcacctgtagtcccagctacttgagaggctgaggtgggaggatctcttgagcccaggaagttgaggctgcagtgagctgtgattgtgccactgcgctccaacctgggcaacagagggaaaccctgtctcaaaaaaccccaaaaaacaaaaaacagcattttattttggtgatggaattctctattgtttcgaagagttttgtttgttttaaagacattaaccagttttctcgagggatattctatgaaaaagtgggttccatcatccaataagtttgagaaactgcaaactctatcccattggtaattcacaatgaacctcaacttagattaataaaggctctgggaaatgatgttactattaatgatttaacctttattgagcactgtctaaggctctgttctaaggctcccacgtgcattattgtttccagtctttacagcaactatctcatttaagttacactgctaagctagaatggaagagctgggattcaaatccagaaagacttgctccatagggttctcaagcctataaccagtatggaaacaggcttgacattaaatccagcatttccccatcttgtttggttatggaaccttattatcttttagtatttatagagagattagtcagttgtccacggcatggaccctgggaagtgttgcctgagtcagtttacactggtgactgcagtcttttaaacagcattgtttcagactataactagttttttctaacttggttctctgttgataatacttaaatgttatatttatttttctatttgagagccttatattttgacttcaaggcattttctattccctttcacaatgaccttcccaggaatcaaagatattgtcaccaccacacattacatttgagttactaaaacagtttataatccaaatagctatttcactttcttttctctggtctaagattatctcattgtaatttgttttttaaatttagagacagggtcttgctatgttgtccaggccagtctcaaactcctgagtagctgaaaatataggcatgtgtcacctcaaccagtttattgtaaaattttaatgtttagagatcttggagatcatcttttatttttaacagtatttatttagttttgcaggtagagaaaatgacagctgtgtagtgctgtggaaattataataattcatatccaagcttgaatgtcagctccacctctttactatagctgtggccttagaaaacctacttcatttcttgaaacttgtttcttcctctaaaaagatgaggataatatcttgcagggtggctatgaaaattaagacagttcatacagtatctggcacatggaaagttctcaatgttaattacccatttttttctgtttaaggaaatagtctcaatcctataccatgaatgaattatgaaaatagttggaaaggaaacaacagttttaaatgtaaactgtctcagtcttatgctgacatcagctacatttctggtaaagtgatggtgtcatgatacaggttatattaagagttaaaaccagtttccttctggctttccaactgacataataagcaaaacctgcctgggcaaacatagacctatttattggctcacttattattaatgttaaactagctttggtgctgacttctgttcttgttttaaaatttcactgttgtcatttaaaatctgacagaccttcagaagcttcatagaatgcttaatggtttaaatcgtctctagaacatgtgaagtatcttttccaaagtggttttctccatctgtcagtatgttcaaaatcatgtgtatagggccgggcgccggtggctcacgcctgtaatcccagcactttggaggctgaggcgggtggatcacgagatcaagagatcgagaccatcctggctaacatggagaaaccccgtctctactaaaaatataaaaattagctagccatggtggcgcgcacctgtagtcccaactactcgggtagtcccaactactcggaaggctgaggcaggagaatcacttgaacccgggaggcggaggttgcagtgagccaagatcgcgccactgcactccagcctgggcaacagtgcaagactctgtctcaaaaaaaaaaaaaaaaatcatgtatataggacagaattgcttatattttcacaattactactggatgcctgtttggttttcatagcaatcaacttttggagtttatgggcagtacttaacatatataacctaagtgtggataattatttaaaataaggctactggaagaaaaatctatagggatttctcagttttcacaacagcatcctgagcaaagaaaaaataggttggtttgagttgtatgtgatgagatttctaatattctattcgaaatgccccctagtaagcactagtgataggtattaatgagctgaatttgatttctagttccaactctgtcccttgcaacttcggtaaccttgaaggtttgtctacgtttcagtttcttcatatgtaaaagagattaccaatatttccctcccaaggctgctgtaacagtgaagtgttgaggtatttatttatttatttatttatttatttatttttttgagacagagtcttgctctatcgcccaggctggagtgcagtggcatgatctcggctcactgcaagctccgcctcccaggttcatgccattctcctgcctcagcctcccgagtagctgggaatacaggtgcccgccaccacgcccggctgattttttctatttttagtagagacagggtttcaccgtgttagctaggatggtctcgatctcctgacctcgtgatctgcccgcctcggcctcccaaagtgctgggattacaggcgtgaaccaccgcgcccggccgtgttgaagtttttaatatagccagcacagcatgtggcacatagtaggcacacagccattgcatgtttcttccagacatctcactgcatttttcagtaatattcttttcaagtacgttcttctttctcattccttaacatttaaaagctgtattgaagagagaatattaatgtttgcgaagtaaactgaaaatatttcctttgcagcccacacttgagtgttttaggccgggtgcggtggctcacgcctgtaatcccagcactttgggaggccgaggtgggcggatcacctgaggtcaggagttcgagaccagcctcaatatggagaaaccctgtctctactaaaaatacaaaattagctgggtgtggtggtgcatacctgtaatcccagctacttgggaggctgaggcaggagaattgcttgaacccgggaggcagaggttgcggtgagccgacattgcgccattgcactccagcctgggcaacaagagcgaaactctgtctcaaaaaaaaaagagtgttttagcaaaaaatgattttatgtatgacataccttggtttaaatcctggctttttaattttaattttttattttttgagacagggtcttactctgtggcccaggctggggtgcagtgatgtgatctctgctcactgcaacctccgcctcccaggctcaggtgattctcccacctgagccacctgagtagctgggagtagaggtgtgctccactatgcctagctaatttttctatttttagtagagacagagtttcaccatgttgcccaggctggtctcaaactcctgggcttaagtgatccaccagcctcggcctcacagtgttgggattacaggtgagagccaccaagcccggcctgaatcctggcttttgaatgtaatagtgttgtgaccttaggcaagctgcttaacctatccataaatattatgaggctaaagtgagtaatagtatgtgtaaaacatctagttcattgtctggtttgtatatttccaaaataaatgttattattttaagtggaaactgttgtttaatttgataattcatataattcatggcttttgagagcctgctctactcaaagcccgttaagagcaggcaggaacattgtgaacgaatgttgggcatattattatgcaagtgactgaatttggctttgcctgtaatcaggttcagcaaaagtggtattttctttctttcttttttttttttttttttaattgagatagtctcgtcctgatggccagactggagtacagtggtgtgatctcggctcactgcatcctccgcctcctaggttcaagcgattcttccacctcagcctcccaagtagctgggatcacaggtatatgtcaccatgcctggctaatttttgtattttttgtagagatggggtttcgccatgttggccaggctggtcttgaactcctgacctacagtgatccgcctgccttggtctcccaaagttctgggattacaggcgtgagccactgaacctggccaaaagtggtattttctattgcatttgaggtaacagaaattgatgggcttgttattgcatttggcgtggctggttttttttttccatgttgtctttctccactgactgtcaaaaaaaaaaaaaaaaaaaaaggctacattcatgagtgccacaagagagattcatgattcccaagtgctacagcagaccaaggtatctaaaaagtttttcatcttttgctgatcttgtttattagaaataaatatgttactctcctgtattaaaatttaacacaatattggcaagctaaatttaatcaaatattctgcccattttaaaattcacttcctagcctgtccatccttccttttattttgttgttgtttgattttgttttattgtatgcttttagcagcctgaagccatggtttttagtttctgtctgtagtgataagtggaaaggagggatgaggaaggggctttactggcccaaccagaaatagaaactaagaacccaggactgtattatctcccttggacacccaacactatataaaattgattcctgccctggcagactaagcgttggaaagctggtgctaagagtgttatgagaattcctaataaatagaaaagctcaaggattgacactatagtaaaagatttcattttgacatgtttataatttacttatcaagttaacaataaggtgtttttatttatttatttttgtttatttttattttattttttgagacggagtctcgctctgtcgcccaggctggagtgcagtggcttgatcttggctcactgcaagctgtgcctcccgggttcacgccattctcctgcctcagcctcccgagtagctgggactacaggcacctgccaccacgctcggctaattttttatatttttagtaaagatggggtttcaccatgttggccaggatggtctcaaactcctgaacttgtgatccacccgccttggcctcccaaagtgctgggattacaggcatgagccactgcacctggcctttttttggtatttttagtagagacggagtttcaccatgttggctaggctggtctcgaactcctgacctcaaggcctgccttggcctcccaaaatgctgagattacaggcatgagtcccaataagatttttaaagggataccaaaataatcaacatttattttagaaggtgactttcttcaatgagatgtcaatgtctactttctgttatatagtgctattgtttcttttttcttttttttctaagtgagggtctcactctatcacccaggctggagtacagtggcatgatctcgggtcactgcaaccttcacctcccaggttcaagcaattctttcacctcagcctccagggtagctggaactacaggtgtgcatgcctcgctaagttttgcatttttagcagttgttggccaggctggtgtactgtttcttttattgattgagttctatatttacacagcatgaaagtctcagttgcattaagtacattcgcattgttatgcaaccatcaccattatctagttccagagttttgctgtcaccctaatagagcttgtatatatgtctccaccaaatcttatgttgaattgtaattcccagtgtttgaggtggggtctgttgagaggtgtttgggtcatgaggcagatccctcatggcatagtgttgtcctcgcagtagtgagtgagttctcacgatctccttactccatccacctgcttctcctaaaactttgaaatatgcttggaattgaaagtgtttagtttgaggatagttatctaaaagtgacatacagggctcctgctttgctcttccttagtaaatttcctattttattacacagtttactaatacagaggactagagttttgttatttccatggaaaacattattgaatctaaatttaactagagatgtgtagttcagggagggagagtggttttataatatgaatcttggatttgaaatgaacttaaagcaaatgaataaaaattgtttcattaattataatgtctgaaataatgcatgtttttgtgaataaaaattgatataataaagtttaaagtgacaggagtagatataactaattgtatttataatttcttggatgtaaaataacatttttgaaaaatattatacaatgacctcacatacagtgacctcacttaatctatgtgaggctatacacagtggctcatgcctgtaatcccagcactttgggaggctgaggcaggtgattgcttgagcccaggggcttaagaccagcctgggaaacatggtgagaccctgtctctacaaaaaatacaaaaatcagctgggcatggtgaggcgcacctttggtcccaactacttgggatgctgaggcaggaggatcacttgagcccaggaggttgaggctgcagtgagctgtgatcgcaccactgcactccagcctgggtaacagaatgagaccctatctcaaaaaaaagaaaaaagtctatgtggaagataccacgttaattgttttgggtggtttagagatgtttctgtctccttcactgatgaccatgtgtctctgctgctgtcgctcactggtgattatcaactcaacttcttacatttgttttaacaaatatttatacaccctttgtaaatttgcatgagataaagtcattatagttaaaaaaattgtttttttttttttttttgagacagaatcttgctccattgactaggctgagtgcaatgacatcatcatggctcacggcagcctgaacctcctgggctcaattgatcctcctacctcagcctcctgagtagctgaaactacaggtgcatgccactatgcccagcttgttttttattttttgtagagacagggtctcactatgttggcaggctggtctctaactcctgggttcaggtgatcctcctgcctcggcctcccaaagtgttaggatttcaggtgtgagccaccatgcctgtcctatgaagtcattacaaagaaattaaattaattggtttcattggcagtattgaatttcaaagcagaaggggtgcttaagagaaataatgcctttggagtaatttctgatgctagatgaaactcatatctcatttaaggtgtccatctgaattttatgtttggatgattatgaattattccttaaagcttgaagtgaactctggctctctaggacaaattaatctttattcctttaatctttattcccttaggtatatattaaagggatcaaatttttttttagagtaatgtaaaattaagggacttcttttgttaggtgaatttctcaggttttaagatatcagtatcattgtggacattgactacattgtctactaaattctgtaattttaacttataattctcagtaattggctgggtgtggtggctgacgcctgtaatcctagcactctgggaggccaaggcggcagatcacctgaggtcaggagttggagaccagcctggccaacagggtgaaaccccgtctctactgaaaatacaaaaaaatgagccgggcgtggtggcgggtgcctgtcatcccagctactggggaggctgaggcaggagaattgcttgaacccaagaggtggaggttgcagtgagttgagaatgcgccattgcactccagcctgggtgacaagagtgaaactccatttcaaaaataaataaataaacaataaaaataaaaatacaaaaattagctgggcgtggtggcgggtgcctgtaatcccaactactcgggaggctgaggcaggagaatcgcttgaacccgggaggcggaggttgcaatgagccgagatcacgccactgcactccagcctgggctacaagagtgagactctgtctcaaaataataataataataattctcagtaatttttgcaatttttttggtacctaaaataatttctgttattgtgttggataactttgtcaacttcactttgggaatatctaaatataggtagctgcattcgagccagaggaatattgggtttttttgttgttgcttatttttgaggcagccttactttgtcacccagactggagtacattggcacaatcatggctcactgcagccttgaccttctgggctcgtgtggtcctcccaacccagcctcccaagtagttgggactaaaggtgtgcaccaccatgcctggctaatttttaaatttttttgtagggatggaattttgctatgtcacctaggctggtttcgaactcctaggctcaagcagtcctcccaccttggcctcccaaagtgctgggattacaggtatgagccaccacacccagttgagcaatactgggttttaatcaagattattgtctgaatattgagtcttaatgacttttttgattttgtttttttggccatagtattaagtttgcagttgataaccttctgtactaactagaagtagtatagaaactgcaaattaaaaaaaaaccccaggtaaaatgttgatggctgctatttttatttaaggtattagtaaaggaaaagaagtcagggacattatggaggtcaagttttatattattaaaactcaacttcatgatttatacatacttagaaatagtctgagtgatgtgtgaccaaaatatgatttctaggaggaatgattgttacatccgtggaatagctgcgtacactttattgttcttggtgcttaaactttagttgtcctgctaagataaaggaagacattctttcagttggaaatcataatgtatttctccattgaaacagtatggtttgaacagtgctatatattcttactcattattattccttaaatgaatattttaagctcctgatagaaggcaggtactgtgttatatgctgttggtgttaccagaatacaaagatgaagagaacaaagtattacacaattcctaatctcacataaatgctattttttttactagctgtggggagcacaaaataagtggttgaaagtcatctgacacagttacatttattcctttccttttccatggctcttaggaataaattgttctactctatggattaaattgccctttgtttattgcctgggatcccaactttatttcataattttatttctttgaggaaacgtttcacaagttttataacaaagtataactcaatttggagagcacaatctgtgcataagttggaggctacctattgtgaaatggaaaaatgcttgtcctagcattactaagttaatgtatagctggtagaaagttttcacttttaattgctaacttgcctagtgagagtgaaagattgattacggcaactaaaaagtataaaaactactgagtagtttttaggtacagtcagttcttcagtagaacaagaatctttagaaataactttcactaattctttactagttgtttttcctatttctcttggatatggatcatcagaatgttttttgtccctcttacccgcccccccccaccccgtctgccaccccccgcctcccacttttttgttgggaggcttatgtgagagcattagaggccttgaatgtttgggtagacaaggtaagtattcaaataaacatttcaagatcattgtgacagtgaaattatttgatatgaaaaaggatctcagttattagaaaaaacacaactgtgttaatactgacagccagcgttgctataagtgttttatgtgcattatctcacttaagctttacaacagtcctaagagaggaatgctgtggttattacacccacttgacagaccagggagcagaagcacagaaacccaaggatttctgccgtcagtgtcatgcatttggctggagttatgatgtcgtgcaagtaatgttccttctttttccctctaattcatttttatgtttttcttttacagggcaattttgtaagatttagtttccaggggtcaggtttgtttgggttttatgtccttgggaaatcctcagtaccttatttcccatattccatattttttaaccttaattttttttcccctcaaatgttatacagtttaatgagtcaagtggtctttcagggattgttaaaacaaacagtaattctcagcttccaccttcatttcctcctctcataggtaaccatcctcaactcataggtatttggaatttacctgtggtttttcaagaaacatttaaaaaattgatttacttgaattttcaggttagaacataaattatttgcatgatttgctgtgtccttgtgactaactcaaactaaacattctatcagttgtccaaatttcccattttctttcaaatttcccatttccttcacttactttgtcagtttcatcatcttgaagaagccttttccagagcacagtgctccaacatggagtagtctctgttttctcatagtgcccagcaattatccttggaattctcttttcttttctcctgcattggcacttctgtttcttctcctcttatgtcttcctgtttcatgggaggcaaatatttgataccttatgttttttgaaaacactttattttcctctcacccttcattagtggtttcactgtatgtaacattgagattgatgattttgctccattgtcttctagcttgtgttatgcctgttgaaagtacaaaatcattctggaagcttatctattgttagctatttccctcttctggaagcttgtaggatcttccctttgtttccactgttctgaaacttgtaaatgatatgctttaatatggttgtactgtattttaaacaattatgctctgcactcagtgtttttttgttgttgtttttgttttttaatttttaaatttatttatgtatttttaaatttattgtttttgtttgttttttgagacggaatcccactctcgcccaggctggagtgcagtggcatgatcttggcgcactgcaacaacctccgcctcctgggttcaggtgattctggtgcctcagcctacccagtagctggaattacaggcgtgcatcaccacgccaagccaatttttgtttttttgttttgttttgttttgtttttttgagacagagtatcactctgttgcccaggctggagtgcagtggtgcgatctcggttcactgcaacctccgcctactgggttcaagccattctcatgcctcagcttcccgagtagctgagattacaggtgtaccaccacgactggctaatttttttgtatttttagtagggacggggtttcaccatgttgggcaggctggtcttgaactcctgacctcaagtgatccactcacttcggcctcccaaagtgctgggattatgggcgttagccaccgtgcctggcttcactcagtgttttcagttaggaaacttacattgtttagttttgggacattttcttgaattatttcactgattttttttcctctctgttttctcccgtggattccccattgcatagatgctgaattatcttgactggacctccagttttttcttctttattctgttgccatctctttgattccttattctttctgataaattttcctaagtttaatttccaagggctctttggaaaagtatcgattttttttcatggatggagtatctactcttttgacacagggtcttgctctgtcgtggctcactacagctttgattgctcaggctcaagcgatcctcctgccctagccctcccagtagctggtactacaggcctgcaccgccaaacctagctaacttttttgatttttagtagacaaggtctcgctgtgttgcccagactggtctcgaactcttaagcgccaagcatttctcttgcctcagcctcctaaaattctgggattacagtgtagtatcttctgtattctttccatggacactaatgatggggtataaaattccttttatttatttatttttttattgacatcagaaattcctgctaataaaattctttttaaattttaagtttttttcttcccacagttgtccgtgtttcctccaagttccttttctattttttgttttcctttgttttctttttgtggtagatgctttcctcagatgagtggtaatccttgactatttgcagttatgcctctaaaagctgattggaagctcttagtacctcattggtacttgttgagtagagttcactctggggtgatctatctgtgtcatttgctggggcacccttcatgtcagcttctgattacttttcccttttctgaaaagggagaggtcttttaatttcctgtctggtgggaggaggtctgtatgccacttctgtgggagagtgagggaagtagggcagtgaggatttcagtattcagtacatatgtgttttcttaaggcttctgttttcattaagcctcccccgcaccaatgtgctttatgtttccctgctctgaaatcctcctgagggaataatcctctagaattttgccttggtgggaaaagcgtagtaacctaaccatgtggtatttaggaaggtactgagagattgagcgtttcctaaggagctttcagccagccttctttatttagtgctcccttcacacctgtttctacaggcgctatctgttaccagttcctgagccttttgaggattctgtggacgaaggttggtttttggctttccatactgctggtttcttggatctgctatgtcagttaccatttatgcatttgctttctagcttttaaattttgtttatgccttaaaaatacctgatgagggccaggcgtggtggctcaggcctgtaatcccagaattttgggaggtcgaggcaggtagactccttgcgtctgggagtttgagagaagcctgggcaacatagcaaaaccccatctctactatagaaaaattaacccagtgtggtggtgcacgcctgtggtcccagctacttgggagtttgaggtgggaggatcgcgtgagcctgggatgtggaggttgcagcgtgctgagatcatgtcactgtactccatcctgggtgacagaatgagaccccatctcaaaaacaaaaacaaaaaccccccaaaaaccttattagtattttagcacaatttggggaagaaatgaagttaaatatatgtatgttccatcttctctttacccagaacttatttctaattttttttttgttaagcatcttttttgttgtggtaaaatatacataaaatttattatttataagtatacagttcagtgacattaagtacattcacaatgttttacagccatcactactttctagttctagaacttttctatcacaccaaaaagaaaccccatactcattaagcagtcactccccattccctccctccctcagcccctggaagccacgaatgtgctttttgtttctatggatttgccttttgtggatatttcatataaatgaagtcattcagtatgcggccttttgtcacatgttttcatttaccataatatttttgtggttcatctatggtatagcatagatcactgcttccttcttttttatggctgaataattttcattgtgtggatatatcacattttgtttatctgttcatcagttgatgaacttttgggttgtttctgctttttctggctattgtaaatagtgctgttatgaacactgatgtacaattttttggggtgaacatttgtttttattcttttgggtatatacctcggtgtggaattgcgggatcatatatggtaattctgtctttaacttaatgaggaactgccaatctgttttcctcagtgactgtaccattttatattcctattagcaatacacaagtgtcccaatttctccacatttttgccgacactgttttccattaaaaaatttttattgtagtcattctagtgggtgtaaagtggtatctttttgttttgatttgcatttccccagtaactaatgacattgagccttttttcatgtgcttgttggccatttgtatatcttctttggaggaatgtctgtttaagtcctttgcccactttaaattgtgttgtctttgtgttgtagagttgtaagagttctttatacattctgggtactagacatgattttcaaatttagatacatgattttcaaatcttttgcctctagatgttttttacttttttatttttgatccttgaactcatctatattctatggttgtgatgtaatgatgtcagaattggtgtcatttgtgtttatttaccaggttatttggaaggattatattttaggtgctctcctctcccccagtaaatggtattatgacacaagggttataaaggactgataagaaattacttaagacagaaagggaagttggcctgcttccaaaatatggtcccagcagaagtgaagttagttacacaaataactacagtcaaaaagctatttttatccatgataatgtatttgttgttattaatattaaagattatattttgccaggtgcagtggctcacatctataatcccagcactttgggaggcttaggtggatggatcacttgagctcaggagtttgagaccagccagggcaacatggtgaaaccccatctctacaaaaaatgaaaaattaaccaggcttggtggtgcgtgcctgtactcctagctacttgcgagtctgaggtgggaggatagcttgagcccaggaggtcaaggctgtggtgagccgagatcgtagcactgcactccagcctgggcaacaggacaagaccctgtctcaaaaacaaaacgaaacaaaacaaaacaaaacgactatatttctgcattaagtgggggtatagaatcctatctaatatttgagataataattgttatagtattttattgagcttttattgggtaccagatgtgttctaagtttttttcatgaattattttcgttaatcttattcattgttgtgtcctgaatgagtactcacatatttgttgaagggctcaatggtccctaaaaccttacatgctgttttggaaggttaacttgccaaaggtcacatagttggcaaatgatgaagctgagattaacattaagatctgattccaaagtagtctttcttaactatattgctttatgtggagttttgtcgctgatatctagacagaaagtctctagcaatggaaaaaaaataatttttaattaattttaatttttttagtgttttgcttcttttattttttttattttgtgagccaccgtgcccaattggtttcttttaaaagactagttagcttgtgctttaggcctcttgattactctgaggtatttaattaatatctttgaaatcctacgatttactgtatcacttctgcaatatctaaatttttccttcttacttatttctgttctccttctacagtcctttctattatgtttaatcatcaaaacattgttcttgttttctactgcagtctaatttttagtgttatgctgtttccagatgccatttgggtcattttcaaaaaaagatgagtaataattagcaagtaatgaatattgttctttttaccattcattaagaacaattgttaattgtcttattctattgtgaagaatatctgtaattcctgcttagaacctgggttgatagcaggatctcaggaagcacgaagtgtacacagaacgatatagctggaaaaagtatatatgttaaagaataatatgttgtctaaggacagaatggaactgatcacacaggttcttttttggtaagcttcaaaacttcttatctcccataaaagtactttttcttttataatatgcaacaataactttctgtttagttaattagttttaaagcaagcttaaacttataatttataaagaatcatatttgctccctatcattgttttatagctggggctatactgacaaataagaaaaataaaattcctgcccttgtggaggagacagttaaacaatgagacaaatacatttcagatggaaatgaggacaatggaagaagagtagagcaggatgaaggcatgaagggtgactgagagctggtcaatctttagatagtgtaatacaggaaactgctttgaaaagatgacttttgagcagagatcttaatgtactgagggagtgaaccatttgaggtctggggaaagaattcagcttcctcttcagatgtacaaaattataagatattgccattcttgtaactgaaaacctataaaagcaggataagaagtacggtttctaaaaacccatctaagagctgaggatacaagggaacctaaatgaaccaaactccagaaagtaatcaaactttcgtagtagagaagaaacccgtggttgctctaggatggaacaaccaaaggaataggaatccaccatagatgaggggaaaggagaaaccagccacatttttttaaatcagatttttaatggccacgtatgggctggtttgacaggttaggatcctgagaagccctagcaactctagcaccaaagagcaagtatgcacccacactccagctcctacccacagatgttcactgaatgttcaggagtagtaagccaaaagcctgggccagtgacgaactggcatagataatacctgaggcatttggaacctctcccaggtatagggcaaccacccttagaaggcaggattgctgagagaaatccagcagaggcactccaggctttcagttctggaatgctgcaggcaggggaagagctagagataactctcaccccacactctggcagtccatgttttcagccaccaaggactggggacagggcagaagaggtgagtgaaactgctctaattcatttcaggccttcacagaatgtaaggaagctggcctccagaaggctggctggagaggaggagcagggctgcacgagggcacctgagcttcagaaagcaaggtgtgcgactggagagcaaggagaatctagcaaaccaaactctgaccgtcgtgcttaatgcagagatagagctcctacagtttttttttctttcttttttaaaatataaacttgaatttttgaaatagtttcagatttaaagaaaaattgccaagatagtatagagagttcccatagatgctgcctctagtttttcctatttttatttaatttattttttttttagtttttcctatttttaacaccttatattagtatggtatatttgttataattaatgaactaatactgatatattttcattaactaaagtccatactttatttacctaatgttttgggatcccatttagctgtcacatctccttagggtcctcttggttttggcattttcttagacttgagcttctcatctcttgtttttgataactttgacagttttgaggagtattgttcaggtattttgtagaatgtccttctattgatatctgtttggtatttttgtcattgttacagtgaggttttatatttttgggacgaagaacatgcaggttaagtacaattttctttcctttttttgagacagtgtctcactctgtcacccaggctggagtgcagtggtatgatgacagctcactgcagccttgaactcctgggctcaacgcgatccaccctccttagcttcctgagtagctgggactacagatgcatgccaccacacctggctaattttttttttttttttttttaatagagacagagtctcactgtattgcctaggctggtcttgaactcctaggctcatgcaatcctcccacttcagcctcccaagtagttgggactacagacatgtgccactatgcttggcagtaccattttcatcacatcatattaaggggacatactgtcaatatgactaatcggtgttgctattgaccttgatcatctggttgaggtagtgtttgtgtatttctttactacaaagttactcttttttctcctctgtttacatactgtactctttggaaggaagttacatatgcgcagcctacacttaaggcatggggagttatgatacccctcctcaagggcaaagtgtctatataaattatttagatttcttctgcatgggagatttgtctcttcttcctcatttatttatccattcaattttttaaatattagtatggacttatggatattttataccttgggttaaaatcttattattgctttatttattttattggtcaagttgttccagctttggccactgggagctctttcagttggtatgactttttgatataccactgtcagtgtatgtgtgtgtatgtgtgtttgcactttctcactttctggcactacaagatgcgctagtatatttagagactaaagcatgtagtatatgctttagtatatgctttatctagtatatttttctgtctcaatcctagaattagccatttctccatggagccttggttccttttactggagaatggagaaaccaagatctaggtgctaggtgcacatgttgctactggggtgttgttgcttgtaggccatctcagctgacagagccagaaaatgtatgtatttatactaccctgtatatatccacatatctataaatatttctatatgtatccatctgtatctaattaagctaaacatgagtttatattgatgtattcggttccagttgaatcactacatggatgattctaacttcctgcccttgcttatctaaaaactcctgctccaatagtgagaaatctgtctcctaccatcagccacccatttacttaatcattctactctagcatacatgtaaggtactcccacagttttaaaaattggtggcttggctatgaaacacaagcaggtctctgtaattttacctaggctcagatcccagacctgctcaagtgaaggacttgatctcagtccttaaatatttgaagccagtgattaactgtcaaattacagctgcatcatagcccacacccagctcagttacatattggattgactcagactcccttctagtgtcctaacagaaaaattgtcgtgtctttttctggaagtaaaatattacttaatttaataagtaatctatttttatataaaatgtctggtgtgtaataaaaagttacaagacacaagaaaagcaagaaaatgtgaccaaaggtcaagagaagaaatagtcagtagaagaagacccagagatgatccagatttatcagaattatcagacagggatttaaagataattatgaaaaaaatgctggatgattgaatgataaaggttaacaatatgcttgaaaagatggggatttctgtagagtcatggaaattatgccaaagaaccaagttgaaattccattaaatagaggtgaaaaatatactagcagagaccagagaaaacaaaaaaaggaaagaaaagaaaaggaaagggaagggaggggagggaagggagaaagaaaaatatactagcagaaatgaattcattacatgggcttaacagtttatggacatagcagaagaaagaatcagtgaatatgaagacagattggaaagagaaaagacagaaaaagtcagggaggggtagaaaagagattttagatctgtgggataatatcagatggtctaacatatatgtaattggagtttcagaaggagagaagagaatgtggcagaagacatatttgaagagacaatgctcaggaacttctaaaattgatgaggtcatcaattcacaaatggaagaagttcagcaaatcccaagcaagttaaatacaaaacaaaaataagccaacaaatttaaaaatcccatatataggcatatcataatcaaactgctgaaaattgaagatggaagagatcttacaagcaacaggagagcaacaggagaataaaggcacattagttatgtgagaatggcaacatgggttatggctaatccatgttttcagaccagaaaaaaatggagtcttagctgagcatggtggcacatacttgaacccaggagttcgagtccagcctgggtaaagtagtgagaccccatctctatttaaaaaagaaaagaagtccaggcatggtggctcacacctgtaatctcagaactttgggaggtgggcagatcacaaggtcaagaggtcgagaccatcctggccaacatggtaaaaccgcgtctctactaaaaatacaaaaattagccgggtgtggcggtgcacacctgtagtcccagctactcgggaggctgaggcaggagaatcacttgaacccaggaggtggaggttgcagtgagctgagatcacacgccactgcactccagcctgtcgacagagcgagactcagtctcaaaaacaaagaaagaaaagaaaagaaaaaatagaatgttaaatacaatgggatgacatccataaagagctgaaagaaaaaaaaaaaaacaacctgttaacctagatttctatggccagcagaaatagccttcaaaaataatggcaaaataaagacttttgggacatatcaagaagggaaagaatttgtttccagcagacctggactcaaaaaacattaaaacatacacattaacaagatgtgggttttacagcatatatgtgattatacaaccatgaaagaacaaaaaggaggagatggaattatactgtcatatatttcttactctgtgaaaggagactgtagtaacttctggatgcatatgtaatctctagaacaagcactaaaaacacaaacagggataccataaagtcagtacatctgcctaagagggattaactgctacaagaatcattctcctacagtaaacagctagaaaacaggacaaaaatacatgaaacaactgttttcagacattggacaacaggcagcacaggatagtgatccctgagagaagggaaataactgatatgaaccctacaggggttcctataggcagtttccagattgtagcacagagtaggggaatccaaatagagcccaggagagtttggagaagtcaaggcaactagaatttgtggggcagaaaacaataaaaggaactacacagaaatctatagaagtaagagaatctttgattggacactcatctgcacatgcaaagtgtggaagtcagcagtgctggagaaagtcacactggaaatcagaacactgaacaattccaggagctcacacagagctgggaatagtttatgtttccattaggcatagtggagagactgtttcatacaaaggacattggctagagtcttcaaagtggggttaaattagctatagactaaaggcctttctaaacctaccctaagcttcaaggcaggttttgaaaggaccaggctgattctaagtaactcaattatgtgccaaaactaaactcttttaaagaatacagtaaaagccagcacctaacaattaaaatgttcagcattaataatatattaatgaaagattactaggcatacaaataataagcaggaaaatgacccataaccaggagaaaaatcaatagaaaagagacctagaaatgtggaattattagaaataattctgatgattgaattatcagccaaatatgttaatacaagtattataatgactagtagagaaatgaatgatagataaaaagacacaagccagatatggtgactcacgcctacacacttgagggtgggcagatcatcttgcccaacatggcaaaaccctgtctctactaaaaatacaaaaattagctgggtgtggtgggatgtgcctgtaattccagcttgggaggctgaggcacgagaattgcttgaacctgggaggcagaggttgcagtgagctgagaacatgccactgtactccaacctgggtgacagagtgagactttgtctcaaaaaaaaccaaaagactcacaagtagtatctaaagatgaaaaataccagatataatatccaaaactgggggaaaaactggatgtgattaacagcagattagacactgtggaaaaaaagatcattaaatgtgaaggtatagcagtagaacctattcacattgaagcacaaagagaaaaaaaatactagaacaaagttaatagaacatcagtaacctgtgggacaatagcaagttgcctaatacatgtataattggagttccagaaaagtggggaaaggtagaaagcaattactttaggaaatagtgtctgggtggccgggtgggtggctcacacttgtaatcctagcactttgggggccgagaggggtgcagatcatttgagatcaggaatttgagaccagcctgtccaacatggtgaaatctcttctctactaaaaatacaaaaattagctgggcttggtggcatgcgactgtaatctcagcttcttgggaggctgaagcatgagaattgcttgagccagggagatgtaggttgcagtaagccaagatcatgccactacactacagcctgggcaacagagtgagaacctatctcaaaaaaaaaaaaaaaagaaaaaaataagaaaatagtggctcatcatggtggctcatgcctgtaatcccagcactttgagaggctgagatgagaggattttttgagcacaggagttcaagaccagcttgggcaatttccttaaaaaagaaaaagaaacagtgactataaattttccaaatctgatgataaccataaactctcagatccaagaaactcagtgaactctaaatagaataaacaaatataatcatacctaggtatgtaataataaaattagtgccagtcatggtggctcatgcctgtaatcctaacactttgggatgctgaggcctggagtttgagaccagcctgggcaacatagtgatacccctatctttacaaagattaaaaaatagaaatataaaaagttagccaggcatggtggcacttgtctgtaatcccacttacttgggaggctgaggtgggaggattgtttgagctcaggaggtcaaggctgcggtaagccataattgtattccacccagggtgataaagcatgacgggagatcctgtctcaaaacaaaacaaaaccaaaaaaaggcgaggcacagtgactcacacttgtaatcccagcattttgggaggtcaaggtaggatgatcgcttgagcccagaaattggagacaagcctgggcaacatagtgagaccctgtctctcaaaaaaaaaaatttaaaaaggggggcatggtggcatgggcctgtagtcctatctactcaggtggctaaggtgggaggattgcttgagcttgggaggttgaggctgcagtgaactgtgttcgtgccactgcactccagcatgggagacagagcaagatcctttctcaataataacacataaaccaatgttacaattagaagaaataaattctggtgttcggtgtttttttttttttttttctgagatggagtttcgctcttgttgcccattgctggagtgcaatggcatagtctcggctcactgcaacctccacctcctggattcaagatgattcttttccctcagcctcccaagtagctgggattacaggcgcgtgccaccacacccagctaattttcatatttttagtccaccacgttagccaggctggtctcaaactcctgatctcaaattctggtgttctattgcacagtggggtgagtatagttaagagtaaaatattattacaaaatagctggaagaggggcttttgaatgttctttcacaagtgagaaatgcaggaggtgatggatacactaactgctctgattggatcattatgcaacatggatatgtatcaaaacattgaattgtggcccagcacggtggctcatgctggtaattccagcactttgtgagtctgaggtgggtggatcacctgaggtcaggagttcaagactagcctggccaacatggcgaaaccccgtctctactaaaaatacaaaaattagctgggtgtggtggtgcatgcctgtaattccagctactcgggagactgaggcgggagaattgcttgaacctgggaggcagaggttgcagtgagctgagattgcgccatcgcactccagcctgggcaacagagcaagactccatctcaaaaaaaaaaaaaatatatcaaattgtaccccataagtacgtacaattacaatatgacagtttaaaaaataaatttcaaaaaattctcttgtacttaccagctgaataaaaaataaatttttaaaaggagagaagtcttaaaaaccagttatttaccccatcattaagttataatgaactttcttatgggaattctttgataaggaagctcctttacgctgaagttttattcttttcatacctctttagataaatcagtgctttgggagcatatgtcatatgactcaatggcagtgttctaacttggattctagctccacattgtgcaaaggcaaaaaaccagagagtcagtgtggtagttaagaacttatgttttgctgtttgatttcctacatgccagtactccctccactacctgcagtcttcctgacctggggcaagttccttttgtaaactctgttttctagggggatggtggtggaagaaggatggtgatttgagccaggcagtagcaggtggaggtggagaaaagtggtcaaaccctgaatgaacgttaaagataggaccaaaaggatttgatgagaaattggaagtagagcacggggaaaaagaaagacatcagtgatgatgccaaggttttttggcctggggaattgggatagtggagttgttatttgctgagtatgacttttcacaaaggaatgtcaaggcgtaagtagcaaagttctttctttttttttttaatttttcttgattgtgtttgttttgtttttcatcttttgtgggaggtgggtggagatgaaagcaagcacaggggttggcaggcatacccctggcacctacctgtgagttcatgattactagtcttaaattcagtcctttttatttttacttttttttttttttttttttttttagagacagtgtctcactctgtcatccaggctggagtgcagtggcacaatcacggcttactgtagccttgacctcccaggctcaggtgatcctttcacttcagcctcctgagtagctgggactacaggcacataccaccctacccagcaatttttttttttaattttttgtagcgacatagtcttaccatgttgcctaggctggtctcgaactactgagctgaagcaacctgtctgcctcagcctcccaaagtaaagtactgtaattacaagcttgagccactatgcgtggccaaattctggcctcttgatgttgcatggcgtggatggggaggtgaagtgtgatattttaggaatttgaggatttcttcttcgaccttaggcgtgacattggacaaatgacatctgggctgagacattttctattaattctgaatccaaaaaactcttatcccattgtctcatagcttcattacacagacctggcagccatgatcctctttttttcccccttagttgtcaaacatgggttctctgtcttacctcatttgagtcttacctcagtcttgagagtctcaaatgtatatcatagtttttagacaaaattcaaccttatttcagttagtatttcattgttatttaaatattttaacaggaaaactgagcaatgtttccctttacctgttaatcctgttataatattttagataaagtgtattagaaggcacattcttcattaatagaatatttattcatgtgtttatatggttcttaactaggaataccatatagtctatctccaaccctttgagaaggaaaaaagatactgactaaacaggacaccagaagagcatgcctaaactaggactgttctgggcaaatcagaaggcatgttcaccttattctttttattctttctttttttttttttttttttgtgacggagtctcactctgtcgcccaggctggagtacagtgacgcgatcttggctcactgcaacctccacctcctgggttcaagcgattctcctgcctcagcctcctgagtagtgggactacaggcacatgccaccatgcctggctaattttttgtgtttttagtagagacgggggtttcgtcgtgttagccaggatggtcttgaactcctgacctcatgatctgcccacttcggcctcccaaagtgctgggattacaggcatgacccactgcacctggcctcaccctattcctaaggccagaaaaccagctagagtaaagttcactttctgtttgagtgcttggactttattgggagaaggcaaatgccctggaacaagagtgaaagggagaaattcccgttgtattgcaagccagaataagagaggctcacccgcactggcctaaggcatctcagttgttgatgagaatgtgattacagatgtctcacttgaataccaaagacaattgcaaaggaaattaaaagttatgcaaagagagttgagaagtcagttgtctgctcacaggttggctttagtggctattactttgagatactaaatgagcaatagctttaaacttcaactgcttttgtttctgaggaaaaaaatcatcttatatcctttcataagtcgcataaaatgtggacattttctattattttaaagagtaaatttaggtacaagcatttactaattttttttttttttttttttttttttttgagatggtgtctcgctttgttgcccaggctggaatgcagtggcgcaatcttggctcactgcaagctccgcctccctggttcacgccatgctcctgcctcagcctccagagtagctgggactacaggcgcccgccaccacgcccagctaattttttgtatttttagtagagacggggtttcaccatgttagccaggatggtctcgatctcctgacttcgtgatctgcccgcctcagcctcccaaagtgctgggattgattacaggcgtgagccactgctcccggcctgtaattctttttttttttttttttttttgagacggagccttgctctgttgcccaggctggagtgcagtggcgtgatcttggttcactgcaagctccgcctcccgggttcacgccattcttctgcctcagcctcccgagtagctgggactacaggggcccaccaccacgctcggctaattttttgtattttttagtggagacggggtttcaccgtgttagtcaggatggtctcgatctcctgacctcgtgatccgccctcctcagcctcccagcatttagtaattcttaaaagagttcggcatgaatatacacagtacgtgggttattagtactgtgttgttaacacaaatgaactatgatagcaaattgaatttggttcaatcaggtcaaagaataaaaggatgattttctttaaccaacaagggatagtataatgaaccccatgcaactatcacttaacttcaataatttcaagtttgagtaagttgcagagtagtaatttgaacccacatctctcttgttccaaatcccttgcttttaattacaatcccatgtggcttctttgtcatttgatgctattgagcaactttatgattttttttggtgtttttggtaaaatagacatgaaaaggcattactacagggagttttttcactccctggtaataagaggggaaaagcactctcttttaatgatacatgttttgtaataagcattttttttagttgcagtgttctgcaaagacaaaacctgctgatacagttcatcctgttttagaaatctttgacccattcatcagactctgaccactctaaagataaaggattatggttgtattggtttttccgactgaagcggctttctgcagattgagaaattgtataattattaactgcggtaatggagatgtacttgcaagtttcatctggtatcttaatgagctttaaccctctgaatacacctaaaacatatcctagaattattgaaattaatcagttgtccataacttttctgtctgtataatttggctatcatacatattttgtttccccctgcccttgccagtttccatcctcctactcacatactcacaactcctataaattggagtatttagtagcagtagcctttggtataaacactttttaaaaatttactattttttgatttaatagggccactttctagtcaaattttttttgggggtggtgaggagggtagggtaacagttccacacttacaagggtatttgtttagacgaagcttgttcaacccacagcctgtggggctgcatgtggtccaggacggctttaaatgcaacccaacatgagtttgtaaactttcttaaaacattatgagttctttttgagattttttttcgagacagagtctcgctctgttgtccaggctggagtgcagtggcccgatcttggctcactgcaacctccacctcctgggttcaagcgattctcctgcctcagcctctggtgtagctgggattacaggtgtgtgccatcactccaagctaatttttgtatttttagtagagacggggttttaccatgttgggcaggctggtctcaaactcctgacctcaagtgatctgcccaccttggcctcccaaagtgctgggattataagcttgagccaccgcgcccagcctgcgatttttttttttttaagctcattagctatcattagtgttaactgtattttatgtgtggcccaagacaattctccttcttccattgtggcccagggaagccaaaagattagacacccctgatttagacaaataagtgaaggcacactgaaataacaattatatataataaccttgtgccgcccagcgtggtggctcatgcctctaatctcagcactttgggaggccgaagcaggcggatcagctgaggttgggagttcgagaccagcctgacttacatggagaaaccccatctctactaaaaatacaaaattagctgggcatggtggtgcatgcctgtaatctcagctacttgggaggctgaggcaggagaatcgcttaaacccaggaggcagaggttgcagtgagctgagatcgtgccattgcactccagcctgggtgacaaaagcgagactctgtctcaaaaaaaaaaaaaaagaaaaaaaaaaaaaaaacaaaaaaaccttgtgttttatggatctcacattcatctcagatatttcttgccctgagagatcctctgaattctcaggattgcttcatgttgattctactgtgatcctatcaaatatagtaatgctagaaatataggtctgaagtttgggagagagattggctcagtatagatatgtaaagcacagttggatatgtggtagttatatgaatgggattggatgaaattctctagaggtgtgtggaatggaaagaggtggcccaaggaggaagagagagagagagaaattggagaggtagaacaatttaggaaagagtaatgttctagaaactaaggagagagtttcacaactgcagtggtgaagcactgtgagttcttatttggcaatttggacttcattattgtcttatcacagataggaaatgaaaggttgcagaacatttaggagaaaatattaagtgaggacacagaagcggtaaatgtcgtatacaccttttaaacattttggagattacccatagtaggcctgtcccttgggtaaggcaattagggcagctttcctgggccctattttggggtggggaatgactcggggactttattatatgactttttttctgaacattaataaaattcagttccaaaattttgtgattaactgtagtcctaagagcctacgaaaaatgcagataatgggcagttccacattggttgaactgccccaggcttctctcttctagagttgctgtcccttccttttaatcctgtagtagctcctatcactttttttttttttttgagacagagtcacccagactggagtgcagtggtgtgatctcagctcactgtaacttctgcctcctgggttcaagcgattctcatgcctcagcctcctgagtagctgggattacaggtgcgtgccaccacacctggctaattttcgtatttttacaggattttaccatgttgcctaggctagtcttgaactcctgacctcaggtgatccacttgcctcagcctcccgaagttctgggattacaggcgtgagccaaggctcctggcctcctgtcactttttataattgtcagtttgtttttcctctcagaaattaagctccttaaagctctctattattgttttgaattcccagggcctagcataatgcccagcacgtaatgttgaatgtttgttacgtaagtgattgaaggaataatccaatacatatctgtcttaagtacaaaagaattccaatatggtggtctcacagagtcaaaaaagcggaatgtttcagaaaagagggattgataaacagtttcaaatggtagtaaaagtattgaaaactgacctttggatttggcttctagaaggtcattggtttccatagtgaaaacttttatagcaaaatggttggagtagaagtggttgaagattaaaggagaaatgagatgtaagaaacaacaaacaagtttgtgggggggcgggggttggttttatttttaaagatttgtagctgagcgtgacagtatgtatctgtagtcccagctatttgggaggctgtggctggatgatagcttgagcccagcagcttgaggctgcagtgagccatgattgcaccattgcactccagcctgggtgacagagagagaccctaactcaaaaaataaaataaaataaagatttgaaactaaagggaagaaaccattggagaagaaagccaaagatctgacggaggagaattcattatcatggtaatgttatgcatttgatttgcatatatctaagtattcccaccaactttttttttttttttttttctgaggcagagtctcactctgtcacccaggctggagtgctggagtgcagtggcatgatcttggctcactgcaacctcccgggttcaagcgattctcctgcctcagcctccctagtagctgagactacaggcttgtgccatcatgccctggtaatttttgtgtttttagtagagatgaagtttcgccatgttggccaggctggtctcggactcctgacctcaggtgatcctcccacttcggcctctcaaagtgcggggattacaggcgtgagccaccatgccaggccccaaccaacatttcaagataatatatttctccttccacttgggtttgatatattaatgtattttgaacttgaaggcttttgctgtgctatttggggcccctagtggtaaatctaataatgacatgcaatagaacagctaatataccagttattccttatgaaggttattctttctatgaggattaaatgaggttggaatatgtagttatagcaatagtagtgattcttaatcatttttttaaagagagggtctcgccaggcacggtggctcacacctgtaatcccaacactttgggaggccaaggtgggtggatcacttgaggtcaggagtttgcgaccagcctggccaacatggtgacaccccatctctactaaaaaaactaaaattagctgggcgtggtggtagatggctgtaatctcagctactcggtaggttgagataggagaattgcttgaacctgggagacaggaggttgcagtgagctgagatcacgtcattgcactccagactgggtgacaagagcaaaactctgtctctaaataaataaataaataaataaataaaaggtctcactttgttactcagactgaagtgcagtggtgtgatcatggctcactgcaatgtccgcctctcaggctcaagtaatcctcccacctcagcctccctagtagctgggactataggtgttccactactatgtccagctaattttaagaaattttttagtttttaaatatttttgtagagatggtggtcttactatgttgtccaagctggcctcgaactcctggtctcaagtgatcctcccacctcggcctcccaaagtgctgggattaccggtgtgagccaccatggctggccaaaaatgagtaatttttttttttttttttttttgagatggagtctcgctttgtcgcccaggctggagtgcagtggcgagatcttggctcactgcaacctcctcctcctgagttcaagcgcttctcttgcctcagactcccaagtaactgagactttaggcacgggccatcacagctggctaatttttgtatttttagtagagatggggttttgccatcttggcctggctggtcttgaactcctgacctcaagtgatccacccccttggcctcccaaagtgctgcgattacaggcatgaaccactgtgctctgccccaaaatgagtaatttaaaggtgactgtaatatagttaaacaaatgcctcttttcccattctttactaacttgttatttaaatggggcaagtttttacaacataagaaataaacaggccaggcgcggtggctcacgcctgtaatcccagcactttgacaagcagaggcgagtggatttcttgaggtcaggagtttgagaccagcctggccgacatggtgaaaccccgtctctactaaaagtacaaaaattagccgggcgtggtggcacagactgtaatcccagctaatcagggggctgaagcaggagaattggttgaacctgggaggcggacgttgcagtgagcctagatggcaacactgcagtccagcctgggcaacagagcaagactccatctcaaatgaaacaaacatactaaaaacctatttacttgtttgatgtgagtgtgcttagctttattccccttaaagagagtctttttttgagatggagtctcactctgttgcccaggctagagtgcagtggtgcaatctaggctcactgcaacctccgcctcctgggttcaagcgattcttctgcctcagccttcaagtggctgggactacaggcgtgtgctaccacgcccagctaattttttgtttttagtatagacggcgtttcacgctgttaggcaggatggtctcaatctcctgacctcgtgatccacccgcctcggcctcccaaagagctgggattacaggtgtgagccactgcgcccggcctaaagtgagtctttaggtgaaaaatttttgtgaatattgtgatttctccttaataatttcttgtgtatttatgaattttatataattaaatggcatatcaaaaaaatcacctatgttaattatgtttttgactcagttatattttcttttggtacattattaagttaatatccatatgcaaaaatatgctgacaatatattaattttggatttttcatttttatcagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacaggtgaggtcattatggtatagtggtagcttattttataaagctaagttttgtttgtttttgtttttctcccacttagtctttgaagactctttagtcatttgcctcttctgagcgcagcataattgatccctttatcgcatctgcattgttctcctttccattgtccactctcctgcccattgccacttctgggcctctgttctatccttctcagctctgtcccttctttccacttatcccctcctttaataagccttccctagtcaggtggagtgggtcacacttgtaatcccagcactttgggaggctgaggcaggaagattgcttgaggccaggaatttgagaccagccttggcaacacagaacccgtctctacaaaaaataaattaaggtttgcgtgcctgtagtcccagctacccaggaggctgacgcgagaggattgcttgagcccaggaggttgaggctgcagtgagctttgattgggccactgcactccagcccgagcaacagagttagacctttctgcttctttacctaatgtctaataatgctgtgcacattgtatttttactgtgggaacagttattgatttctattgccttattatcaaaattatattaattacacttggaaatatggaaaggaaaaaactggtattataccaacttcatataaccaccaatagagttctagagtgttgccttccagttattttctctgttctccttaaaatgtgtgtgcatgtgtgtatatatcacacatagaagctcatatttattgggagcttagtttgtgagaccctgttttagattttacatgcatatttcattacaacaagtatatgaggaaggtactgatttttatccctacttttcagttgaggaagctgaagcccagagaagtaaagtaacttgtccaatgtcatacatctaggaagtggcaaagctatagtttctcctagactccagaatttatactcttactatatagttgtaaccataaagaacattttgtttttttaatttttaatttatttatttttaagagacagagtcttgctatgttgccaagtgcagtgggtactcacgggcacaatcccattgctgatcagcatgagaatttttaaattgttatttttaattttttgtttgtttgtttaatagggacagggtctcactgcattacccaggctgatctccaactcctgggctcaattgatcctcctgccgcagcctcccgaagtgctaggattacaggcgtgagccaccgtgcccatggtatttttaacatgcccttgtttccaacctggaccagttcacccctccttagggaacctgtggtcctccactcccaggaggtcactatattgatggcaagcttagtgcagacacctgatcggctacaactctgaactcctgggctcaagtgagcctcctgcctcagtctcccaagtagccaggactacaggcacgcatgccgctgcacccagagagaatatttaatatttttttttttttttttgagacagtcttgctctgtcacccaggctggagcgcagtggcacaatcttgactcactgcaacctccgcctcctgggtgcaggtgattctcctgcctcagcctctcgagtagctgagattacaggtgtaagccaccatgcctggctaatttttgtatttttagtagagacggggtttcaccatgttggccgggctggtttcgaactcctgtcctcaggtgatccgcccaccttgtcctcccaaaatgctaggattacaagtgtgagccaccgtgcctggccagaatatgttttcaccgaacacatctaacattgtgttacatgttctttgttgatttaaaattgacacatggtgtattagagcaggaggaagttgattaagcttaataaaatatctaaagaaagaatgtgatacagaggaggtatttagaagaagaaaacttcgaagcaatattgataatcctaccaaatagtttacaggaggaatgagaaccttagctaatgtaccttggtgttcctgtaggattgtcaagtacaatcttttttgtttttttgagacggagtctggctctggcacccaggctggagtgcaggggcgcgatgtctgctcactgcaagctccgcctcccgggttcacgccattttcctgcctcagcctcctgaatagctgggactacaggcgcctgccaccgcgcgcggctaatttttttgtatttttagtagagacagggtttcactgtgttagccaggatggtctcgatatcctcacctcgtgatccgcccgcctcagcctcccaaagtgctgggattacaggcgtgagccaccgcacccggccgagtacaatcttttataaagaggtaaacacaagattgtaatgaacaggcttagcatagccacatcccactggcagtattagctaatattatttatatgtgattatattattggagattcaattcacctaactccctctgttctgattcagtgcttgctgaatacctctttgcttgtgatttggctttctagttgtagagctgcccacagcatgagaacaggctgaaatactgtttttttgggcaattaatgcctcattgtaaatgaaaaaaaaatttttttttctttaatttgtttcattagttgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttcctttttcctaggtaggtgtaaactcaactctgcaatctctgtattttttcctaacatctctatagttgttaacaacgaggtaacattctctctggtggctgaaatgcaatttacttaaccattttcctattataagacatttagatgatttctatgaacattttttttaaaaatcagatttttttgtctttttaagaaaaagaggacctagttcacttatttctgaataagtttcttttgtgtggaacagatggaaatgttgggaaaaaaaagaaatctacacttttctgttgtcctaatgaggcagtgaacttagttggatagcctgggtagttcatactacctattgatatatacccccaaacagaaatcttcctttttttttttttttttgagatggagtcttgctctgttgcccaggctggagtgcagtggcgcgatctcggctcactgcaacctctgcctcctgggttcaagtgattctcctgcctcagcctcccaagtagctgggactacaggagcccgccaccacgcctgactaatttttgtatttttagtagagacagggtttcaccatattggccgggctggtctcgaactcctgaccttgtgatctgcccacctcggcctcccaaagttctgggattacaggcgtgagccatcgcgcccggcccaaactgaaaaattttaagtaacagatgtattccagaccttgttgaataccaacacagcagacagtttgctattataacttctagcaatagaatgaagagatgccaaaaataaggattacctaagggagactactgactagaattagaagaagatgggaggcttaacattgggaaacaacagtgtttaaaggacaaacagaataaggactaggagctggggcatgtcagtgagagggtaggaaggagccaggaggccagggcgggctacccatcccctccatgcaccactagtgattaccatgtcactaatccaacatatgcttcacagtcctagctttcagaatgctctccttgaaatttctcgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattaatgctctgatgaatgactcattagcattgtaagaaatgggttgcaggcgggacaagcacctgttgggagggaaaggaatgtgtaatgtaaaacagtagtagtggtggggcatgggcacatttaagcagcagaggggtaggtgggggctggtggcaaggagtgggaagggagaggcaagatgacttcagatgttagtttacttgattagcagcatagcgtcaacaaatgagttgggcgctatgaaaggaaaagcaggtttggacattgctgagtttggggagccaatggaatatccaggtgggaatttccattaggcagttgtaggtaaaaggttcaaaagctgaggaaagggtctggaatctaaatctgtaagtaatcacttggaatttatacatccttggttttctttcctattatctctacattatttcactattgttaatatatgtttatacctctgacactgtatgctgattagatcctgccttagagatagctcccttcccctctttctctttacagctcacacgttttgctctacctacaattgtttctacctgttggtatgtttagttctacctgattctactctatccgtcttagatatacagctctctctttccaattggaaaatgttccctacctccaaagtctttcacttttaacttatgtggaagataattatagtgctatttagggaaaaataatcaagtgtgttaagaatgccttatattcagatatatttatagtagaagggaccagtgcatactgaatattattactctcctaggcactacggctttggaaccactactttgccttctggtcctaaaaaaaattatttttaatgtatcagaaatatacatgataacattttccttatgtaaataaaaactattaagccttttttatatagagcagtggacttccatactgctatcatttgaatataaagaagcaattttgttaatttacctagatttagattttagatttgctgttttcttatttcgtgcctttaggcaggttatttaacctatttgatctctacttgcttggtatatgggaggcatgcatagtattttgttgtgactagtaggttaaccacattgtgaaggaatttatggcatgatcagaacgttttttctctctctagatgttgttattcatgaggaccaatggattggcgagacagtactacaatcaacatttagcagtcagttattaaatcttgggagttattcatctattcagcctgaagaatgtaaggcacattttaaatgaagtaatgtagtagtgtttaaagtataaaaacatactaggaaagattagggttaaaatggttcttttacaaaatgttttctaaacagttggagagtattggtttcttttcattagtaagaatgaaaatagaattttaagaaatgaacttgtacattgtaaatcacatttattttaagaagtattgggtctcatgtttcgttttcttaggccatcagtatagtggtggttcttcaccttttagggagtcagagacctctttgagaatctatagaccatttctccagaaaactggacttatgtagataggcacaaaattttgcttataattctaaagcattccacggacctctgaagttcttctgtggaacttctgagcctctgattaagaatccttgaggtaataaaaatgtattggtctcgtattcagacagctgtggtttgaatccttattctcctgtctaccactgctaagaaaagctatctttcttctttaatgtccagttttctcttctttaaaagaagctgtttaatgaggaaactagcagctatctcctcctctaggaaataaaataacataaaaaaaagaaagaaaacaaagtaagggaaacagtataaacttgtggttatggtcactggactcagatagaccaggatttgaatactggccctcttacttccagtctttgtctttaggcaatgtatttcacttcactatacttttgtctccttttctgtgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaaatatcatacaagaaaatagctagagaaatatactgattatacaagaagataactggaataataggaaagttataggatatatatatggaagatagagcatggaattccaatctttgaattcttaaagaaaggcagagcaagtagaagggaagagcaacaattagaataacaagaactgtgtttggaatgggcaaggtttcattatatactagggtggcccatcagcagaaaaccaactctgacatatttcatagacaactaaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatgtgcaggtgataatgagtgctatgaaggaaactaacaaagggttaagatacagaatgccgtggttctagttgagaaggattgatcatggagtagaatcagggttaggaagttgttacaatagctgcagttgagagataatgggaggccagtggagctaaagagctgagatatatttgtaaatagagttaataggattttctgatgatgtgggtctggggatcagggaagagggacaatctactgctactgaattactggtttaagtaactaggtagcctttattgggaaagactgagagggaactggtttgtggggaaaaggactatgtttcaaggcatgttaagttttagatatctttgagatattcaagtggaaatgtcatataagaactggaaacaaagttcaggactcagaagacaggtttaaaattaagaggcaaattttagagttattagcatacagataatatttcaaatttaaaagttttttaaataataaatatctgtataattatagaatcacaggggattgcaaaaataatacataaagtcccatgaactcttcttctagcttctcccaatggtgatatcttatataactttagtacaatatcaacaacaggaaatcaacgtttgtataatactgttaactagtaatatactaggatactttccctttcagtatcaataaatatagtatcagcctggcacagtggcttatgcctgtaatcccagcactttgggtggctgaggcaggaggattacttgggcccaggagctcgacaccagcctggatgatatggtgaaacctcatctctactaaaaatacggaaaaattagccaggtgtagtggtgcacacctgtagttacagctactagggaggcttaagtgggaaagaaagttgaggctgcagtgagccatgattgtaccacagcacttcagcctgggtgaccggagtcagaccttgtctcaaaaaaattttttttcttaaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaatgcacttagacaagaagaggcatctggtctggtgcggtggctcacgcctgtaatcccagcactttgggaggccaaggtgggcggatcacttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctgggaggtggaggttgcagtgagcaccactacactgcactgcagcctgagcgacagagtgagattcggtctccaaaaaaaaaaaaagaaagaagaggcatttgaatggataaagaagaatgaaaattatttctatttacaaatgctctgataacatacctgaaaactccagggaatcaaagttaaaacaaatttaaataataagataattcagtgatataacagaatgcaaaattagtgttaaaaaatatcattaggctgagtgcagtggtttgcgtctgtaattctagccctttgggagatgaaagtgggtggacagcttgagcccaggaattcaagaccagcctgggctacaaaaaagaaaaagaaaaagaaaaaaaagctgggtgtggtggcacccacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaataataatagtaattagacttaatatacacaaataataaacagagggcataatgatagtgaaaaactcatttactatagtaataaagaagatagttcaaaatacagttaacaagaaatatgcaaagcctatatgaggaaaaaatttaaacactccagaaagaaatgaagacatgaagaaatggaaagacattccctgttcttggataggatgactcaacattataatgatgtcagttcttcctaagttaatatgtaaattcaatgtagttccaatgaaaatatatatgttatggcatataaaagttgatactaaagctcataggggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaacagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacatatctcacaacaaacagtaataaacaccatatggattaatagtctaaatgtaaaaaataaaatcatgcaacaacaagaaagaaacctgaatgaatcctctgtaatcttggtgtagggaaaggctttttcttaatattactcagaatccaggggcagtagaagataaactgatacattttactatagaaaaataaattttgcataaccaaaacactataaacaaagtcaaaagacaactgacaaacttggagaaaatatttgtaacatacaacaaaaggctaatatccctaatatataaagaacttttaaaccctgagtgacaaaggctgggtgtggttgttcacactggtaatcatagcattttggaaagctgaggtgggagaatcacttgagctcaggagtttgagtccagcctgggcaacatagtgagaccctgtctctacaaaaagtcaaaaaatcagcccggtgtggtggtgcatgcctatggtcccagctacgttggaggctgaggcaggaggattgtttgagcccaggaggtcgaggctgcagtgagctgtattcatgccactgcactctagcctggcaaaagggaaaatgtgaaaaagagatgaacagtcagttttcaaaaaaagatataaaaatggctatcaaatataacttattagagaaattcaaattaaaactacatggagataccatttctcacctatcagattggcaaaattaaaaaaaagcacattctgttggcgcaactgtgaggtaatgtgccctcttaatacattggtggtaggaatgcaaattgctacaacccttgtgaagggatatttggcaatatctaacaaaattacatatgtacttagctttcaacctagcaatcccacttctaggaatctaccctgaagctacacctccaacaatatgaaaatacatatcacaaggttattcattgcagtattgtttataattgcaaaatatataggagaatgattcactaagttatgctacattcacatagtggaacactatgtactatgcagctgtacaaaaagaatgaaaaagatctctatgaactgatatggagtgattcccaggacatactgttatgtgaaaacataaaccccccaaaactgtatgtagtatgctgtccttcctgtacgaaggaatggaggtataagaaaatacctcggtttatttgtggaaagaaaatgcaggaaggataaaccagaaactaaagagattggtcacctacagggggcacataggagaggggtggaagaaagtggggaatgggaacaggatagcaggggtcaggaggaagtgacactaacaaatgaatgtaatattgttacaagtgaacctaatattgttacaaatgaataaaataactacacagaagcgggtggggaagaaaagaacaaacctaagtagctgtggaaaagagtatattgactggattctataaggctaatgacagaaaggactgtacataaatgctgcaatctagttagaaatatgtttctcaaaggggaatggcttagcaataaccttatgtacatactagaatgaacaaatgagtacatagattgtagataaggaaagctggatttctcactgttggagaaagaaattataaacaagggaaggttaaaacgaaccagaggtattgttataaactgaggatttttaatatagataaatggatacagaaatataggcatgtgtatatgggtgggatagtacacatacataaacatctcctagttctgtccattgagcgagcacagcacagatgcagttactccccagtaataatgagcatacctggtgcccagatcttcatctgtaaacattttcttttcttttcttttcttttcttttttttttttttgagatggactcttgttctgtcacccaggctggagtgcagtggcgtgatcttagctcactgcaacctctgcctcctgggttcgagcaattctcctgcttcagcctcccaagtagctgggactacaggtacgtgccaccacgcccagataatttttgtatttttagtagagatggggtttcaccatgttggccaggctggtcttgaactcctaacctcaggtgatctgcccactttggcctcccaaagtgctgagattgcaggtgtgagccactgtgcctggcctctctttttttttgagacagggtctggctctgttgcccagtctagagtacagtggtgtgatctcggcttactccaacttctgcctcctgggctcaagccagcctcccacttcagccttccaagtagccggtaccatagctgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaacagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttactgacataaagatatatgtatttcattaactaaccagaggggaagagagagctcttccttccaatggaattccaattaataaatctgagagaaaagaaaaaaaaatagagaattactggccatgctcagtggttcatgcctataatcccagcactttgggaggctgaggcaggtggatggcttgagcccaggagttcgagaccagcctgggcaacatggcaaaaccccgtctctacaaaaaatagaaaaattaaccaggtttggaggtgtgtccctatagtcccagctattcgggaggctgaggtgggaggatagattgatcccaggaggttgaggctgcagtgagctgtgatcatgccactgcacttcagcccgggcaacagagtgagactctgtctcaaggaaaaaaaaaaaaatacaaaacacaaaaatagagaattaccatcaggcagagatcacaataataaatactgcactgacacaaatgcactgatagatgctaaaattagtaggtgaaagtttgaggagagagagcattgcatagtctcaaagtatctccccaagataccagcatactagagggaaaataataaatttataagaaaactcttcagacaccaagttaactgagtgattgggataaatatcaccagtaataagatgtatggtatcataaatgctttgatattatccattgagaaggatccaccatattttttgtggaattgccaaaaatgcataacttcattccaatcataaaacactggagaaacccaaagggaaggacgttctactaaataattgatcaggattcttcataagtgtcaaggtaatgaaaaagaaaagactgagaaactcttatagactagaggagaccaaagagaaataacaactaaatatgaggtgggatcttggatgaaatcctacatagaaaaaggatattaataggagaattgataaaatttaaataacatctacattttatttaacaatatttaattaacattagtttcctgtttaagataatttataatatgtgagatgcccacattagtcgacatagtgaggaatataaggtaactctgtactatttttgcaacttttttgtaagtcttacgttagttcaaaacagagtttttaaaaaagctgtatacgatcatctcaataggtacaaagaaagcttttgataaaattcaacacttgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccgtattagagttattaaccagtgcaataaacatggaaaaatagatatgtaaagattggaaaggtagaaataaaactgccattattatagatggtttacataccttttccctctgaaaactacaaacaaattattagaaataatgtgaaaatttagcaaaggagctggatataagattaacatacaaaagtcaatcacatttctagagtgactaacaataacaaaggaagctgccattgacaataatattattttgtactaatagtaataaatgtaacaaagtatgtgcaagacctaaaaaaggaaaaatttttaaatgaagaaaaactaacaaagaatgaaataaacatatactttattcattgattggaagatttaacattgtgaagatttcagttcttttcaagttgatttgtaaattcagtgcatgttcaataaaaatcctcgtaagatttcaagggctcagtggctcatgcctgtaatgccagcactttgggaggccaaggtaggaggatctcttgaggcaaagagttcaagaccaataagattttcatgtaatttgataagattatatgatatttatgtagaagagtaagtggttgaaaacagcagggcattttaagaagaaaagcagggaagaataatttgccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtgtgtgtgtgtgtgtgtgtgtgtataaatgatagctaaatggcttctaagtaaaattcagcatatcttgtatatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaattatgtgaaaaatcttgaactaattagataatctttagaagttacttcacaatctttgtttttacacatacacaggaatttatggtgctttattttttacaggttagtagctaaataaagtatattctaaagttttttattgatgtagggaaatggctaccagtggacattttgagaatattgcagttgtttttcttctgaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactctgttacccaggctggagtgcagtggcctgatcatggctcactgcagcctcagtctcccaggctcaagagattcttctacctcagcctcctgagtagctgggactacaggtgcatgcccccatgcccagctaatttttgtattttttgtagagaccaggttttgtcatgttgcccaagctggccttgaattcctgagctccagtgatcctcttgtcttagcctcccaaagtgctggaattacatgtgtgagccaccactcccagccccagaacaactattattaaaaagtcaaaaaacgacagatgttggtaggctgtgtagaaaaggaaatgctcatacactgttggtgcgaatgtaaattagttcagccgctgttgaaaacagtttggggttttctcaaagaagttaaaactgaactatgatttgacccagcaatcccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacgcagccataaaaaggaatgaaatcaggatggtgcagtggctcatgcctgtaattcccacactttgacaggctgaggcaggcagattgcttgagtccaggagtttgagaccagcctgagcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaatagagtgacaccttgtctcaaaaaaaataaataaataaataaataaattgcagcaacacagatgcagttggaggcaattatcctaagtgaattgagggaggaacaggaaaccaaataacatgtattctcacttataagtgggagctaaacactggctactcatggacatagaggtggcaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgttctttcatctttatagtgaggtgttacatgttttacaaacctagttctgataatgtgacaggaatataaatttatcttgaatattattaaatatataagtcaaagatcaacacaatgtttccatgaggtagactttttttggaatctaaataaccatgtgtttccatgtaaatttttatgaatcagggacaaatatataatttgatgttagagatgtttttgttccccaaaagctctatcttgttcatgaaaaacgaagcccagagaagttatgtacaagttcacagagcttattattgacaaaaccagaatttgaatacaactcttctgattccagatttgctggaaatactgtgaaagaagaactcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaaacacaaatcagtttatggagtctgctttctaaaaagtacttaagtgtttattgccaatatcttattttggtcagcaatcaatcacgtactcaagcatacttgtcttaccttcagagaaattaaaatttaatcagcaaaactcatcagcctgtacatttaaaatatatgcatgttattgtacagaaactataccttaataaaaagtgagaaaaaaaatgagacaggaaagagaaaaacatttaaaggacatagtaactgaagaattaaataaccaatccaacacttgaaaaatattacaatgtagcacgtgctcaaaagctctctgagctcagggaacaaagcagcactgtgaatctatagtggtaatcattctatgtggtattgggtaggacaagacagccttgcagctggaaattggtgaggacggaggcctcgctgtggaaagagtaaggcacactcagggagagaaccagtgaggtggctctgagcctgtttcagaaggggcttgaggaagaacggcagaggataggatagttgggaaagcaggatcaaatcagactccagggactggggaaccaattggctgttacagggtggtggagtcaaaaaagaacagaaattttctgtttggttaattgatagaaaatgatattattaacaaagtaaagaagtatgggaacagcacaagttttttggggatagtaaataattccatttccattgattaaaaatatcaagtttgtttttacatctaaactgattcaagacttagctattgtacatgttttagagaaagcaaaactatattttatatctaatcatactttacaacataaaatacagttctaaaaaatattatttgtgaagaaaaatataatgttgccatcttttgtctgtctgtatgttttttttcccttagattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacaggtaaatattttgactgcctccttaattttagattatgaaaaaattaagatacaagaccatcttagtgtaccatttggttatcactatatatgtatcatcagctattaaagtatggtatcacgtgtgatagagtaatgccaactaaggtactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaagtcttaaatttattcccaggtatactactttacccttttagtgaagatcttacctccttcaaataatgttctttaaacatttaattctggagaagcttctacaattttttttcagccagagtactctgataaatgctatggttataaggcagatgtcaagggagttaccttaactctttcaagtcacaattaatgttcaataaattactgtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctattgtgagatcctttagttgtaacaaagacagtttcatttgtggcttatgagttatttttccctgctaaattaatttagagattgattcagtatattattattttttacctgaaagagttaatgtctctccaaacttctgccttccaaatagttatttgtagataggagctatcacattgtctctcttaatcattaatagctatgactaggatttgagataagtctaactttggacttttatgttaagatcaaacagggacagatgtttgtttggttgagcaagctgacaaacatgtatcagtgatagactaactatgatcattgaccaccatagcctggctgagaacatgagtctagtgcatgctacacaagaatgtaggtcacaggtatagtggagccgtaacaaagcagattgctccatgtttaatgtgaatattcttttaaaattaatagttttttggttaatagaagagaaattacagttgtctctaggtgattctatggtgtttaggttagtattgaaaacatatgaatccaggaattaagatgttgttgttctttgtacattcattcatccagccccccttatttataaccatcattttaaagttttaacatctacttcaatacctcacatcagtctttttaagataaaaatcccaattttgaaggattacttaagtaattctattttcctgattttacttttcttttcaagagaccaaccccatttccaaattcccagcaaagagaatctgattgcccagagtaaatttgattcaaaaaactgtgatcaggaagacaaggtcacacaatacaaatatgagagcttgagcttatttcagtggatgggaaaacagttaagggagtcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagttcaagttctcatcttaaaaaaaataaaaaataaaaaaaaattggattgtaaaacttcacgtatagaaaatatgttatcatataataaatatttttatgtttatataagttaatacataaaaattttcaagaaaaccctttatatataatagtatctcattttaataaaaatgtatctataagtacatatgtgcatttgaaaacctggaaatatgcatgtatagcaaaatgctagcagtggttatttctgtatggtagtattatatgtgctttaattttttctttatacctttagtttgaatttcatatgtgtgtgagcatctgcatttacttttaaaaacttctattataaaagccttcaagcatatataaaagcagagagaatactaagcataaggcactttttttttttttttttgagacagagtttcattcttgtcacccaggctggaatgtagtggcatgatctctgctcactgcaacctcctcaagttattctcctgcctcagcctcccaagtaagtggaattacaggcatgtgccgtcatgcccagcttatttttgtatttttagtagagacgaggtttcaccatgttggccaggctggtctcgaactcctgatctcaggtgattcacccgcctcagcctcccaaagtgctgggattataggcatgagccagccaccgcacccggccagcataatgaacttaggtacctattagccagcttattaaaacatggtcagtcttgtttcacctgttacctcccttgtctttactgtttaaatatttcacaataaatatattttattttataattaaaaataaaattaaaaccttatgctttttaaaataaaagaatagttaatgtttggaaaatctagctaacaatgtgagaaaaaatagaattaaatttatactttatgtttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaaccaaaaaaaaacagaaaaaaaattacattgtcagaaaataatgcagtaagcaaaagacacatatctatagagataaatggggaaaggatatgagtaggcaagtccccaaagaagaaataaaaatggccaataaatatatggaaaaattgttcttacaagtaattgaaaacacacaaagtaatgatgatagatgatttttcttttaagaaattgatagagaagatatgggaaaacagctactgtcatcagctattggaaatgcaaactggcagaacctttcttgaggataactgacaattaatatgaacaaattgggggtacttttagcccaataattttagctataggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgctctgtctttacagatttactgagatgtttgatgattttccaccaaaaaaaaaaaaaaaaaatctctagtgaaagaaactaaggagatgagcaggtgtagtaaattagatttatggcctgaagtgagaaactaaaaagacagctgatgttatcagaaaaattagtgctaagaaaccctcttttgttttattatagttttgaagttgaatttactaatacagaatatgataatacagataagttgaatttactaatagagaatataacagtaataaggtctgtgttattgtggctttaagtattagaattgtggccggcgtggtggctcccgcctgtaatcccagcactttgggaaaccgaggcgggcggatcatgaggtcaggagatcgagaccatcctggctaacacggtgaaaccccgtctctactaaaaatgcaaaaaaatttagccgggcgtggtggcgggcgcctgtagtcccagctactccggaggctgaggcaggagaatggctagaacctgggacgtggagcttgcagtgagccgagattgcgccactgcgctccagcctgggcaacagagcgagactccatctcaaaaaaaaaaaaaaaaaaaaattgttactgagagttaaaaataagtacaattgtgtctaaatgctttttgttctagaaaagttaactaaaataactattgaaatatgagtgaaatattagacttgggttcatttcagtgtcctttctttaacaaaacaaaacacaactttgcctatagatagatacatgagaattttctttacagaaagcagttggttattataaatgatgaccgttcaggagggcaaggaatctttagaaaatattttattaaaattatctctggtggcccggcacggaggcttatgcctgtaatcccagcactgtgggaggccgaggtgggcggatcatgaggtcaggagttcaagaccagcctgaccaacatggtgaaaccctgtctctactaaaaatacaaaaattagccgggagtggtggcacgcacctgtaatcccagctactcaggaggccgaggcaggagaatcacttgaacctgggaggtggaggtttcagtgagccgagatcacatcactgctctccagcctgggcaacagagtgagactctgtcttggaaaataataataataataataataatctctagcatgcttctgttgtcttaatgcatcattcatattttgtctctgtttacccaaattctttagtgataaaagattagattcaactgacttaatcagatcaatctatttaatctgatactaagcctagatttttttcctttttggtgacttttgtttttactgttttttttaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatctttatatacataaattctgctatttttatttcttttgaaacagggtcttgctctgttgctcaggctggaatacagtggtgtgaacacagctcactgcagtctccacctcccaggtttaagtgattctccccgttcagcctttcgcgtagctcaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataattctatataaaagtgaaatataaatctttgcaaatatctgaactagattccagtagttttaggaactatgtgccaggaaccagggacaaagagcaaatacctattttttattatatgacaagtgggagcagaaattcagttccttactttatcttggccaaatgccagattaaaatgttactagttgggttaattcacatatatgtataaatatgttttccaatatatgattgaaggttagcattgttatatcataaaactatgctaaggagaatacaggcagaaaacaaagacaatacctctcaaaaaacccaacttttaattgaatacagagatttcattctcaaagaagagctccttattcctagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctacattactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccatgctgatgatgaaagattctgaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctctttcattctctttatgttcagctatgagggctgaattcatagtttctgtcatagtgtatgtgtttttaagacaaaaatggggagagaatatgaaaacacaaggaacttttccctaacctattttatagttaaacaaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagccggagtgacccccttgaaagcaaagtccacattcagcatgaccttttaattcttttcaagagttgtgtaaatttacaaaatgataggattatgtgaacattcttttaaaattattgaattattaagaattttttaggctgggcagggtggctcatgcctataattccagcactttgggaggccgaggtgggtggatcatttgaggtcaggagtttgagaccagcctggccaacgtggtgaaaccctgcctctactaaaaatacaaaaatcagccaggcatgatgtcgggtgcctgtagtcccagctacttgggaggctgaggcaggaaaattgcttgaacgcaggaggcagaggttgcagtgagccgagattgcaccactgcactgcagactgggtaacagagcaatactctgtctcaaaaaaaaaaaaaaaaaaaaaaaaaaagactttttgagtggagggaggagagcaagggtttaaaaactaactgttgggtactctgcctactacaggagactctacttgggtgatgatatgcccatgtaacaaacctgcacatctaccctctgaatctgaaataaaaatcgaaatttttttttttacataattttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaaaaaaaaataataataattttgtagtgatttgacatgtctttggaaagatgtggtattgaatcttctacagtttgttacatattcgatcgctacacactcctgctaactcatgtagggatatgtgacacaattggaagagatgatgaaaccatctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaggaaaactcatagacctcaccagtacacagtaagacgaaagtaaattaggaaaaaataatgtctgggagatagtagatattcagtatttgtttactggtgaatggatgagccattagcagtgaattatgaatatgcttgaggtttcttgtgagtcacctgagaaacgattaataaatgagaactttttataacccacacccagagtatatagatgataatggtgagcggaaagttggaaaaaagtttaaaagagaacaggctattgatatttttaggtagagagaagaagaaaagttcacctcctatttggcttttttttttttttgagacggagtcttgctctttcgcccaggccggagtgcagtggtgcgatctcggctcactataagctctgcctcccgggttcaagccattctcctgcctcagcctcccgagtagctaggactacaggcgccagccaccgcgcctggctaattttttgtatttttagtagagacagggtttcaccatgttagccaggatggtctcgatctcctgacctcgtgatctgcccgcgtcggcctcccaaagtgctgggattacaggcgtgagccactgcgcccggcccctatttggcttttcactatgatcagtttaagagaagacagggcaaggagagaggacatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacatccctgcccttagattctaggaaaatagtaaagaagacgaagaacaagacctcagtgtatccttttactacaagtgactgtaaatcaactataaaattagccatgtttgtaaattaaagttataattttggcccaataatttataatatatctgtttgttgtttgtaggagtggttctgattaaagcccagatttcagagctggcatttcctattacagcatctcagaagatagcgctaaatgctcacagttctctgaagagtattttttcttctcttcccaacatcgtatatactggttgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaattagtctgtaaacccttactttctaaaaataattaactagagctagtcgaagagaataaaattttccgagtgatagatagctatttatggaagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatagaatttaagggctaaaagtatcatatgatctcacctctgagttgttgtggaagctagtaagacatttaaggtgttttcccacctttaccttagaaattaaagctagcaaataaatgttgtatggtaaaactgctaatcagctcagtgaaaaacacattgttttttgaataataggtagtcaaaagctcagatatttttctctttacctcataaattacatgtgtttacaaaatagcactcagtgttttatgctccttatgattatttctaaatattgcggtatctaaaaaccaaattcagatatattccacatgttatcatggcatacttcaagaaaagttatagaagcttaatttgtaaaccttatttctctttacagatattatgtttgttataaataagtgaataaattttgctattactgtgaaagttgcttttgtggaaaagaagattgaattaagatgtatggtaggctgggtgtggtggctcacgcatgtaatcccagcactttgggaggccggggtggggggatcgcttgagcccaggggttcaagaccagcctgggaaacatagggaaaccccatctctaccaaaaaaaaaaaaaaaaaaaaagctgggcaggtgacataggcctgtagtcccagctacttgggaggctgaggcaggaggattgtttgagcccaggagatcgattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatgtcattccaaatgtttctattcaatataagcatttattggacaaaaatgttgctcaatactattccttatggggaggagggcctttgaatctttagtttacaaaatgactgttcaagagaaggacttcacagatcagtatcacctgattatggcataactagtatgaggtatttaagatctcttcctaaactataccacattaaagatgtagtgctagtttgttgtcttactagaatgttgaatggtcatgttaaggcaagaattattattttttatttatttacaagccttttttttttattttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagtgcagcctaaaagcctttaaattgttattagagtccagattatatggtttccttgaaaagaaaatattgaaattaacaaactcccttcaagttatcaagtatgtgactccaaaatcatctacataaatcaatcagcaaactgaataagagaaaactctcattgattatttttctaagactcagtcaaatatttattaggaatccacgtatgttcacatatcacatatgtactgtggatgttatactagttgacctaagtagacttattgtgcccaagaagcttggtagtccatttaagaaacacttaatgaacatttgtgtggcataacagtcccagactatgagtgggttgatcatattttacattggttgtaacttggagctgattttccaatggaagcaacattagatattgcattggagtctcatacgaggccacagacatttattaaattaacatgtagatagcatagttcctgttcttcaagctatcataaaactcaaataccatttttaacaatgtttctacagaatattcagatttacatttttggaatacaagaaatacatttatttttctgtactagaagcaaaaaaccccagcaggtcaaaccacaattaaggctcctatttaggcagcactaggaaatgtttgggtctctcaagaggttatagtcaaggtgtaggctggggctgcagtcatctgaaggcttgactggggctggaggattcatttccaaagtggctcattcgtatggctggcaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctaccaaattctgttcatcagaagtgagttagctgtgcgttggagagtggattagaatgaagctagtgcagagaagcggtaagaggctgttgccttattttggaggggagatgatggtggcttgactagagaggaagtggtaggaataaaaagaagtggacagatttgagaatggtcggaaaatagtttgcaagatgtagtgattggtaggtaaagagagagcacaggtacattgcaaatcattgacagttgggtgaacaataagattatttattaaaacaagtaaccttgggagaaatgttgatcatattgagcttgagttcctgagaggtaacaagttggaaagtggttagatgtaaagaaatgcaatttgcaagagaagtctgggctaggcttataaggttatttgtggtaattgaacttttgcttggtttctgcaccctgttttgtttttccttcttaatcttcagtgattacctctcataatggattattctcactagcctataaagacactcccatatttcttttattaaaaaacaaacaaaatcatccattaacattacatctccctcttgtcccttcgtttttctattctgttttatacccagccaaactttgttaaagagttttaaatatactctctctcccctattatgtcttcagtttcacttcagttattccattctactcctaccatgctgcagaagctgcttttgtcaaagttacacttttgatgttgcctgaggcatggatacttctttcctcactctaactgctctcagttatattcagcatgtcagtccacttcctccttcttgaaacagcctcctccttgctttctaacctgtctctcaggcccttctttctcagcctcttctaccccctctttaaatgctggggttaatcttgagctctcgtctgcgtccttcctcttattctttctgtacattctgcctggatgatcacagctgttttcgtatttgtacttaacatcttcaccctgattttctcctccaggctccagtagtcaggtatcaaattctttgcttgacgtccatctcacatttaaacatacccacaatagactcttgtttttcctaaccacactcaaatctagttctcttcatttttatactttctggaaaatggcacaccatctacccaattatttaggctggaaacctgggcacaatcgtcgcatcattttctcttccctacctcccctatctaatctattagcaagtcctaggaattttcattcagaactatatcacaaattcatccacttttttccatctccactgctaacatcttagtccagtgtatctcagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctacgacctgttgcgcaaaccagcacaccagcagtctcttggtggggctcctcctggccttgcctcctcccctttattctctacccattggcagtgtgattaccctttgcctttgcttcacccatcagtcgtctccttatgcttgtttcctctgcagtctcatctgctgccactcccctgtcgtccagcactctagccacgtggccttctttcagttcttcattttgatttttctccttaggatgttctcgaatgtcttccttctgtctgactccacaaggctggtttcttcatgtcttagattaaatgctgctttatcagagaggcctttcctaaccactcttctttattttctgttatagtagcctgggtgtgcttactgtaatttgtagttgcatactgtcttttctagaaaacatttttactgaagttaaaattcatataccatcaaattaatcttctgaaatgtacaattcaatggctgtagtatattcccagggctgtgtagctatcaccacaaccagttaggacattttcgtcacccagccctttacaaagcctcatactcattagcagtcactctccattccccatgcccctcaacctatggcaactacgaatctgctttcggtctctatagatttgcctgttctagatattttatataaatattatataatatgtgatcttttgtgactggcttcacttagcatgatgttttcaaggtccatccatgttgtagcatgtatcactacttcctttttattgcaaaataatattgtattgtatgcatataccacattttatttatccattcatcagttgatggacaattgggttgtttctactctttggctattatgaatgatgctgctgtgaacatttgtgtacaagtttttgtgtggatatgtgtgttcatttctcttgggtatatatttaggagtggtggaattgctgggtcatatggtaactgtctgtttaaccttttgaggactaccaggctgttttccaaaattgctgcacaattttacattctcatcagcaatatgagggttgtaatttccccatattcttgccagtacttcttattctgtatttctttttgttgcatgtgctttcgggtcgtatctaagaaaggtgtcatttctaagccaaggttatggagatttgctcccgtattttcttctaagagtttagtagttttacctcctacatttaggtttattatctactttgagttaagttttgtatgtgggataaggaaggggtgtaattttattttttggcatgtggatatctagttgtcccagcgtgaatttttgaaaagactgttccatccctgtttagtcatcttggcaccactgttgaaaagcttattttctttcttcttctttttgtagagatgaggtctcattgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttatatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgtcacattaaattcccccgctaatgagcctgtttctgaattctgttctcaatttattttttaaaaatcaatgtagttataaaataggtaccacatgccatgattaaaatgcacactacataggaggttacaaaacaaagagtgaaagtctccttcaccatccaaccctctctcaccagtgctgcttccattgctggtgagaaggttttttgtatgtccttccagtgatttattatgttcatcccagcacatgtgtatccctttctttagaagcatgtggacagaagaatattgttcatgttgttgttccctagagtctatcctggtgctccttccctaatagcacttgcaaatgttcttcattctttttatcagctacatagcattaagatgtaggatgcactgaaaattgttaatccagttccctgtttattgatatgcaaaacagtttatttctgataggaaagaattcagttgaaaaaagtaacttgaaattgtgattgtgaaatatgtgattattatttttattttcatttctaaaaataatttataaaacagtttaatatatttttatattagtatctgaaatttaaaaatggatatagaataaataaaatgtagtaatttatcatttgaagctcttggggaaaaaaaaaaacctttttttccttctaggatgtcacagaacatcctagagttgttttaggcattcaaattaatcctgcataaaaaccaagtgctttttggaattatttttcatttaagcatttcttttatctgaaaatctttttgaaggtcgtgtgttgtttactcttttgtaggccagcgttaatgactgccattgatggaagacatgatgtttgtatccgtgtagaatcaaagctgatagagaagattcttctcaacatttctgcagactgcctcaacagagtgataggtaatatatcagtgtgccatcaagaagttgttttattcaggagtataaatggtatatcggaacagaaagagcactgtactttaaattaagagcttttctgtccatatgaaaaccgaaggataatttagcttaagtgaaatataagcctatgtaagttagaaggttgacttgctttacacctgttagtacatgaacagcgggaggcacctaatttcttcttaacctacatttcctgttggtaagcaaaaactattttacttaactctagttttataagagtgaagtcaatgagtgtgtgacataatatatatgaagatagtccactgtcagtggaatggatttgcaagatcttcaaccgtgatgtcttagttgtcagtggctaagaataaagcaaagataatatatttgtcaggtattcaaactccattcctgttctcattagcctcagatcctctaagctgatgagctaatctggttccgtgattgctttatctttcaatagtagattgtttttcgtgtatttttttagttgggggtgtctagtaattttgggttgaatgctgaacattgcatatattaagtagaacagtacaaactgaggtaaatagtatttgtacctggaaacaggcatgcctctcggtcctttactggaggtgaggggtgagcaggatggtcagtcttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccacgttcttgcacctccccaagttgcacaagcttttgttggttgttatttggtgcatcctaacctggtgggcgggagcagggttgttcctctttgattctggtccagccccagtcttatacaggatgttgaatatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggggttttttttcttttttctttcccccatctgtactggttcctcacctgtaccctggggcaacaggatttggtgtccctcctccagcagttgaaggcttttgttccttaaaggggaggccagatggtgctttgtgttttgtagttggaagctttctctgatgtcttgccctgcccccagtcttatgagcacctggtggaggtgagactactatgtggaagagcctgtgaggatgcagatgttccttatgttgctgacactggcagttcattggctttttgcaattaatttattaataaaaattaatcacattcttctttcctgcctgtatggaggacctgtcttcttcccaaggcctgccccaagggaaactgtgctcctgttccatctccctggaggcacctgtctccttatgtttcagtctttttggctgttttacaaccttggttctcatgtgtattcaagaaaatgatgatttgatatttattcaattttttccagtaactgttagggtaggagccactttttccagctttctacatcttaattagaagcctctctccgtttttttcccccattttctttatttcatttttattcttttggctattttcattccttttcttaatgttacttatatattttcagtgtaatctcttcttttttttttttttttgagatggagttttgctcttgttgcctagactggagtgctgtggtgcgatctcagttcaccataacctctgcctcctggattcaagcaagtctcctgcctcagtttcgcaagtagctgggattacaggcatgcgccaccatgcccggctaattttgtatttttagtagatatggggtttctctatgttagttaggctggtcttgaactcccaacctcaggtgatctgcctgccttggtctcccaaagtgctgggattacaggcgtgagccaccgtgtccggcctatctcttcttttttgcataatgtaaattagtctttatctcttagagaagcatcattctcatatcacatatacttcagtgttttgtccattcttgagacaattaaagttgtactacttggcattaattagattgtgatcataagtcaaaatgtcattggttataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacggtctgagcatggttgatggtgctctgtcattctggtattgaacaacctgccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcacttttctgatgtactgcagcataaccagaactgctgtcggtctgaacggtgtgttatctgggcctgtttcttgtgtcagggggatcacatgccgtcactctggagtgcctcaatagcttgtaactagaaagagaaggtatagaaagagtagtttacttacctgtttatttatttagagacagagtcttgctctgttgcccaggctggagtgcagtggcacaatctcagctcattgcaatctctacctcctgggttcaagcaaatctcctgcctcagcttcccgagtagctgggattacaggcatgtgccaccactcccggctaatttttgtatttttagtagagacagggttttactgtgttggccaggcatgtctcgcactcctgacctcaagtaatccggctgcctccgtctcccagagtgctgggattacaggtgtgagccaccgctactggacgggaggagaaatttaaaatgggtttgagacttgaggaaccaaaagaaacaatgaaaccattcaatgtgtgtgctcctgtcaagctagcagcgatcttgggagctctgtgtttttgtcttttgcagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttactttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtgcttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaa

SEQ ID NO: 577 - DNA, 103893 bp, Homo sapiens
cttccaaaacaaaagttctttattaattcttcaagaaatctgttttttacttagtcgattaatgtccatctcatgttgcctcaatagcccatgtatgaatcactcttcttgcagattttgttcagttttgttgtatgtagacccatctttctttgagttggtttctttgattgagttgatttgtctgtattaaaacccaaacaatacctaagccaaaaaagcaatgtaggcacctgtgaactcacacacttggttgcaattgcttcagtaaaaaggacagtttacactcaaattgaagcaaccattatgtttccacaaacaacattccttattatcccacctcaccttttcattcttcctatgctgtctaatctgattctgtacaagagataaggcaggtactgctaaatgataacttagatgcaggggccatcatgaaaatattcatcccatatcttacattaagcaaactactagcaactgtttgttaaaaagtataaatgaataaatgaaaataggacagataggcagtgtgggaagctaaaatatggaagtgttattgctttgctttatgtggtataatgatctgattttatcttcccagctctcccaggaagtatgcagaataatatttatctcatattgtgggtgtggcaatcaagacagagaggctagatgctttacctaaagtcatccaacaaatatttggtagaaccagtgctagaatgcaataaatggaaacagagtttatttcggtgtttcttttcctgatacttgccctattcctgacaaatgaataatggcttcagaaggtgtcacttgttgctagggctaaaaggataaattttacctgtaataccgtaccacttactattagttaacgacccagtatttattctctttttttctttggaatctttggaatgtgtaaatatttgcctcccgggaagctcactttatcctctcctcaggaaaaaatcctgatttggtctgaaccaatcttggtaactatctttcttgccagttttgttttaggaatgggcacgcaactcagttctagccaacgagatatgaggagcagtctactggggagtttctgggaaagtttgtttttcttgtcctaataaacaaacaaataatggggtcactggattggagatcctattgagtcaaaggaatattgaatttgacacagtagaatagtctggaaggaaaggaaatgatattcagtaaatgaaatgctgaaaattgatattatgaaggtggcgcagtagttgttattgattaaatgaaacagttgagattaagaaagtttagccaggacaagttatatagcacaaatcatttcaggtaaggaagttaaaaaaaaaccctgagaggctaggaagtcctggctccaaactcctgctcctgctggacttgagccccactagcttctcatcttccactaatctatgcacccctcctttcccactcctcaaaagccgagctcactcaacaactttaattttattcaaataaattatttacacagacattttgtttttagtagatgttattagtgattaggaaaaatgaaagagattgacatctttcaattgacagagatgccaataattttaagtataattttttaaacactttgttcttaaaatgagaaagaaatgtaaggaagggatcactagcctgggcgttagcatgtccgaatatgataactaaacctgctgcaattatcttgcaaccagggaggagctagcttgaaaataaagccaacacagatgacaagcagaaagtggaaagaacctaagtcgttgatgatgctattgagctgatgaattaaacctggagtgtatgttccatgggcttctgtaaggaattaaaatatttttactgtttaaaccagtgtttcattgttttctgcagaaatcctaattggcataaagaaactattgaccgactaaccccactgcaacctcacctgaccccttaggatgtcctttcatgattttcttgattttgttgaagttacgtattgagaataatggaaaatcacagaaggtgattttctgatcccaactccttagctatgaccttgtgtctctagctcatgatcatggtttatgaagcacgggaaggactgggaaaagtagaaagtaggtaggtaagatgagatgtctgatgatggaggttattggggtcaggacaggtggataggcaagttgaagtgtgtaagctaagcaggaaatgcaaatgaaaatcagagagaaggtaccccttcagaacagattcttagaaagccattattagaaacatatgggccacatctttgagaaaagttgtggaattcacattacagtaatggcatcacttagattcatgctcttctctcagggagagaaatcaatatttataggatatcaaagggtcttcatcatgtgtctcagtctgtttttattgctataaacaaatacctgaggctgggtaatatataaggaaaagaggtttatttggctcacacaattctgcaggctgtacgagaagcatggcaccagcatctgcttctgttgagggcctcaggaagcctccatcgtggtggaaggcaaaggggaacccgtgtgtcacatgatcagggaggaagagagcaagagaggggaggaaggtatcagattctttttaacaataagatctcacaggaagtaggagtgagaacataatcccatgaagacagcaccaagccattcatgagggatctgcccccgtaaccaaaacacctcccagtgcgccccacctccaacattggggatcaaatgtcagcatgagatttggaggagacaaacattcaaactttatcattgtgcttgttttcttcagaaatagaccgaattgatatgtttcatgatgacattatgatctaaaaatgagagtttatttcagtttgtcctgtatacacccaagaggtccaggatattattctgtctgtctaccacaagtcctgcaaactagaagatggccttaacagtcaatctagggtggttctgcccaatgaccttttgtctttcctcagtgtcttccaaagcacatagtaatattctatcatgaattatatgaaagctgtttacatggattaaacagtaaatctgacaaacaggctgctttttgatgactctagacatatttcttcttacattttagacatttgagaaaaaaagtcaaatttcttaatactttatgttcaattgagtttgaagccataaagaggaaggaaataataaggattagagcaaaaataaatgaaatagagaatagaaaaacaatagaatcaatgaaacaaaaaattagttctttgaagagatcaacaaagttgacaaagctttaactagattaaggaaaaagaatactcaactactaaaatcagaaatgaaagacactactactgatttataggaataaaaaggattgtaagagaattcgtataagagctatatgtcaaaaaattggataacctagatgaaacagacaaattcctagaaacatacaaaccaacaaagttgactcaagaacaaagaataaatctgaatagatctataaaaagtaatgatattcaattctgattgaatcagcaaccaaaactctcctaacaaagaaaagcccaggaactgatgacttcgctggtgaattctaccaaacgtttagaaatgaattaacactaatccttctcgaactcctccaaaaagttgagaaacagaaccctttctgagtcattctatgaagccaacattaccctgataccaaagctagacagacaatacaagaaaactatagccaaatgtcccctatgaatgcattatagatacaaaaatccccaacaaaatactaggaaattaaattcagcagcccttaaaagaattttacactatgaccaactgagatttatcccagaaatttaagagtggtttaacgtatgaaaatcagtcgatgtaatacaccaagtaatagaatgaaggagtgaaaaactcatgatcatctcaattgatatagaagaacatttgagaaaatccattcctcctttatgatagaactgttcaacaaaccaggaatagaaaggaactgtctcaacatgataaagaccatgtattaaaaactcacgactgacatcattctcaatggggaaaaatttcaagcttttccactaaaatcagaagccatggatgcctgtgtttgccacttctattcaacatagtattggcagttctagccagacccatcaggcaagaaaaagaaataaaataaatccaaattagaaaggaagaagtaaaactatctctatttgcaagtgatataagtgtagaaagccctaaagaataccaaaaatagcctcttaaagctaataaacaaatttagcaaggctgcagaatacaaaatcaacacacaaaaatcagtcgtgtttctacacactagcagtacaaaatctgaaaaggaaattaagaattttttatttacagtagtacccaaaagaataaaatatttagaaatcaatttaaccaggaaggcagaagacttgtacactgaaaactacaaagcattctggaaagaaattaaagtagacttaaataaatggaaagagatcctgtgttcataagttggaagacttaatattgttaaaatgacaacgctactcaaaatgatatgtagagtcaatgtaatcacgctaataaaatcccaacagcgcttttggcagaaatggaaaaacctattctaaaattcatataaaatttcaaggaacccaaaatagccaaaataatctgaagaggaacaaagttgtaggactcacattttctgatattaaaatttactacatagctataataattgaaatagcatggacttggcacagaggtagacaatatagaccaatggaatagaatcgagaggccagaactaacactcacatctatgggtaattaattttcagcaagggttccaggatcactcaatggggaaaaggacaatctcttcaacaaatggtgttggggaaactagatatccacaagcaaaagaatgaagttggacctatacttttacacaatgtacaaacattaactgaaaatggatcaaagaccaaaatttaatgctataaaacacttaaatattaaatgctataaaactcttagaggaaaacatactgaaaaatcttcatgaccttgggtttgacaacggtttcttaaatataacatcaaaagtacaagtgatgaaacaactgataaattggacttcatcaaaattgtgtatcaagtgacactataaagaaagtgaaaagataacacaaaaaattggagaaaatgtttgcaaatcatacatctgacaaaaaactaatatactcaggcatttctttatggcaatgcaagaatggcctaatacaatacccaaaagaattgaatgcataaagaatcctacaactcaacaaataaaagataaataactcaattttttaatggacaaaatacttagacacttctctaaaaaaaagacatgtaaatggtcaataagcaactcaaaagatgctaaaaccacaatgagataccactttgtacctactagaatggctataattagaagaaaaaataactagtgttgttgaacatgtggagaaattggaaacctagtatactgctggtgggaatgtaaatggtttaactgctgaggaagatagtttggcaattcctcaaaacgtaaaacagaattatcacccagtaattctactcttaagtatataccggatatagtttgactgtttgttcctatgcaaatctcatgttgaaatgtaattaatctccggtgttagagttggggcctggtgggaggtgattggatcatgggagtggtttctcatgagtggcttcaccatctctagctgtcatcaagattgtgagttctcacaagatttgattgtttaaaagtgtgcagcacctccccacttcctctcttgctctggcttttgccacgtgacatacctgcacccactttgccttccatcatgattggaagcttcctgaagcctccctggaagcagatgctgctatgcttcctgtacagactgcagaaatgtgagccaactaaacccttttttctttggcacttacccagtctcaggtatttctttatatcaatgcaagaatggcctaatacaatacccaaaagaattgaaaacaacaacttaaacagtgacttgtacactaatgttcatagcagcattattcacaatagacaaaaggtagaaacaaccaaaatgtctatcaaaagataaacggataggccaggcacgatggctcacgcctgtaatcccagtactttgtgaggccaaggtgggcggatcacctgagttcaggagttcgagactagcttggccaacatggtaaaaccctgtctttaaaaaacaaacaaacaaaaagataaatggataaacaagatgcagtatatacatacaattattattcagccatagaaaagaagaatggaatactgatacatgctataagatggatgaaccttgaaaacattatgctaagttaaataagctagacacaaaaggatagtgtatgataccattatgtgaaatatttacaataggcaaattcatagagacaggaggtagattagaggttaccagaggttaccaggggctggaaggagaggaaaatgggagtttttgctgaataagcacagtttctatttggggtgatgaaagggctttggtaatagatggtggtaacggttgcacaacattgtaaatataattaataccaccaaattgtacagttaaaaatgattaaaatggcaaattgcatatgtctttctccgtttgtgttgctataaaggaatacccaaggctgggtaatttataaagaaaagaggtgtatttagcttatgattctgcagattgtacaagaagcatggcactggcatccacatctggtgagggcctcaggctgcttccgctcatgtcagaaagggaaggcaagccaatgtgtgtggagatcacatggtgagagaggaaacaagaaagaggggggtagtgctaggctcttttaacaactagctcttggccaggtgaggtggctcatgcttgtaatctcaacaccttgggaggctgaggtgggagaatctcttcagcccaagagttcaagaccagcctaaaaaaaaaaaaaaatcccataaaacctagctctcacaggaactaagagaccaaaaactcactcacctgcaacccagggagaatattaatctattcatgagggatctgccccatgagccaaataccttccattaggccccacctccaacactgggtatccaatttcaacatcagatttggagggtcaaatacctgggctacatacccttgtctctagaaaaaatatataaaatttagctgggtgtggtgacacatacctgtagtctcagctactttggaggctgaggcaggcggatcatttcggcccagaatttcgaggctacagtgagctataatcaggccactgtacaacagcctgcaagacagaatgagaccctgtctttaaaaaaataaaaataaaaataaattaattacttttaaaaagaccttgtattgcaagttggtaaacataagtacatttgttgggactatgaaattattcacccacaggatcaatgttacaaattggtatttgcatctcaatttagtttgttcaacccagaattcacatttgccataaaactgtagtcaataattcaattaaactactgataaccaaaggggaaagcaacatattgaatcaaaaatagttttatcaactggtgtcaccaaagaaaagcaggtttcactagtgttgagaaaatagaaagttttctattgattatggagaaatttcagttcagtttctagaaggttaaatgccccaattttttttttaatgactgggttaaactaaataatggcctccattatttccatatgcaaatcctcagaacctatcactgttacgttatatggcaaaagagaatttgcaaatgtgattaagtcaaggatcttgaaattgggagattatcctgggttatctgatgtccccaatgtaatcacaaggatctttataaaaaaggaaatgtgagacaaagggagagaaggtgatgtgatgaagtagaggtcagagtgatgcgggggctagatccaaggaatgtgggcagcctctagaagctgagacagacagggaaatggattctcctcctagagcctccagaaggaaagcagccttgccaacccatttgaaacttctgatctccagatctatacaacaatacatctgtgttgtttttttttatttttatttttttagggacaggtcttgctctgttgctcaggctagagtgcagtggcatggtctgggctcactacagcctcaacctcccaggctcaaatgatcctcctgcctcagcctcctgagtaggtggagctacagacatgtgccaccacacctggctaattttattttttattttttgtagagatggggtctcactatgttgcccaccctggtctccaactcctgggctcaagcaatcctcctgcctcagcctcccaaagtgctgggcttataagtgtgagagtcacagttcctggcccatctgtgttattttaatgtttaagtttgtcataatctgttacagcagcaataaaaaactaacaaaatgactaattttacttccaaacccattgtctccctcccttaaaataattttatcacaatagctatttttatattacagtcacacaccacataatgaccttttggtcaatgacaaacttcatatacagtggtagttccttaagattacagtggagctgaaaaatttttattgcccagatatgtcagagctgatcattgtacaacacattacttacatatttgtgatgatgctggtgtaaacgaacctactgtgctgccagtcctataaaagtatagtacatacaatatgtacagtacatggtacttgataatgataataaacgactgcgttatgggtttatgtacttgctatattatacttgtcttattattttagagtgtcttttttatacttaaaaaaaagttaactgcaaaacagtccttcaggaggtgttccagataaggcatagttaccataggagatggcagctccatgcatgttactgctcctgaagaccttccaatgggagaagatagggaagtgaaagacagtgatattgaagaccctggccctgtgtaggcctagtctcatgtgtaatgtgtgtttatgtctttttgttttttgttgtttttttgagactaggtctcactatgttggcccacgctggagtgcagtggctgttcacaggtgcaatcatattgcactgcagccttgaactcctggccttggacaatcctcccacctcagacttctgagtagctgggattataggcttgcaccatagcacctggctatgtcttcatttttaaacaaaaaagtttgaaagtaaaaaataaataaataaaaatttttaaatagaagaaagcttataggctgtgtgcagtggctcatacctgtaatcccagcaattagggaggctgaggcaggcagatcacttgaggctaggagtttgagaccagtctggcccacatggtgaaactctgtctctattaaaaatgcaaaaattagccaggcatggtggcacactcctgtgtcctaagctgctcgagaggctgaggcatgagaactgcttgaacttgggaggcggaggttgcagtgagccaagatcatgccactgcactccagcctggacaacatagtgagactctgtcttaaaaaaaaaaacaaaagaaaagaaaatgaaaaagaaaaaacctcactgtagcctccacctcctgggctcaagcaatccttgcacctcagcctcctaagtagctgggaccacaggcacacaccaccacacccagctaatttttttttttttttttttttttttttttggtacagacagggtttcatcatgttgcccaggctggtcttgaactcctgggctcaagagatcctcctgcctctgcctcccaaagtgctgggattacaggcatgagccactgtgcctggcctaagtgtaccactttatatcttctatagtttacttttactgtaccttttctacatttaggtacacaaatattgaccattatgttacaactgcttacagtattcagtacaataataggctgtccaggtttgcagcctaggaacaatagacaatgccatatatagcctagatgtgttgtagactataccatctctgtttgtgtaagtgcacagtatgatgtttgcacaacgatggaatcacctcatgatgaatttttcagactatatccttgttaagtaatgcatgaccttaatcaggaatgagtcacagcaatactgtaatcttgatgaagatgttgatgtagataatactcccatttacaatgcacttgccaaatacaaggcattgcactgaaagctttacagactttattttaaaaaattttacaaccttttaggtaagtaccattaaccacttttacagatcagaaaacagggtctatgaggtgaaataatttgtcatacagtggtgatgtaaatatgcatataatgaaacagaataggcaagtcagaagtgatttttgtatttcttttaatagattaagggtacttactatcagcaaaagagtgaaagtctgacagaaaagaaaaagatggaaagaaatgtggggatgtgcaattccttatgttggttggttcagcagagctttgccattgttcagatggagtttaggcaagcaaaagacgaccagccattgctgggtatttgaacatcagatgttcataaggcttaggtattcttaaaagaaaaatttattctcttaaaaattctgaaaaaaagttctctgtattaaaacttcataatgaacattgccacattgtatattaggcacagatattatttgttggagtttttggtaattgttatttttgtaactggaatatttaatatatgttttatatatatttattttatttatttattttttgagatggagtctcactctgtcgcccaggctgcagtgaagtggcacgatcttggctcactgcaacctttgcctcccaggttcaagtgattctcctgcctcagccgcccgagtagctgggactacaggcacgtgccaccacgcccagctaattttttgtatttttagtagagacggggtttcactgtgttagccaggatggcttcgatctcctgacctcgtgatccacccaccttggcctcccaaagtgttgggattacaggcgtaagccaccgctatatattttgcaaacaatagcaaatctagaggaaattctttgaagtaagaagcagtggtacttaaaactggctacttgtatttatcatctctgtttcagttttttaagaaattcaaaatttttacagagagttgataaaaacatttgatgatttggggtgcagatgaaggatggctggtatttgaaaaataaataaataaaggccttccttgattcttaatgttgagactgaaggcttcattggagtttcttcctcagcctgaattccagtgataatgtgtctgttcttgacatgagcaataactggagtacttaggattaaacaaaatattagatgtgccgggccagaggaggtgaggaaagtctaaagtgataaggtgctagtcagctcagagtggctgttttagatagtgtaatacagcagactagaaacttgtcggaaaggaaaggtaccaggcaggagataaatgtacacccaccttagctaatgtaaggagctgaaaactctattttgaatttttatcctaaacatggaaataacatccttatgagaaattgaacactaaatagacatattaaaccaattttgcttattgagacatctgttcattcatttattcaacagctatttactgagtggatacttggtagtttttaggccttagaattaacccaagacaaacttgtgaggtaggaagttgcatctcagtcatctcactactttgctctttcttgagacttcagccttccctttcctccctcaggttttggagcttagaaattaataatattaaagcttcaatgacaagactgtttaaaataaaaaatggttgggctgggcacggtggctcatgcctgtaatcccagcactttgggaggctgaggcgcacagatcacaaggtcaggagatcgagaccatcctggctaacacggtgaaactccatctctactaaaaatacaaaaaactagctgggcgtggtggcaggcacctgcagtcccagctacttgggaggctgaggcaggagaatggcatgaacccgggaggtggagcttgcagtgagctgagatggcgccactgcactccagcctgggcaacaaagcgagactccgtctcaaaaaaaaataaaataaaataaaaagtaaaataaaaaaataaaaaaaaattgttgtgttcagtgggagataatgtgttaaggaaagaaagatgttaagttctactacttgtagataggtggaattattgtgtcctttgtattgtttttgctttcctgtcataagatattccttggtttaataccataataaatacataaaaatacacataagaaactaaacaataaaaagaatgtgttaaataattttttttttttaccatttcaggttttttttctttctaattcagttaatcagtcccgctttgcttgtttgtcaaggttcttcaacttgcttaaaaactttttcaaattggtcaaaaattaatctttcaaattactacaggcttacaaaacttttatgcaccatgcaaacatcatgagatgtagtatgggaggtaaggaatatttaacctgcttcaaactttaagtattggacatttggattgttttccactttaccccgttaccgacaaagtggagcagacataactgattaatatttttaaccaaatattttgacttaagtatcgaattcctttggggtcttgaaggatataatacactatgaaagaaaagtagaaggtgctgatgatacaacgaattaggaggacctattttgtcgtgggaactttagagaagactttttgaagaagagtcacatgtcctacctcaatcagtctacaagcgcaaggaaacaacttagagttcgacaaagtcatatttatagattcattgcagtgagggagatcacacacagaactgtgaggcatctcactcaccaaacaaggacaagataatcattacaggatttgggggaagagtagagtttgggtgagatttaaatgaaaccatttaagtggcttttgatgaactcaaagcaaatcaggagtcaacatcaggtctgggcaggatccaggggtctgcttccttgaaaactagaaagttaagacagatatggattattgtgtccagaagcccttttcttaagctctgtggctggaatggaaatggaggctgattctctgtgtcaaagtgttttagagtctccaagacactatgatgttttatgttataataatataatttcaaagaacaaagtttcttagcaagtaagaaaacagtaatcactcaaagaatggggttgttatgaagctttatcgcatgtctttgggataactagtttcccgtaaactttgcagctagttttatcaatgtttattaatccagcttgatgagtgatggaacagatttttactttctaagtcctagcaaaagctttccctaaaaagagaggaccaaccaagagacaggggaaaataactttctggaaagaacaaaaaaacaagcatgaaggttgtgagctggttctggacacatttaagaccctaaaaaccaacaggacaatgacacaggcaacaaatgatttgaaatgatggagagataggggcagatctttcaggaagctgctagccttagttaggattttgcatttcatcaaagagtagagggaagtcactaaaggattctaatcaggggaattaccgaatcttcatcttctaagatagagaatgcattgtcataggcaatagtggaaggtagatgaccgtttggaaagttgttgcaagagaggatgatagtttatactagggtggcagcagtaaagaaggcagaaatggagagattcaagacaaaattttaggtagaaccaaatggtcttagtgagagtttgaatgtgtaacatgagggagatggagtcagggataatatccaggttctggcttgaatatccgagtagaaggtggcatcattaggatgtggaagactggaggtgaggcaggattgatggaaaagaacaagtacagctgtagacatcttacatttgtgcgacatttaagtaagaatgccttgaaagcatttgggtatttggatctgaggttgagaagagaggattgagttggtgctaaatatggagtcataagtatatattcaaagccatggaaaaaaaagtaacatgagaagagaaaaaggatcaggaccaagtctaaaggaactaccaaatccagaggtgaacaggaggacaggagccagcaaggaagcccaggcaccatgaagatggctgaattcacttatgaaaagcttggtttgatgctttgatgttaactcagttgtacttgtcatcaatttcttagagaatcgagagctgaaacatattctgaactgccttctatttttattcactgctttgtattatctgtagtcatctagttagacaattcctttcctgcaatgcctgtgatggaagccaggaagcatttatttctttgcgaagcatttggaaaatataaacatggccgggcgcggtggctcatgcctgtaatctcagaactttgggaggccgaggtgggcggatcacgagttcaggggatggagaccatcctggctaacacggtgaaaccccgtctctactaaaaaaatacaaaaaaattagctgggcatggtggtgggcgcctgtagtcccagctactcgggagcctgaggcaggagaatggcgtgaaccttggaggcggagtttgcagtgagccgagatcgcgccactgcactccagcctgggcgacagagcgagactctgtctcaaaaaaaaaaaaaagaaaaatataaacatgcaaatgacatcttatcacagcactgaacagatgttttaaattgtatttatttatttattcatttatttatttagacgaagtctcgctctgttgcccaggctggagtgcagtggcgcgatctcggctcaccgaaacctccacctcctaggttcaagcgattctcctgcctcagcctcccgagtagctgggactacaggcacgtgccaccatgcccggctaatttttgtatttttagtagagacagggtttcaccatattggccaccgtgttggccaggctggtcttgaactcctgaccttgtgatctgcccacctcggcctcccaaagttctggaggcgtgagccaccgcgccaggccatttttaattttattttaagcctgtgttctaaccacatcatttacctgcaggtccttggatacaatatgtacttttgagtctgagtctgtgctcacgttgttccttctgcttagaatggcctctctttccccttctctacctaatcaagtcctacttaacttttaaaacccagctctagtggcatgctcctctctgagccttttgttgttctaataaggcgtaactaatcactcctcctaaatacactcacagtatccagctcattccattagtacagatcttttcatgttttactttgctaaggtatagacaaatatatctgtctctaccattggactgtaaggttcttaagtgaccatgagttattcaactttacgtccctcatacagagaacaaatcttgttgaatttacttgcatgtaattggagatgacatggcaaagaataatgtggatatatcctgctcagcttcagataaacgctatgacatatgtaaacaaaatattcagctaacttttaaactttacatccaattttgacttatataggatgtaaactgcatacatgtacatatgcttcagacctttgaacatgctgctttctgtctggcatatgcccctatcttctctctcccacacaagtccacccatctctcaattttagtttataggctttttttttttttttttttttgagacagattcttgctctgtcgcccagactagagtgcagtggtacgatctcggctcactgcaacaaccacctcccagattcaaacgattctcgtgcctcagcctgccgaatagttgggattacaagtgtgtgccgccacgcccatctaattttttctatttttagtagagatggagtttcactgtgctggtcaggctgatcttgaactcctgggctcaggtgatccacctgcctcggcctcccaaagtaagcccggccattttttttttaagagataatatctcagtctgtgacagactggagtacaatggcgctatcaattttagttctaactaaactgtcaacaaaatctttgactaccttctctctctacctcaagatagcttgctcaattgcaatgtcaccctgcactctcattttacaacacacatcatcttttagtttctcagtaagtgttgctttctctctacaactgaaagctccaggaggcagggacaaaacctgtagtttttcttttctttttttcttttttcagcaaagggagggctgattttttaactttttgaaaatagatgaaagtaaacaataaaataataaaacctcacatgccatcgctcagcctcagtaaccatcaacccatggccaatcctgtccctactgcaaccctgcccattccctacactcacacattattttgaagtaagtcccagacaacacatgattttatttgtaaatatttcagtctgtttctgaaatgactcctttttgtaacataaccacaatgtcattattacacctaagaatgaataatatacctctttaatatcatcaactatccaggcagaattcagatttttaattatctctttcagacaatctttttaatgtcttttcttgaatcaggatacaaacaaggttcacacattgagattggctggtagtctattgtctctttttacctaccgattcaccttctattttttctttttgtttcatcacttataaatataaatactatttttttaatagctatgtctccagttcctcacccagtcttggtcatagcaggttttagataaatattgtatttgatgaataaatgaatgaatacaagtaatgcataattgagaaatctcaggagataccaaaagaaatgtaatttaataataatctttgatttctctgatctcatatttcttcaatgttctctaaatttaaaattttatttgatacataataaatgcatacttttgaggcagaaagtattattctctgaaacatttctaagaaattaatttaccctggaattgtcataattagttaattttaactacttcccctatataaaattggtgacttgggcagcaagacaaaaaaggtttctattgttaagtaagacttatttttcttcctcaagaaatcatcactagtaagcattgcaacctttactttgctattgttagatgtggcaacaactcgtgctggactcgagaaaattgtgcaagcttgaattaaataattgcttctaaatttgcttataaggaagtttattgtcttaccagggactaacactacaaatatggaaatggagtcaagcagtgattcaatgtagataacataattggaaactgggagaaagaatgttcattcaacaatcgagaaaaactaaaataaaagttaaactttacttcatcaatgctgggtccaaattaattaatgaaaacagaaataaaactatgcttcctaggataatattgacagtatttttaaaagtttattattttttaaaaagattattatatgaagagtaaaagtctttctatctctctagcctcccttattcagattttcagaggtaaaagcattgtttcttatatatccaggcattttcctatcagaatgtccaacatatgtatatttatatatagtcatgcacctcataattacatttaggtcaatggcaggccacatgtatgatagtggatggtcccataagattataattgaactgaaaatttcctatcatgtagtgacatggtagctttcataacctggtaacacagcgtattgctcacaggattatagtgatgcgatgcagacaaacctactgcactgtcagctatgtaaaagtatggcacatacaattatgtacagtacataatacttaatgataataagtgactatgttactggtttatgtatttactatactatactttttatcattattctagagtgtactccttctacttattaaaaaaaagttaactgtaaaacaaccccatgaagagtaatatattctagatacacttctgtacttgcctttcacacagttgatcatgttgttcaaattgtccagatttgggcattagtagctcctttaagttggctccgatgtcttgtagacttggcccccattattttgtgaacatgtctttactttctggcactttaaatggtctaagctcatcttgcattcctcctgctctagtctggactcagtcatttccccagggagctctggttcctttcatcgagaatggtatttagaaaccaagatctggaaactagttgtgctcattgctactgggatctcactgcatgtatatccatgagttcacactgatattcctgctctgatttcaatctggagtttgtgctacttcacaatttctctattttaactcttttatctgacagaaaactggctctcaatatccacagtgtatttcttaattactcaatcctagtatatacataaagtagtttcagaaatactaacccataccctatgaaaaacaaatttactaaagtacaatattttcatacagttctttctgtttttagccttctagtatatggttaaaataatgttctccaggttatgttagataattcttttattttttatcccatttagtataattatgtcatttatttgtaatacagttgggcttatttgttactgcttatattccattttgggtcttcccttccccaacatcctggttaattttaattatttatttttttgggggggggtgaaacattaccatatttataggaattagagctatgcatataggaatactctgagtgtgtcacatctctctaatcatttctacccatttttattccccaatttttccacgctgatcctacttaacctctgtaggtgacgaatctcatttgtttctagtttaactttccagtatgtttttcctcatatatgtggatatatgtatattttcttatatatacttctttcttacatgaagagtagtatactctagatattcttctgtactttgctttccacataagaatataccttggaaatctctgaatatgaatccatagagctcttcctcatttattttatagctgcatagtgctctcttgtgtgaattgttagagtttatttaaaaaccactgttctatatatgagtatttaatttgtttcttaaatttagcaattatatataatcttacaatgaataaacttgtacatatgtttttcatattgttggatatgtatcttcagggtagattttataagtgagattatagggctccttatgtagttatattaggtattgccaagtttccattgagaagggttgtagcagtttgtattccttaacagcaatgaaaagagtgattattttcctaagatctggctaacaaaatgtgttgtcatattttaatttattacattttattagttaaaattttattttaatttttacccatctgataggtgagaaataatagcttagcatttttttaatctgcatttttctagttatgaatttgcactttacaggtatatatatgtatttttctttttaaaaaattgtattttaagttctggggtacatgtgcaggacatgcaggtttattacgtaggtaaatgtgtgccacggtggtttgctgcacctactaacccatcacctaggtatcaagccctgcatgcattagctatttatcctgatgctctccctcttcccaacccgctgacaggcccgagtgtgtgttatttccctccctgtgtccatgtgttctcaatgttcagctcacacttatgagtgagaaacatgaggtgcttggttttctgttcctgtgttactttgctgaggatgatggcttccagcttcatctgtgtccctgcaaaggacacgatctcattcctttttatggttgcataatattccatggtgtatatgtaccacattttctttatccagtctaccattgatggacatttgggttgattccatgtccttgctcctgtgaatagtgctgcagtaaacatacacatgcatgtatctttataatagaatgatttatattccttttggtatatacacagtaatgggattgctgggtcaaatggtatttctggttctagatccttgaggaatcaccacactgtcttccacaatgcttgtactaatttacattcccaccaacagtgtaaaagcattcctttttctccacagcctcgccagcatctattgtttcttgactttgaaaagtgattatatgtatatttacggatcactttttcaacagccttgttaaggttgtggagacaaaaaccaccccatcttggatgctaatccaccatgttgacttctgattagacccagtcccatgaataacttctggtttctactttatttactgtccctagtataagatcaaaacaaccctgatgttatcacacaaattataggctaggacacacatagcattttcgcctgttctggagggttgcctttaatcgtttttgctggagcatgtgtaccctttccatacggtacccaaaccttgggtctgggaaataacagtgtggagatctacctgtcttgcagtcatccaagatcacacttctgtccataagttcctcagtaaatcacccattactgacgaactggatttgttcacttccttctttggtttctgggcttcttcagcatttgggaatagctttgtgtgcacagccttttcacagaacaaagatatgacctactttctgtttctatagagttgttaaagccatttgtgtgtctctgtgtgtgtgtgtgaattgtctattgatgcccttttcccattttttctaatgggtgcttggtgcttgatctcttaatttctaacaattatttacatattaggaatattagcccttttcctgtaatatatgttgaaagcatgtttttaacctggttgtcagttgtcttttgactttgtttatgatatttatcatgcagtttatttttatgttactagattcatcagtcttttataaatggcttttagatttagatttataaccattgccaactgctggctcctccagaaaccaccaaaatggtttactgatgaacaaaaaccaagtttattgctcactgcagtaaggaagatgactgtcttcacataatcttagtagcctcagaaaagggagtcaagggtgggatattggtaagctttggggagtctggttctaaggtatgtctttcaacatgaggtgtgcagtcctgactgggatagggtaaagtttggattgctggatacagtgaggcaagacctataaagccagccttgaaaggtaaacagtcacttgaaaacccagttgagtgatctactgttctgaaaagaaggctgtttagcccgatgaggctgtatgagtacagatacatagatcggaaagtttccaggacaaaaaagtaatttcaactttactttcttaggcaaggatttcttggaatagtaaagtcatcttagtgcagacagttcctaatctctttattttttatttttagagacatagtctctctccatccattaggttggaattcagtgttgtgatcataactcactgaaatcataagctggaatgcctgggcccaagtgatccttccaccgcagcctcccaagtagctagggctacaagcacatgccaccatgcccagctaatttttaatcttcttatatagagacagattcttgttatgttggcaagactggttttgaactcctggtctcaagtaatcttcctgccttggcctcccaaagtgctaggattacaggtatgagccaccatgcccaaccaaacagttcctaatctttttaagctgtgtggcttcaggttgcttttgttctcaacatatcctctataaatagattcctaccattggctgcgcgtggaggctcacacctgtaatcccagcattttgggaggccaaagcgggtggatcacctgaggtcaggagttcaagaccagcctggtcaacatggtgaaaccccgtctctactaaaaatacaaaaaattagccaggcatggtggcagatgcctgtaatcccagctacttgggaggctgaggcaggagaattgcttgaacccgggaagcagaggttgcagtgagccataagccaagatcccaccattgcactcaagcctgggtgacagagcgagactctgcctcaaaaaaaaaaaaaaaaaaaaaaaaatcctatcatctcttttatcttcaggtcatctttttctattttgatgtgtaaattctagttctatgttcttttagttttctgcaaaagagtacatggggatatatttataaatgcatgcatattcaaaaattttcttctgcccttacatgtaaatgataatgtgaatttcatttaggatttttgaatcatatttttgtacaatattttcataccgttctttatgttgaaggggttcctgtagcagcctgcattttcttctgcagtacttaccacaatcagaagttacgctccatcaaggcagtgagtatcaggtttatacactgctatattcccaatgcctagaaaaatgcctgacatatgataatacctcagtaaacatttgtcaataaataagtgaatgaggggcgggtgcagtggctcacacttgtaattgacactttgggaggccaaggcgggaggatcgcttcaatccaggagttcaaggccagcctggacaacatagtgagatcccatctctacaaaaaataaaataattggccatgtgtggtggtgcatgactgtggtcccagctactcaggaggctgaagtgggaggactgtttgagcccaggaggtggaggctgcagtgagccatgattgcaccactgtactccagcctgggtaacagagcaagtctctgtctcaacaactagaaaagaaaagaaaagaataaatgaatgaattagaggttgtatatgtaatgtatttcttctcctctggactataaacttaacagaaagaggaatcttctacattgtttgcctcttgtgtttcataacaaagtatctgcctcataaagatgttgcatacatttttgtaagccagtgtatgtttgcataagtgaaattcagtaaaatgcattccggtaagactcaagtagaaactaattatatattcttcttccttcctttccttttccttttccttttctttgtcttactctttctgttacccaggctggagtgcggtggcctgatcacagctcactgcagccttgaccccactaggctcaggtaatttttccacctcagctttctgagtagctgggactacaggcacacaccaccatacctggctaatttttatactttttctacaaaaatacaaggttttgccatattgcccagtctggtcttcaactcctgagctcaagtgatccacctgccttggcctccaaaagtgctaggactacagttgtgagccactgtgcccagcctaattacatattcttatttcaagacctctttgaagataaacctttagtgctaaataatcattcagtatcatatcctctcagcttctaggaccaaatatttggcttatctcaacaacatgtattcagaatgcccaattcaatcttgtctttgcagaaaaaatcattttctcttatacacgatcccaaaatatgcaagaaaatatacatatttttctcttctcccccttgtttcataaactggtgttgagtttttaatttttattgatggtttggaatttataatgaaaatgaaaatgctgatgaggtctttggctgtagtaacaagaagtactacagatgactcagagaataaagctgcctcacattacattaaaactcatctcttggaaaatggtgtaaatggttgactggagatgaaggtaatttatcaatttatgtggttgaggcatattacatgatcttaactttcataaaattaaatctgaatatataacaatttgaaataccttaatgctaagccttatcatttggcgaagccccttttatcaaattgaaactctaaaattacctaccatcatttatcccaatggtataacatgtcaatggcttacaatgtatcatttattttcataatccatccttcatgaaaaatattacctaaagtgtttaccataaaagtgagtgacacctaaggcaaagaaaaataacaaaaatagaattaaagagaaaggactcagaggatggaagacattgatttaggaagaatgaatgacggagttataggagcatcctataatgttaagttgttacatcttgctaaaggccaagctcattctgcatatgtgaagagttgattgcattatttacatagatgtatcttgggatttgaacaaagttgtaagtcagtatagaggaagttgggcattccagggtgagcctattagcgtcctccagagtagaaatattggaatggtctcatacagaagagatagaatataggataattcgtcattgattacttcctctgaattaggatatatttataatactgtttttaaaccagataaaactagagaaaatctcaagtaattagtcaatttattgtattccccatctttcttctctgaaacattccctaggtatacagtagtgtaaatatacatttcaaaagagagaggtgctacagaccctctttgcaacctgtatgtgtatccaatcctcttgtcttcttcttcattctgtttcaagaggattacacttttaaaatgtcttttgaattcctgatcgccttaccattccatttccactgccttgtcacctttcacaaagagtactgaggtagcttctttaaaaaatatgtatagtttcaacttttattttagaatcagtgggtacatgtgcaggtttattacatgggtatgtttcatgaagttgagtccgttacccaggtagtgagaaaaatacacaatagttggtttttcaacccttgtccccttcttctctcctccctctagtatttgccaggatctatttttcccatctttatgtccatgtgtacccaatgtttagctcccacttataagtgagaacatgcagtatttgattttccatttctgtgttaattcacttaggataatggcctccagttgcatccatgttgccacaaaggacataatgtcattcttttttatggctacatagtattccatggcgtatatgtaccacattttctttatccaatccaccattgatggacacctaggttgattccacgtttttgctattgtgaatagtgctgtgattagcatacaagtgcatgtctcttttgtgtaaaattatttattgtcctttgggtatatacccagtcatgagattgctgggtcaaatggtagttctattttaaattctttgagaaatctccaaattgctttccacagtggctgaactagtttacattcctacaaacagtatataagtattcccttttctctgcagccttgccaacatctgttattttttgactttgtaataatagccattctgattggtgtgagatggcatcttattgtggttttgatttgcatttctttgatgttgatataatcaccaaaaacgtaaacatttcagttgctattggttacatgttacgttttctgttgtttttattgttgtgtagttcctcctgagctggttcggctctgtgtccccacccaagtctctcaccttgaattgtaataatccccttgtgttcttggaggaaccccgtgggaggtaattgaatcatggggagggggtttcttcccatgctgttctcatgatagtgagtaagtctcatgagatctgatggttttaaaaaggggagttctcctacacatgccctcttgcctgctgccatgtaagatgtggtttttgccttacaccatgactgcgaggcctccccagccatgtggaactgtgaatcaattaaacctcttttctttacacattacccactctcgggtatgtcttcattagcaacatgggaacagattaatacagtaaattggtactgggtagtggagtgctgctgtaaagacatcagaaaatgtggaagctactttggaactgggtaacaggcagaggttggaacagcttcgaggactcagaagaagacagaaaagtatgggaaagtttggaacttgctagaggcttgttgatggctttgaccaaaatgctgaagtgatatggacaataaagtacaggctgaggtggtctcagatggagatgaggggtttgttaggaattgaagcaaaggtgactcttgttatgctttagcaaggagactggtggcattttgcccctgccctagagatttgtggaactttgaacttgagagagatgatttagggcatctggtggaagaaagttctaagcagcaaagcattcaagaggtgacctgggtgctgttaaaagcattcagttttatttattcacaaagatatggcttggaattgtaagttatgtttaaaaggaaagcagggcataaaagtttggaaaatttgcagcttgatgatgtgatagaaaagaaaaactcattttctgaggagaaattcaagccagctgcagaaatgtgcaagtaacaaggagccaaatgttaatacccaagacaatggggaaaagtctctagggcatgtcagagaccttcctggaagcctctcccatcacaggactggagacctaggaggaaaaaatggtttcctgggccaggtccagggctccattgctgtgaggaacctagggacttggtgacctacatcctagctgctccagccatggctaaaaggggccaaggtagagctcgggttgtggtttcagagggtgcagcttggcagcttccacatggtgttgagcctgtgggtgcacagaagtcaagaaccaaggtttggaaacttctgtctcaatttcattggatgtatggaaatgcctgaatgtccaagaagaagtttgctgtaggggcagggccttcatggagaacctctgctatggcagtgcagaaggggaatgtggagttggagcctgcacactgagtccccaatggggtgctgcctagtggagctgtgagaagaggggcactgttctccagaccccagaatggtagatacactaacagcttgtgctgtacacctagaaaagacactcaatgccagcccatgaaagcagccaggagaggggctgtaccctgcaaagccaaaggggtggagctgcccaaggctatgggcgcccagttcttgcatcaggatgtgagacatggagtcaaagaagatcatttcagagtgttaagatttggctgccccgctggattttggacttgcataggccctgtaacctctttgttttggccaatttctcccatgtggaatgggtatatttatgcaatgcctatacccccattatatctaggatgtaactaatttgcttttgattttacagactcataagtggaagggacttgccttgtttcagatgaaattttgggcttggacttttgggttgatgctgaaatgagttcagttttttgaggattgttgaaagcgcatgattgtgtttttgaaatgtgaggacatgagatttgagaggggccaggggtggaatgattgtagggaaaagaaagagagatcagactgttcctgtgtctatgtagaaaaggaagacataagaaactcattttgatctgtaccctgaacaattgttttgccttgagatgctgttaatctgtaactttagccccaagcctgtgctcacagaaacatgtgttgtatggaatcaaggtgtaagggatctagggctgtgcagaatgtgccttgttaacaatatgtttacaggcagtatgctggtaaaagtcattgccattctccattctcgattaaccaggggcacaatgcactgcggaaagcctcaggggcctctgcccaagaaagcctgggtattgtccaaggtttcccccaactgaggcagcctgagatacggcctcgtgggaagggaaagacctgactgtcccccagcctgacacccataaagggtctgtgctgaggaagattagtaaaagaagaaggcctcttgtggttgagataagaggaaggcctctgtctcctgcatgcccctgggaatggaatgtctcagtgtaaaacccaatcatacattcattctattctgagataggagaaaactgccctgtggctggagatgaaatatgctggcggcaatgctgctctgttactctttactacaccgagatgtttgggtggagagaagcataaatctggcctacatgcacatccaggcatagtaccttcccttgaacttatttgtgacacagtttcctttgctcacaggttttcctgctgaccttctccccactatcaccccgttctcctgccacattctccttgctgtgataatgaaaatagtaatcaataaatactaaaggaactcagagaccggtgccgatgcaggtcctctgtatgtggagcgctggtctccttggcccactgttcttttgctatactttgtctctgtgttttatttattttctcagtctccccatcccacctgacgagaaatacccacagctgtggaggggctggcccccttcagatgatatggtttggctctgtatgcccacccaagtctcaccttgaattataataatccccacgtgggatcaattgtgggaccaggtggaggtaattgaatcatgagggtgtcttctttccatgctgttcttatgatagtgaataagtcttacaagttctgatggttttataaaggggagttcccctacacaggacctcttgcctgccaccatgtaagacgtgcctttagccttccaccatgattgtgaggcctccccagccatgtgcaactgtgagtcaattaaacctctttcctttatacattacctagtatcgggtatgtcttcattagcagtgtaagaacagactaatatgctgcttctacagtttattgaatttaacttttaaatcaagttgtgattttattgttgttgttgtctttgagtcttgccatccaaatcaaaactgggctaatttgtggaaataatatctattgggttaaggagagaattgttagatgcagcctaaaagaaagaatttagtgttcactgtatctatcatgaaaggctctttctatttgttttctattataaagtaatatgctgtatttcatggcaaaggctttaaattgaaaactccaaggcttaaaatttaagccttgcatttggaaatagacaactagctctacagaagtagttttgttttgtttttgtttgtgtttttttgcagtggggggctggtatttgggggcagggagaggggaaaaagtccatttgctggtactgagtgactttgggcaagttacttgccctctgtaagcctcaatttcctcatctataaaatgggatattagctttcttgtaggattgttgggagaattaaatgagataaggaatatctgtaaagcagttaacatgaaacaggccctcaataaatggaaactaattttattgtttgtaatagaaaacaacaatgtgtcagcttctagtaataactttaaaatattctatgcatactatatagcaaaggcagttttacttctaatcacagaacatataacactaagtatagttctaatacttaagaagcaaaataacaccagggcagtaacaaatgctggagaggaggtagagaaaaggaaaccctcatatgttgttgatgagaatgtaaattagtacaaccactatggagaagagtttggaggtttctcataaaagtaaaaatagagttaccatatgacctaacaatctactgggtatatactcaaaagaaaggaaatcagtatatagaaaatatatttgcactcccatgtttgttgcagcactattcacaacagccaaaatttggaagcaacctaagtgtccattcacagatgaatggataaagaaaatgtggcacttatctgcaatggattactattcagccataaaaaagaatgagatcttgtcatttgcaataacatggatggaaccggaggtcattatgttaaatgaaataagccaggcacagaaagacaaacatcacatgttctcacttatttttggatctagaaatcaaaacaattgaaaacatgaaaatagagagtagaaggatggctaccagaggctgggtagtgtaataggggtggggtgggtagggaggtgaggatggttaatgggtacaaaaaaaatagttggaaagaatgaatacagccgagtatttgatagcacaacagggtgactatagtcaataataatttaattgtactttctaaaataactaagagtataatgggactctttgtgacacaaagaataaatgcttgaggtgatgaatactccattctccgtaatgtgattattacatattgaatacctgtatcaaaatattacatgtaccccataaatatatacacctataatataccctcaaaaattaattttttttttttgagatggagtcttgctgtcacccaggctggagtgcagtggtgcgatcgcaactcactgtaacctccgcctcccaagttcaagagattctcctgcctcagccttctgagtagctgagattacaggcacgtgccaccacacccagctaatttttgtatttttagtagacatggggtttcattatgttagtcaggctggtcttgaactcctgacctcgtgatccgcccacctcggcctcccaaagtgctgggattacaggcatgagccactgtacccggccaaaaatcttaaaaaataccaggggacatatcagcatagctgagccactctgactttttatcagtttccggaagacacccatctccttcttacctctaggcctgtgtatttccattcccttcagcctggaaagctcttatccaagctatttacatggctggcttcttattctttagttgttagcttaatgtcaactccttacagacaccctacctgattatcttagctcaattaggccgttccttgctctagtcactattatagcatcctatatatttccttcagagaggttgtcacaacctgaattaccttatttttttgttcttgtttacttgcttactatcagtctctcccattaagctccaatgacatggtcaaggaccacatctacttgtggcccattgaagaccccttgcctaacacagtgtctggtacatgttgaattgtcagtaaatatttgttgaaacaattggttaataaatactgttcctgaaagcctctctgccactgtctctgcagtagaactgcccttgctaccctcagactaatgaagaagagaagaccctaagtaccttatttatacctccaacaagctgcaatcaacccaagaagaggaggccagtccgtctcccatggttcccacacccccaacccccactcatcaccagagagaacccctggcttgagcccacagcacagacccttcatcctggggtgattgcactgaggaattgctgacctacatctctctggtgtggagctcccaggatacaagcaaaagacccctgaccacaaccactactaaggtcctttcctctgttgccgccaagttgaggaaggaacgtaaacactgacattgccccagagctgcagtgggcagccaggagtgtcaaaccacaatctacagccatacagctggcactcaagggggcgaggaacccacactttcagagcatcgagagtgaacacagctgtaactatgagaaaacatagaggagccacacaactgagcaagagtctaccagttgaccaataagcctaagtgccacctactggatcacaccccaaagcttcaacaccaagaatacctcactaacatactcacctctgaaactagagacaagaagtcagcttcaaaaaaagaccctgcacaaggcctcagcctagtgaaaacagccagaagtctattgactgtactcaatctatatggcagttaaaggaacacccacacatggagatgagaaagaactaacgcaagaactccaaaaattaaaatggccagagtgtcatatgtgctccaaatgaccatacaaattctctaacaagagtgcttatccaggctgagctggctgaaatgacagaaatagaatttaggatatgtataggaatgaagatcattgagattcaggaggacagcaaaacccaatccaaagaaaccacaaatcacaataaagtgatacaggagctgaaagacaaaatagccagtataataaagaacctaatgggtccgacatagctgaataacacagtacaagaatttcacaatgcaatcacaagtattaacagtagaataaaccaagctgaggaaagaatctcagaactcgaaagctggctttctgaaataagacagtcagacaaaaataaagaaaaaagaataaaaaggaatgaacaaaacctccaagaagtaggggattatgtaaagaagccaaatctacaaatcactggcatccctgaaaggaagggggagaaagcaaacagtttggaaaacatatttcaatatattgtccatgaaaacttccacaaccttgctagagaggacaacagtcaaatacaggaaatacagacaactcctgcaagattctacacaggaagatcatccccaagacacataattgtcagattttccaaggtgaaaatgaaagaaagaatgttaaaggcagccagaaagaaaaggcaggttacctgcaaaggaaatcccatcaggctaacagtggacctctcagctgaaaccctataagccaaaagagattgggggcctatattcaacattcttacagaaaacaatcttcaaccaataattttatatgcagccaaactaagcttcccaagcaaaggaaaaataagattcttttcagataagcaaatgttgaaggaattctttactaccagacctgccttacaagagatctcaaaagaagcactaaatatagaaagaaaagatcactacgagctaatacaaaaacacacttaaacacacagaatagtgtcactgtaaagcaaccacacaaacaaaccaacataataatcagctaacaacacaatgacaggatcaaatccacacctaacaatggtaactttgaatgtaaatgggctaaatgctcaacttaaaaggcacagaatgacaagatggataaaaaagcaagtcccaatggtatgctgtctttaagagacccatctcacacataatgacaccaaaaggctcaaaataaaggcatggaggaaaatctaccaagcaaatggaaaacagaaaaaagctgaggttgcaatcttaatttcagacaaaacaaacttcaaaacaacaaagatcaaaaaagacaaagaagggcattacataatggtaaagggtacgattcaacaacaagatccaactatcctaaatgtatatgcaccgaacacaggggcacccagattcatgaagcaagttcttagagacctacaaacaggcatagactcccacacattaatagtgggagacttcaacactccactgacaatattagacacataattgaggcagaaaattaacaaagatactcaggacctgaactcaacattggaccaaatggatctgatagacctcttcagagctctctactcaaaaacagcagaatatacattcttcccatcgccacatggcatctactcgaaaggcaactacttaattggacgtaaaacaatcctcagcaaatgtaaaataactgaaataatacgaaacacactctctgaccgcagcgcaataaaaatagaagtcaaagaccaagaaaatcttcaaaatcaggcaatgacatgaaaactaaacacgctccagaatggcttttgggtaaataatgaagttaaggcagaaatcaagaagttctttgaatctaatgagaacaaaaatataacataccagaatctctaggacatagctaaggcagtgttaaaagggaaattcatcgcatgaaatgcccacatcaaaaagttagaaagatctcaaattaacaacttaacgtaacagatgaaggaattagagaggcaagaacaaatcaaccacaaagctagcagaaaacaagaaataaccaaaatcagagctgaaatgaaggaatctgagacacgagaaaccattcaaaagatcaacaaatccaggagttggttcttttaaaaaattaataagatagataggctactagctagactaataaagaagaaaagagagaagatccaaataaacacaactggaaatgacgaagggaatgttaccactgaccccacagaaataaaaataaccactagaaaccactatgcactcaaactagaaaacctagaagagatggataaattcctggacacatacaccctcccaagactgaaccaggaagaaactgatcccctgaatagaccaataatgatctccaaaagtaagtcagtaataaatagcctaccaaccaaaataaagctcaggacctcatggattcacagctgaattttactatatgtacaaagaagagctggtaccatttctataaaaactattccaaaaaactggggaggaaggactcctccccagctcattctacgaagccaccatcattctgatacaaaaacttggcagagacacaacaaaaaagaaaacatcaggccaatatccttgatgaacatcaatgcaaaaatcctcagcaaaataatttcaaactgaatccagcagcacatcaaaaagctaatccaccatgatcaaatagacttcattcctgggatgcaaggttggttcaacatacgcaaatcaataaatgtgattcatcacataaacagaactaaagacagaaaccacataattatctcaatagatgccgaaaacgctttagataaaattcaacaccccttcatgttaaaaactctcaataaactaggtattgaaggaacatacctcaaaataataagagccatgtttgacaaacccacagtcaacatcatactgaatgggaaaagctggaagcattccccttgaaaactggcacaagacaaggatgccttctctcaccactcctattcaacatagtattggaagtcctagacagaacagtcaggcaagaaatagaaataaagggcatccaaataggaagaaaggaagtcaaactatctctctttgcagatgacattattctatatctagaaaacctcttttttttttttttttttgagacagagtctcactcttgttgcccatgttggagtgcagtggcatgatctcggctcaccacaacctccgcctcctgggttcaagtgattctcctgcctcagcctcccagagcagctgggattagtgatatacaccaccacacctggctaattttgcatttttcaatagagacagggtttctccatgttggtcaggctagtcttgaattcctgacctcaggtgatccacccacctcaacctcccaaagtgctgggattacaggcatgagccacaacacttggcctatatctaaaaaaccttatagtcttggcccaaaatttccttcagctgataaacaacttcagcaaagtttcaacatacaaaatcaacgtacaaaaaacactagtattcctatacaccaacaacagccaagacaagagttaaatcagaaaggcaatcccattgacagaaagaatcaaatatctaggaatatagctaactagggaggtgaaagacctctacaatgagaattacaaagcactgctcaaaaatatcagagaagacacaaacaaatggaaaaacattccatgctcatggataggaaaaatcagtattattaaaattgccatactgcccaaagaacttacagattcaatgctattcctactaaagtgccaacaacctttttcatggaactagaaaaatctattttaaaatttatatagaaccaaaaagagctcaaatagtcaaggcaatcctaagcaaaaataacaaagctggaggcatcatgttacctgacttcaaactatactacagggctacagtaaccaaaacagcatggtaatggtacaaaaccaggcacatagaccaatagaacagaatagagagcccagaaataaggccacacacctacaataatctgatcttcaacaaagctggcaaaaacaagcaatggggaaaagactccctgttcaataaatggtgctggggtgactaagcagccacatgcaaaagattgaagctggaccccttctttataccatttacaaaaataaactcaagatggactaaagacttaaatgtaaaacccaaaactataaaaactctggaagacaacctaggcaataccatcttggacacagaaacagacaaagatttcatgacaaagacaccaaaagcaattgcaagaaaagcaaaaattgacaagagggatctaattactcttaagagcttctgcatagcaaaagaaattatcaacagagtaaagagacaacctacagaatgggagacaattttcaaactgtgcatctgacaaaggtctaatatccagcatctataagaaacttaaacaatattacaagagaaaaacaaccccatagaaagtgggcaaaggaccccttagaaagtgggcaaagaacataaacagacacttttcaaaagaaggcatacatgtggccaagaagcacatgaacaaaagctcaatattactgatcattagagaaatgcaaatcaaaaccactatgaagataccgtctcacaccagtcagaatggctattactaaacagtcaaaaaaaaaaaaaaaaaaaaagaaaaccagatgctggtggtgaggttacagagaaatgagaacatttatatgctgttggtaggagtgcaaattagttcaaccattgtggaaagcagtgtggtgattcctcaaagagctaaaagcagaactaccatttgacccagcaatcccattactgggtatataccctgaagaatataaatcattctaccataaagacacgtgcatgcaaatgttcatcttggcttggtttctcattcttttgttcacttttcggagtcattttcctaccattcatttgtgcatgcagtgtctgaatttcagataacaaactcctatgtgctttctggaggcattccatagctgcttgatattcaacagcactattcacagtagcaaagacatagaatcaacctaaatgcccatcaacaacaaattggataaagaaaattgggtacatttataccatggaataccgtgcagccacaaaaaagaatgagttcatgtatttcgtgggaacacggatggtgctggaggctattatcgttagcaaactaacacagaaacagaaaaccaaataccacatgttctcacttataagtggaagctaaatgatgagaacttacaaatgtgaagaaggagacaacagacactggggtctacttgagggtggagggtgggaggagggagaggagaagaaaagatagctattgggtactgggcttaatacctgggtgatgaagtaatctgtacaacaaacccccatgacatgagtttacctatgtaacaaaccttcacatgtacccccaaacctaaaataacagttttttaaaaataatcaatattgtcccagtcctccattttacagatatggaagttgtgattaaaatgtgattaatgtcacagaaatactaggaaagccaagcttctaacagtcattccagggtcattgccagggtgtcaaatcctatgtcactgcacagtattactataacaacaaagtgtccctttcctgacttcctattccccattcttgatccagcatctttgggatccacttccaggcattttctctggggtcctgctggcttaagtcagccagatcctgcagtgcctttgccatatgatcctcccctcccttaacagacactgtacttacccagttggattatactgaaacttagtcctcatactgtctggtatcggggagagaagtgggggtagattctgagcaggaccaacattgttttgtaagacacttgacttactcgaagcttatagttttcaagcaaggagaaggtcttccatcttccagcaagggagtgggccacctctgtaggcccagatattccggagaagctgggaggccaaggtccttaagtgtgtctaataagtttccccattccaattctcatgttcccacttttttccaatcaggaccctgattctcttgaaggagacttacacaggctgagaattaaccttctctggcgttctgccactcataagtacaggctgcacctgggcttcagttcagttggccttctggctgccagtgatgagggactttttaaaggcttccatggaggccctttgactctcacacttgggtttaaattggtggttaatagatttgatcctggcatctatacttagtgcatcaatggtgcttaccaataccctcccaattcaacaatctttcaagttacttttccacctgtactctcaaatactagatacatcacagaagttaatgcattcgcttctacttatatgctgtcctggttcactacaagtaaaagtgttagcaatttcactgcaggagcacatctgagactatcttcagggaagagattctgatgggaccactggtgagtgagcaaactccagaatcccatccttagactcaggtgtatataactactactgctatcaactgtcttagattgggctcttgcagctgaccctgagaattagattcctgtccaagtgattgcctgagggagtgctctcagaagaaatctgaacagcgaggaaggaagcagaataggacaggaaaagaagctgggaaagatatgggtttagctgaagtctagcctcagtctgatcccacagggagttctggagcctcagttctgtacacccgtatcaatcagtcattggctgtgagctacccacgggggaaggctgttaccttccaggcattttctgaaattgttggcttgaatggaatcctcagggaaagagtgtgaactattagcagccaacactctcagcagctaagggatgagtacgccagctcattgaagagattctggacaggacaccaacagcatcttcagtaaagatgtacttcaatggtaaggacactgaacccagaaagaaggagtcacatgcaagaagaaatggtggaccaagaaatgtataaacatctggctatatctgaataagcactcttatacacaacaataatggggaacaatggctaatttggagatggagggtatttaaaaggcagaatttaaacaataaacattaataaggaatatggggtaattagtattgaaagtttctaaagcccttgtatttctgaggtgaagggtaaatacattaattaaatttagattttattatgtcaagttatacttgtaaaaatttaatggagctcccagatgtagggagtaaattaaacacatgcatcaaatttggtcctccccaaatccagttaatttgtcagtgaatttttttaagtcctgggccatgggaaaataaacaataataacacaattttggaaaattggatgagtgagaaaagacttagcagaactcccaaattaaagtactaaaccagcagcaggaaagccaagaagcaacttgttttacactcaagagccttcaagtgtcaggaattggcagcatcagattcttctggaagtgtggtgaagaggagagactaaaatgagaatgatgcgctgaaagtttatttaagaagcagtcagatcactagatcctttccaatcatgaaaaggtacactaccgcttctatttcccttctctttcccaggaagcatattcacaggagagagagaacaggtttcctgcttggggatcccaagcagagttgaagttgggagcactgtactgaacaaagccagcttaagaaaatgcatgcatactgaatgcccacctctctctactccactatctcgcttgacccagatccaaaatagtagtagcagactttgactcttctgacaggagattggaagaatcttacctgatcagtccaggaggaaaacctaaatgcagtaacatcagggttccctaactaagctgtccagaacttaccatcttcaccaaaacaagaaattaaaccaataaagtggaagatcagggcaacacacccaggacatacacccaggttgggagacacatgtaggagagtaagacagtgaggccagaatgatgctgagggaaagtcccaagatgacagctttatgtcttacgcatcaggcataaagaccaataggccatcagaagaatgaagcatattttgtcaggaagatgaaagcaatgcatcttagtagcttaagagaagatttagagaactggcaaataatttgggattaaattagtgataagtacatagaaaactaagcaaatggtaaaacaagataattagctccagggcaagcaaaaagctgctcaggaaagaaaaatttatcatagtttcctacatggctcagctgtgaacagtttgtgcatagttatattaatgtaaatatattgcttgatatcaaacgcaaacataatatgactgtattgtgagggcgtgaagaggaaagaaggcacatatatggtgggagcagtcattttctagagtgggaagtcagtagataataccaaaaactggaaaattgagaaatataagaaattgagaaatgaatgttttttagagacatggaagtagataccaacatgaccagtaaaagaaatgtaaatgattgtttcaggggaaggaaggagggatataaggctcatgaggaagtatctgatattttcaactatgagtttttaaaatttttggtgaaataaaatctaaatataaaaacaaagatggaatgggaatataatgaaatattcaactaaaaatatttcaatggcaactactgaaagaatgcaaagaaaatatataatttccaaaccagtatgaggagaaaaaagaaaaagagaaaaaaataaaacacttcagtaatcccttagaaaacaggaaagaagaatggaagaagcaaagcagaagcttggtaataaagaaaagaaaaaaaaagtaaaagaggctgagcacagtggctcatgcctgtaatccaacactttgggaggctgaggtgggcagatcacttgagcctaggagttcaagaccagcctggacaagatggtgaaaccccgtctctacaacaaatacaaaaattagccaggtgtggcagctcgcgtctgtagtcccagctacttgggaggctggggtgggaggattgcttgagcctaggaagtaaaggctgcagtgagctgagattgtgccactgcacttcagcctgggcaacagagcaagaccctgtctcaaagaaaggaaggatggaaggaaggaaggaagggaggaagggagggaggaaggaagaaaaaggaagggaagagggacggaaggacagaagagagagagagagagagagagtgagattcaactaaggtaaccaggcaagctttggaagagaagtgtaagaagaagaaagggattttaaagaatgtgtggataagtgtgacagtcttcagccaaacaaactgattcccagcagtcaaagacaagtactcaagcactgcagggccatgaggaccttgagaaaaaggaaaggtggtaaggaaatcactcagagtgggccctgggtgctggccaataggtggtgctgtctgtatggacagcagtgttgtcatccagggcagcaacacagtggaaaggaaatccaaagcttaatgagccattcacatataagaacctttgccagctaagtgttcataatttgagaattacatatatttcagtattcattatatgactcaagatttcaatatttcaatattcaatctacacaactgatatggtttggctctgtgtccccacccaaatctcatttcaaattgtaatccccacatgttagaggaaaggcatggggggaggtgactggatcatggcggtggatttctctcttgctgttctcatgatagtgagtaagttctcaaaagatctgatagttttaaggtgtggcaattccccccttgctcttttactctctcttgccaccatgtaagatgtgtcttgcttctccttcaccttctgccatgattgtaagtttccccagccctgcagaactgtgagtcaattaaacctctttttctttataaattacccattctcaagtagttctttatagcactgtgaagatacaataaccaacacttatacaatacaataaccaacacttaactagtattaatgatatacccctattaagcaaaaggatttcttgagtgaagtaaacccaataaccagtatttcttttcaaaaacatctataaaaatactaggtttctataaaattttccagataccacttgatagtcattcaattgaacattgaatatgctttgtctcaatttccaacattcaagataaatattttttctattttattacctttttcattttatcattaaaattattatatcatattttttcatttttaaagagagagtatttcagtaactttataaattaagtaagtttttgctggccaatttggaaaactaaacaactattttaaaagaggaaaacgcacaccggaatcaacaagtaaaaattgaatgtcatttttattactatttttacttataagaattatagaaatatttggttatttcaattccctatgtgtataactcatcacaatttgataaggagataggtttaagtgtatgtgtatataaaaagagactgaaaggaaaaagataagtagttatctctgattggttgttgggattagctatattttccaaatactctagaatgaatatgtattacttttctattattaattgggttagggattaaaaaaacattagacctgtatgttaaagttgaaccagcatcgtcaggaaggatacaaaaatcacctgccaaacgatgtccatttcaatttactttatgtcctttctaggaccactgtgagcagttgtaggtacctgtgagagtgctcaatgtaaaaaaaaatttctgttaccctaaattgggttaatgataagtgtctaaaggagatgtagatctagcatataagaccttctagataaatttaaagatatcaggaatgaaggctgcagaggagtactttggaaaaaaagtttagtaatgaaaagcaatatgaattgtttcagaaatactgtgacttggagacatgggaagtgtatcaaacagaagtcgaggacagacataaatgaagtgacttgctttcaatacgacagatgtccaagacggaaaaatgtcacccagggcaagaaaatgactcaggctggaataaagaaactagctgcagagagaataatttaatcaggaaatcgaagccaggtacagtcgctcacgcctgtaatcccagtgactccagagcctgaggcaggaggattgcttgaacccaggagtttgaggctgcagtgagctatgattgcaccactgcactccagcctgggcaacagagtaagacctcatctctaccaaaaacaaacaaacaaacaaacaaacaaaacccatagggaaccaagtggaagacttaggatctattgtcttcttttatctcaagctggtggaaatagctctgcatttaaaggtagaaataaggatggagcagatagacaacccaaaactaagagtcataactataaaatacctaaatacatattaattttcaccaagctaaagtgaaaaatgaaatgttcaatactatctatgctgtatttgtacgtatgggatatggtgtgtggtggatactgggctgggcccttgaaactatgaggctaataacactgagaagggaagatgggagaaaaagcagtatgggaggtcttaaagtcttggtaacttcagaaatgtgctaggatttgtgggcagcagatatttcaaaacactaagtaaagaacgctggagttaaaggcatggagcttcagaaagttattagcactgatagccaaccacggtggtgggtgcctgtagtctcagttacttgggaggctggggtgggaggattgcttgagcccaggagttcaaggctgcagtgagctatgatcatatcactgcactccagcctgggtgacggagaccccatctttaaaacaaaacaaaacaaaacaaagataagaagaaaagaaagttactggcactgagagccagacagatgcccaaagtaagagcccattaagaatttccaccatgagataactggaacagtaattttcacattaaaaatagctttcttcctgcacttaaagggatggttcgaggaagcagattctaaaggagaggtgaaaaagaagacatgctctggatgtttggagatacagctataagccaacatcctcggcaagccctgtaccaccccaatgccaccactccctgttccagtgggtagacatgggtgggagcagcatgagtgattacagttagggggctaatatcaccgtctttatttcatcatgtctccaacattctgagaaggacatagtggtcactatccctcaaccaaagaaactgatgagtgcagtaggaacctgctttggagggttcacattgggactcatcaatgtggaaggtaaaaatctgaagatacaattgaaatctagatagccttgaatggtatggacaaggagacataaaatctgcttactaaatcagaataataagatgaaaggtcaataataagcatagaaaggtcaataatggaataataatagtagaggtcatccctagaaggttgaaaacattttcaagtaaatataagaaactccttattgtacgtagtagtgcaggctggaaaaatatacttatttagttcaaatcatgtgacaggcactaggaataaagttagtccctgccctcacagggttcaaggtctaaatggaataatagatatgaaataactcaacaagtaaatagctcagctgttggaaatcaaacaaggagaagaaaagaaaaaggacatagtgctataaaagaaaatctttataaaattcaaaaccatttaaaatatgttgccattgatttccttattaacaggttttaatacctccatctttctctaatagttttcagtttattagaaacagtatgtgaactttttagattaaaaatttccagcataggtttatcacttattatatccttttattccttgaaatggatgattgtcaggcagaaatttaggacaaaggagctggaaaatattcatgagactcaggaacaaagctattactccaactgtaaggtttcattataagcacgtaaatatagttcaaagttaccacatctgtaaactcaaaaatgctgctcacttggctggatccaatcaatatttgctaaccattattttagttattcttcatatagacaggcgctttgtttcttagaagaaatcactgtccataaccaaaaaaaaacttaattgtgaaatggttttatttaaaacagtcttttctggttattgaacatttcatatgaataaattaatcttcatgcatatgatagcttatctgaaatagcttcccaattctttaaaataccaaaggcttcttttctcagaataaggcattttgccatcacgtggtttattagcagaataggaaaattaatcttattctaagcaaaagcagaaatataattagccaaaccaagaaaagtgtgacatttgcccatgaactcttcattcagataatatatctattttgggaactcatgagacagaagcaagacaaaaatatgagaagatattaggtttctctaactattgttcaaaattagaaaatggatgtggcttttatgttgactctttcaatacctatatgaagacagttaaaggatgtatgaaattaaaaagcgacatcagtgattattagtaactacttcacaggaagcaaatgggagtatcattgtagttagtggtatgtgaacgactgattgtactggtttatcttcatgctctcgcctcttctctttaactctacgcagtacatagtatgggattatctttaccacatgcccctagagattctgtttcacttcactcagaacctagaaaccacttgctccaaaacttgaaaaatattaagagctgatgtccccagactgctcctcaaccttgaactcaaaccactaagctccaggataaattcgtttaaaatgattgtgcttaaattttcatgtgggtctaaatttgctgggagagaaagtcctttgtttgtattttcgcatattgagaatatttatcatgattattacactgaagagcctaactattcatttaccccatttttaagatgtagtaaagacattttcctctgtggaggaagctattgtgcaagattttatcacgtgttggcggaaaatttgagtgtctgaattttgtttcacacatgtgttcagctttgcatgtgtatttctgtgtgtatatagaacatagaaaagagtctagattagaagataatgtactgaccacgttcaaagtgattatttcatcacgcaggtaataagcatagtactccataggaagttttttgattctctccctcctcccagcctccaccctcaagtaggccatggtgtctctttttccgctttttgtgttcatgtgttctcatggtgtatctcccacttataagtgagagcatgcagtatctggttttctgtttcttcattagtttgcttaggataatggcctctagctccatccatattgctgcaaaggacatgatctttttcttttttatggctgcttagtattctgtggtgaatatgtaccatattttctttattcagtctactactgatgggcatataggttgattccatgtctttgctattgtgaatagtgctgcaatgaacatacatgtgcatgtgtttttatggcaggatgatttacattccactgggtatatgcccaataatgggattgctgggttgaacggtaattctattttaagtttttcaaggaattgctacactacttttcacaatggctgaactaatttacattcccaccagcagtgtataagtgttacaaaagattatttatgaagacagagattatatgggagtattcttttctttagtatgttcctctttattttctagattttttgcagtgagcataccttacttcatgatgaggaaaaaaaattgttattcctccaaaatgattgagcactttgtatgtacacaatactgcaataagtgattacgggaattaaaaaaaaccttttttcttttttggagctttcaatattcacaaataagttgacgctatgtgataatatttgtattgcctgttatgtatcagatacttctcccatttaatttcacatactctatctcctttaatccaaatatagagaatacgtgtcaatccactccatgttattgtaaataatgttgacaatgcacagagacgcatattttataatagtaagttacaaacacaaggtaaaaataggcagacagaaagctatgcataaagactaaatggaaagcagtctagatagtgataatttttttctacctactaaatttactagtaggagcatgtatccttcccataatgagagaaaaaatgaacttttaatgatttttaacatatatgacagccatggaacaattctgtgctaactttggggtacttatgtgcagcatattggacatttagtgaaaagagagaccactgtgagatgatgaagctggagaaggcttcaagaagcaatgcagggctccctgagtactttaaaggaagggcaagtttctttaagaatgtggaaggaggacaaggaggacgttatagaaagaaaataacttgtacaatagcaacaagaactggtccatttataaaacaggagcttgctcaggtggtggctatgaggattaagtaagttggtgcacctggcatcatgcctggatgaaaggtgctcaggaaatattagccatcatgatgatggtgctggtgagaatggagaagagggatgaattcaagacacagtccaaaggactaaatggtaaacttgttcacagtctggttccttgaatagaaataaaagtgccaactaggccttcattgtttctctcccaagacagcagaaggagagtgcccgtgtcagaaggggaacaggctggggagctgggcagcaggggtaggtgatgagacaagtttgggacactcagagttaaaagtttgggaggtaaaggaagtgtggccagtgaggcggagaacacagaggtggcatcagagaaacaagagagggaagatttttcagggatgtcatcaactcttcagccagcggaatgcaggcggagttgaagaagtggaaagagaagtcccccagtgctatactaattgtgtcaccaattgaagcaccctgctttccctattcttgcatctaattgcagtacgctaccatgaaaccagttcattctgtgctcaatttgctgttctgcttaaagggacttaaacttgatatctgaaggccaactgctacgggccattacatttatttccttccaggcattgtatgtagataagcaattaaatgagggaaaagaagttgagagtcatttatcatggagaaaaaaaaaaaaaaaaccattgaacaaggctgtacaagcaaacctatttggattgaagaaaacataacgtttaattctcagaaacaaatgcaagcatcggtccaagtcttccttcccaaacctttgtcatttagggattgagaagctgagttgggtgaaaggttgaatagaaaacaaaaaggaaagctagaaacacgctgagctcatggagatgcagcttcttctgtagctcctaaagcccagctgaggtatcatctaatgagaattctctctatgccaggcactgcgctaagcatttcacatcattaagcaatgtgagttttaggcaaccccgaagcaggcagtctgttcatcccaattgcagctgaggaaacagggtgagtgaggccaagcagctggcccaaggtcccctgcctggtaagtggcacagcctgcagccctgccaggtggtcccgctaaccaagccggcgcttttctgtcaccatgccgtatcgcctcctgtactatcaaaatgtactatcaaatttacctcaaaagaaaaccctctgtcttctgagaagctccggaaggtccaacacgttgcctgccaacaaaaaaacatgaagagttaaaaattagctatcgtacgtaaattattagccatttacattgtatgtaaattatgtttcattaaactttaaaaattagaaaaagattttcttctggtagatttccttaaaaaagtgttacctttaagttttacacttaagtgacccatgttatctgttttaatgaataattttcctaatagaaaattattatgtggaagacgacgacggtagcgggtggcaatttaggataaaaagtgatcaagtgaactcaggacagcgaactctttctaactgtgcacaaatataactgtctattctcttcctggtggcatcaactcaaaatttcagttcattcatttattcagcaagtatttataaaccaaatgaaccatatgaaatcgccattcttgtaggttaaaaatggtcatatgtgggtaattccaaatagttcaacctaatatgaagaaccctctgtgtggtagaatagataatatcatgggagctgggaatatagtgttgcataaatggaccaaggtcctgcctttatcttgctacattctggtggtctaagacataaacaagcaaaaagatacattaacaaaattatcccaaattgtgataagaaataaacaggataaaataattaataacttacttgaggtgaattgaaagctacactgaataaagagatcagaaaaagtaaggtggatggaacatcagaggaagatcattccagacaaggggagaggcaggttgaacgtccatgaagcagattgaaactccttagcagggccctgctgagtgaggggacttgttattaggggagttcagagaagtaaatggaagtgagttttgtagggcttcaaggaccctgacaaagagtttgaattttattctaagttagaagaaagtcactgaaggctttttgcctaaagagttgacatgattcagttaatgtattaaaatataacttatggtgacgggtacagtggctcaaacctgtaatccctgctagttgggagggtgaggcaggaggtttgatcccaggagttcaagggcaacagaaggagaccttgtatcttttatatctatatctatatccatctatatcttatgggtaaaggaaatattctatatttttatcatagtggttacatgactgaatttatttgtcaaaagtcactggaatgtatacctaaatatgtgaattgctgcattttactctatgcaaattgtacctcaaaaaacctaaccaaaaacaaacaaatgaaaagataactctgagctgaagccattaaaaattatttatctggaaggtattggtatgtcttgtttgtttgtttccttttggtggtatcatttgttgaactctgcctgcttaaactctgcacatgtattttttttgtaaaattaaaattatattttatgaaagataactctggctactgagtggagaggaatttataagacagcaagactagagactgggagaccatttaggagactatggcaagaaatgagactatggcaagaaatagtcgtggtggtgatagtggaactgagaaatgggaataacattaaaaacataatttggaagtagaactgacaacacttactgatgggttggatgtgggcagagggggtaaagaaaaagaaatcaaggatgacttttggggtgggggtgtccacatggacaaggcatggttgaaaagagggaacaaacagttcaatgaagggtttgttttggactttaaaatatttgaggtggctatttattattcatccaagtggaggagtcaagaaggaagttggacacataggcctgcagttgaaggaagagatgaggactaaatctgtatgtcatcagtatacatacgatgtcttagtcactttgtgctgcacaatattacagactgggtaatttataaattatagacatttatttctctcagttctaagggctgggaagtccaagatcaaggcaccagcaagtttggtgtctgatgaggacctggcatcttctcactgtagcatccttacatgggagaaaggagaagaacaaaaagagcttagctagttccctccatcccttttataaggttctaattcatttatacaggcagctccctcacgacctaatcacctcctaaaggccttgcctcttgacaatgctgcattggggattgagtctcaatatgaattttgaaggggacatatacattcaaaccatttcacatggtatttaaagccttgggctggattgagatagaagaccaagggtaaagaagagggccctatagcactacaaatttggaagactagtagggaaggaggatcagccaagcagggagacccacattgtctgttccaagaggtatatacatttaaccctttgagtgttgaatctgtgaattagtcagtttggctgccataacaaaacaccatagactgggtggcttaaacaatagatattaattttttcacagctctgaagagggaagaggaagatcagggtgccagcgtggttggcttctagtgagtgcactctgtgccttgcagacagctgccttctcactgcacgctcatgtggcctttcctcggtgtttgccatagagagagctctctctctctctccgtctttttatgaggctacagtcctatagaattagggtgccacccttatgactcctgtagccttagttatctgccaagaaccctatcttcagatacaatcacactgaggattagggcttcaacgtatgagtttgccaggggaggacacaattcagttcatagtaacctgcaaggagacatatcaggggcacattcttgtcacacggccaaacttccattgcaaaatgactacattacaatggatctttatatgagtgtctagcacattgttgcaattattcgatgaactatcattttgaatttgttcagctgcacttgtggaagaggaggggtaggagatgaaaaagaagaagaagagcatcgattgtgtactcactctgtatcaagcactgttctaagtacttttgcatgcatcactacttcgtccagtttttatgataaccctttgaggtagatattttgttttacagatgaggaaacagaggccccaagaagttaaataacttgcttaagatcacagagctaatgagtggcagaacaattattctagctctgattttaagggatttacttaacttttacttggaattcatggagtcattgggctttatttaataagtatctcatcatattctagttatatcatctcctataagtgttcaaaatttgacaaaattcagatcaaaggtgttttgggggcattttggtgtcagaagccatgaggccattaaaactcatgagggctgctttagtttcctagggctgccataataaaggagcacaaactagaaagctgtacatctgaaatcaaggtgtaagcagagccgtgtttcctctgaaacctgtaggggaatccttcctctcttcttagcttctggtggttttatagcaagctttgacacgtagtgaaatctgacacaaattaagtacataagaagctgttccttggttttcagctgcataactccagtctctgtcttcatcattgcatggtcttctccttgtgtgtttctgtcttcacatggccatcttctaataaggccaccagtcatattggatcagaggcctaccctactccagtatgacctcatttttatttaactaattatatctgcaatgatcctatttccaaataaggtcacattctgagatactgggggttaggaagatatgttgaagagcatgtcttttttttcggtgggggttggggaggatacaattcaacccagaattccagacaggggctttgtggatagagtttataatcttaaggaagcacatcccttatttcatctccccttttcccaatcctaacatccacagaaaatttcctgccagcagttccttccttgggtttaaggattccccaatgccagatgttaagtctgctaggaaatctgtagaccacagggaagaaaatgcaaaaagaaaataaagtcctcaaatgcagctaaaaattgctagcttctatttttaaaataaagcaacataatactttttcttccaatttatctaccttcaaaagtcccaacaaatgttgttcgtagtactgaaatctatcatttccctttattttttccattcttcaaattgagctattaagtcaaatgctaattacatgaaacattgttctctgttaataaacgttttgagaagttctgccgcctcaaataaacaactaaaacattaagtcagtgtggcatttcagttgaatagggaaaaactagattacttaataaatggtacagcaatatttggctaaccatttgggaaaaaataaaattagatgcctacttcacaaattaaatttcagatttgttaaagatttatatataattaaattaaagacagatccttaaaattcaataaaattttaaaaattgcaaaataaaatatgtggctatttagtgtatttgggtattgggaagtcttttgactagttataaacactaagatataatctacaaagagataaatcaacttacaaaaaacttaaaacttcatggatatatagaaagcagcactataacatggaaaaaggaaagatgcatacagtatatgacaaataatatgtttatattatgcatataaaaacacttacaaataatttgcaaattaatgttccaacagaaaaatgagaaataattttaaaaggcaattcacaaaagaagaaatacaaataaccattaaacatatgaaaagatgtttctttttacttaaaaaacaaataggatctttcaggcctctttcagttctaacacactgtgattctgaatacaaaggtttcagttggaacatttttgcatagatttgcccttgaactgatcctccagtgcaaaatactttaattgctaacgtaaagtttcataaaagcacataaatctcatttattatagttctaatatgaaaatctggatctctttagaaccagctttattaggatctcttggctgcatatgtcagaatctcaactcaaactctcttatgaaaaaaattcagcagatgtctaccacctccacacattcctacatccttaatctccctgtgttttaaaactctaaatgagttctcttagaaatataaaggcaaagacacctcattcttctctcttgctgagtggagaagaattaaattctcatacttataagtcgaacagctttaagtagaatagacatggagggccagctaacctctccagcgacttcctagtaatttaacttttcagttccagaagtttctagaagaaaaccccattcctggcttaactcagcctataacctgagcctctagttgcagctcactgaagcaccataagaatagcaaccatgtgtttagaacagcaaccatacgacagcaaccatgtgtcatggcttattctcatcaagcctccaggttgtagggagcttcggtgattatatttttgtttaacagccctctcacccaccctcctcttgggttccttgggtaatcactccctctctttccatgtggtccaggcaaacctgtcaatcacaacatcttcaccaccttccccttgccaaaggcttacaacccaagccagacaatcagaatgttcctagggttggattaattgttgttaggagaaaggcacttttagccatggagcaggcaaactcaggatgagaagctgggctactggtggccaaagaaagtgatttctcacaggagaagttgaggaaagaaacagggaggcagggccagagatgatgagggagacagagaactccgtaaacaggagtaccgaagtttgttgtagccccggacttcccagatgtgtaagacaataaattctctttttgcttactagcttgaattgggtttctgtcatttaaaacctaatggctccaacttgtgggcacttctgacttacagggcagctcccacagacctcagtagctttaccagtcttccttgtcttgtgagctaccatcttctactcttttgggagtgtgcgtgcatgcttcggattatcaaatgatttcaatgacaacaaagaactgattgtagttttgttcttccaaaaattcatctttcacttccaaagaagtgagatgtattttacacacacacacacacacgcacacacgcacacacacactgcatttctgttgggtccactgattcatgaatttaccctgacactaaacattcctttccattctagttttcaatacagagccagtttcagcaagcttagaatagcaggttctttgctgaaaaaaatattttgtttcaggcaagttctgtcagttgatgattgctatattacaaattacccccaagcttaccaattttttttttttttgagacggagtctcgctctgtcgcccaggctggagcacagtggtgtgatctcggctcactgcaagctccgcctcccaggttcacaccattctcctgcctcagcctcccgagtagctgggactacaggtgcccgccaccacgcccagctaattttttgtatttttagtagagatggggtttcaccatgttatccaggatggtctcgatctcctgacctcgtgatccacccgccttggcctcccaaagtgctgggattacaggcgtgagccaccgcgcccagccaagcttaccaatttttttaaaaaacaaatgtcatctcacagtttctgtgagtcaggagtccaggagcttcttagctgggtggttctgcctcagaatctcttacaagacttcagtcaaggtgtttgccagggctgtagtcatctgcagcctcaactggggaaggatttgcttctgcactcactgccacggctgccagcagtcctcagttcctcactacgtgggcctctccacaggctgcctcacggcatggcagctggcttctccgagtgaggagtttaagagtgaaaaagtgagcacgcacctcccaagacagaagccacagtctttcaataacctaatctcaaaagtgacatttcatcctttctgccagatctatctgagtccttatgtccagcccacactaagaaaaggggaatgtagctccatctctttgggagagaagcatcaaataacttgtgaatatatctttaaaaatcaccttacaagtggtggcgctcgcttccccaaagagaatctgagttctttctaaaataccaatcctttgttaaaatgagatggagagtagatgagggaatgcagcggcaatagggaagacaactattccaggcagaagagaaatgctgtatcatccacacacattcctcaacatacctaaagctacctttaatggttttaagtaagaaaatggctgagggatttaaaaatctttactgggaattagaaagcccctagcaatacaactcagtaaactggcattaagatacagccatgcgattatcgtggatgggaaaacggcaagattgtaacaatctgcaagcatgttgattgatcagagttgcaaagtactatcagctggccgatggcatacacaaagtgcagaggagctctcaactctgtaagaagaacaatgccggaggagtagaatagctatccttagcccaggtgctcactgcccctgtcacgtatgctcatgccacacctgagataccgggagggcagcgtcttgtcctatgtcctcccattactttcattcccaaagtatttctgcctatagagctcttccggcctctaaactccttccagctgtgtccaaccttttcaatgcaaggactattttgcttatctgtggtggtggatatcatgaaaactatgcatggacctttttttttttttttttttttttttaggtcatcagctattgttagtgttagtgtattttatgtgtggcccaagacaattcttcttccaatgtggcccagtgcagccaaaaggttggacacgcctgcaatacttagtaatgtatatcattcatgtggtgataaatatattcagacgaagaataattctttttttaaaatgtaaaatcacaattatttgatgtttttcatttgtgaatgccttttacacgtagtccctacatttaggtgctttggatgcatgacttttcactagaccagtggttctcaaccttggctgcacattagaatcacctggaagtttctttccattccaagattcaacacagaaattaatagaatactgaatcaatttcaatgaactaagagtgacaatttttactaaaaaatatttacttagcaagaagccaagattgactgttgttttagagtctttctactcgaagtgtggcctatggaccaacagcattcttatcagatgataagtgagctgggagcttgtgagaaatgcagaatcccaggccccacatccaaattataatttgcattttaacaagattcctgggtgattcatacgcccattaaaatttgagaagcactcatttagactttcccattacccttctctttatcactctgaatattctccaacttcctatctagtgaccacagagggtactgacagattacagcttcaaagcataaccaggatcaatagaatacattcattctttcattccagaaaaatctatttagatgtagggccagtgcctatgcttgtgcagactgtgcaccacatctgggaagtactattcacaatgtagaaattttacatttggattttattgctacaccattttctagcagacggcagtacagtgtcttgcaacaaaatcaatacacataagctttggctgaatggaagttaagtgcttgaggaaggaatgtcttttttctattcaatggcctataggctagatgtcaccttaatgggagccaggacctggcgacacagcagcaaaccagagaggccaaattattaactatttcccatttaatacaatttgtttattagtttttatgcaaaattatggtatggtagtttttaaaaattcaacgtatgtggcatattttccttccattgcatacgatatagcctacaattttaatgtttaatatacaaaacacagcttgtgtttttttcccttcacaaagtttataacaaatcttggagcacaatctgtaattacaatacatcgtatgcagaaattccagccactttcgagctttatactttatggtgtagtttccaagtacacgttatagcagaagtgaaagaaaaactctatttttctgaatattctataattcctgtcatcaagtgccttggatgtggacattagagatcagtcaatatttgttttaaaacagtattttcaacttcttttatatacttttctgtctctctctctctctctttctttttttccctaatggaatgctctgtcctgcttgccagttttggtgcagagaagccaacaaagatttataaatagggatgctcatgacatcatgatttatgacaggtaaaaacaggaagcattttagatttcaaacaaaaggtagttgatcaaatatatcactacacatccaagtaactaaatagcacatttattaaaaacgatgagtctaaagaataattaatatcatagggaaaacatttatgtaaaatgttaagcaaaaagttttaagaggttaaaaggaaaaaaaaaatcagggtgcaaaaccacatacatagtgtaatctgaatgtccctggctccttgctacttagctagtctacggactagcatcatagcatcaccaggagcttgttggaaatgcaagattttaggctccaccctaaaacccactgaatcggaatcttcaggtgattcttaggcactcgaaagtctgagaagtatcacccaggccgtatcaacttcggggaacagtggtcagtttacttctacaatttgaaccaaagttcattagctcattagcaccgacctacctaatgcaggaccacagtccccctccaagacacatccagtgtcttaggcaggtatctataagtataaactcaggcactggggtggtggccttacctgtctctcaaaatccccaagggggaaatgctgtttgatacaaatgattatttgaaaattatgtcaaagaaagggggatctatttcttttgccctggcaatccctcattaaatatgccttttatgtcatctctgcccattcgttttcctttcggcttcctcctatccctcacacatgcctctcctctcttacctgagaatcctgagagagtcgaggaggaaacctggtattccagagttaggagaaacgactgtgccctcatgtaccatgatggatactatcacagaaagcaacatgcatgctctcccaccatccacactgggacgtgagcatcactatccctttatcatcccaatggccactttgctgcagcaccaaccttgctgatgtgacccattctggtccactgctggttaaaaactcccctctgaccactgcccacatggttggatcagtccaccgtggacccaagatgtgactctcactgctttacactgccatgtgggactctataaggtcactactctcctgataggcatgtgggatctgcagtgtgggatcccccatgcctaccgagaaggagaaatgggggaggatataggtttaagtagaaattagacaagggattgggactagagaacatttctcctgagagttttcaaggaaaatgacttgcctggttatgttcaagcataaagtatataatacaatagaaaacagagtaataggagttaggaaacgtagtgtcttgtcttggttctttgtgtgaccttggggaagtcattttcagatgcttatttttccccttttggaatgctgggtaaaaataattgcacagtccatctcccaattctggttaagttcaaatgagatgatgtttggaaatgagctttgaaatcccttaggtgtagcattagcaccattaatatgcagcaccatggtaagaaaaaaagacagtctgttctttaaattggcctcaagaaaatttcacacctggatatctggtggaacctgcaaattggtgttgtatattttaaagtcaagagtaaccttggagactggtctagattgaaaatcaacagtacattggagagtgatacacagctcctagctggtaggggaaattgagggcatccagagtgaataaagtgtttattgcggtggagtgagcaggggggagtagcattatgttctaaaaacattcaataaaagaatagccaccttccgttttctcaaacatctatgcaggtgcttagatcccaaatatggaagattttgcatttcacaaggtatctttcattctacatagatttgtagcaaaataaaaatcattatacattttaatggctttgttgatttggttaaattagctgaaggcattgttgactgcacataaaatccatttctcaaagttctttagctttttgaccctttcatcaattcttcttcagttctgtcatcattctttccctcctctttcaatttcctatctaaaatgttccaaaataattataaaagtcagagaggcatgatgaacctttttattggaaagagatgaaccttccaaactcattctcagctcatcatcacagcatttggaatatggagtaaaaattcatattttgcaagtgccttggtgcttaagcatgcagaacagatgtttcatttcacaagttttcccaatttattacacataatatctctatttctgtgagacaaacactgctttggggaataggcctctccatttcctccagcaagctaaggcatggaaatggactgttgagtcaccttctagtcacctcaggagaggagatttttcaaatgctgtttgtttattttcatgcaaggtcatcaaggggaaatagtcacagtcccatactccttaccaaaggccgtcacttctgcacatggcatttctctacctgaaatgcattcaattaaatgcactcatccttgctaggcctggcttgatttcacatctgtgacggattccttgatgaactcgacaccgagtggtttcttccaatagctaaataatacctgatgatgacattattttcatcattaccattagcaacttaggagggagaaaggtggtgttgggcagggaagtcacactaacctcacctttccctgttgcactctaaattccgagggcggggtggcttgcacagtgcctttcatatgattggtgttttaaaaacattgcttggttgattacataggatagtattgctgctttggtagcctaactttgctcctacactacggccagaagagagggtgaagaagaaataagaaaataaaaatcaatcctaaagaaagtggtaaggagcaaaataggagttatcggggaagcacaaaaacctgaagcagataaccctcaggcgtgaaggcctatttctctcctggtttacacacgcacccacctccgtttctctcctacttctccgccaccccacctcaaccaggaggcaattccccaaccaaccctgaatatgtcttctaatttcatgtactcaataatacccaaaccatttaatctcagtcactgctggtgggagcggcaattgacacgaccttgaagggaaagcaacttggcagcagatatcaagagttctaaaaaacatttatactcatcttctccataattccacttctgagctgtatcctaatttttaaaatcttaaatatgtacaaagatttatgcccccagagtttccaatacaggtttatttatacagagataggaacagtgcagcagtctagcatcagaaggagtggctaaattatgggatgagtctctcactggaatttttctaaagttattttaaattatgtcttaaaggcatttaaagcttattttatttttaaatgtttttaaattagcatgcaataaaattgacctttgtctacacagttctatgaatttcagcactcacatagggtcaggaccgagtttcctctcacaagactcctagccccaccttgaaatcaccggacgcgcttcgttgtccaggagccttctcgaagcggcgggacgtctccggaggttgggtggcccggtcagtccgcggcacacaaggacctctagggggcagtgttgtctcacaccacatgttcctctaccgggctttaacacacacccttaaactctaacccagccaaagcactattgcgtctgtattttccaaatactttacaatgagtatgcactactattacaatcagaaaaaaaatattagattactaataagctattgaaactgggggagatagcaatataaaaatacccactcatggaagacactgcttaaaatagagaactagcctctgttcatagtctggtttcaaagcccaaagttacgtttccttttgttagattgctagatgatatggctctggactttaattctccatgtttaaaatagcatttctgtatttaaaatagcatttcaatagcacttttaaaacttctaaaatcatttctgtaatactcttttttcagtgagaaatagaacaatgcttcttccctctctattttagagatagcaaagcgctaaagagatgaatttgtgttagaacatctatatattaattcagaatatcctaataagcaaaaggatattgctaacaatttgtatgcagcaaggcataagttttggagtcttctcaatttagctattccacttatgctagttcacccactcccttcctgtgacgggttccctagtgatgaatggggcatgtagattatcagatgagtggacaggaaggaagacagtctagagtggaagataaagataaccaacccatgatggaaccaactcagaaatcaaccccaccaagagaaaactttattcatgcactgaatatttatggaacacctttcacttgccaagcactgttccaggtgctggggatatagcagaaaactgcacgtcaaaattgctgctctcataaagttcacattctgggactctaacccagccaaagcactattgcgtctgtattttccaaatactttacaatgagtatgcactactattacaatcagaaaaaaatattagattactaacaagctattgaaagtgtctcccactgggtgggagacagctaggaaaaagaaataaagaggaaaaatatcctcttgaaagttaaaataggatagagacggattggtgggggctactttagactgcggagtcacagaggacctctttgaggaagtggtaatttaagatgagatcagaataacatatccagccttgagaagacaagggggtggagggagtgttccagggaaaggagacaccttatacaaaggctggaacaaattgaatgggttcagaaaacaaaaggaaggcccagagtgactggagcgtggcatttagggatgaaggtcaagtcagaaaagtatgtaagagtctggtcaagtaacagtctcgtaggccaaggtaaggaatttgggttttattttactgcagtgagagatataggagatttcacacagaggcgtgaaatggtctgatataggtttctaagaaccattctgatggccattagaaagtgcaagtttgggaatatggcgatcactgagaaagctatgggaccgtgcatggtagatcatgcctgtaatctcagcacttcggaaggccaaggcaggaggattgcttgaggccaggagttcaagaccagcctgggcaacacagtgagacctcatcgctacaaaaaataaaaacataagccaagtgtggtggcatgtgcctgtagtcccagctactcaggaggttaaggcaggaggattgcttgagcccaggagttcaagactgcagtgagctatgattgcaccactgcactccagccagagcagcagagtgagaccatgtctcatataaaataaaataataaaattcaaataataaaataaaacagaaagctatcacaataactgaggtcaggtgtgatgaagtgtggaccaggattatggcggtagagatggaaggtagctcacagagtcatgacatcttttggagaaggagctgttggaattagctgtattattagatgtacatggttggggggagatgaatcaaagcacgattcctagctttttagtttgaacaactgaaaggatggtagctccatttccggagatgagaggactgaggagatcatgatccggggggaatatttggtctttaacatgtgagcccattggacgagcatttgggtaacttcagtcttactcctcagcagctgctgttggcagggtgtggtcaggtaggctggcactgtgtctgagcaagccagctctggtctgataacagagttttatctggaaggggaaacccagggctgggcttacgatctaaggtcagcagcctgtcacaccaagaaataaacatctgttaaggcaattggtacataagcactcagaaagtgtagcttgtcaaagtggcttaattccaactaggttgttattactcagttgacacctcttgggagagttttttgatattttctttaactctttagtgttatactttatgtatattcacatgaattgaaaacaggttcagttaaaagggtaattaaaaatataaaacattttttaaaaaagaaaacagggccaggcacggtggctcacgcctgtaatcccagcactttgggaggccgaggtgggcacatcatgaggtcaggagatcgagaccatcctggctaacacggtgaaacctcgtctctactaaaaatacaaaaaattagctaggcgtgatggtgggtgcctatagttgcagctactcgggaggctgaggcaggagaatggcatgaacccaggaggaggaaggagcttgcagtgagccgagatggcgccactgcactccagcctgggcgacagagtgagacactgtctcaaaaaaaaaaaaaaaagaaaacaggtacatgatgtagactctacattttaatgtaatgtttcattaattgtaatgaaacattacaatgtttcaacatccttgaaatttaaataagggaagctttgggtttccataaagagaacacttatacttaaacacaagaaggctgagacaaaggttaaaaaatggtaaagctgtaaagggctgttaaaagcataatgctgtatttttcatcccccaaatcttaaaatgtaaaaaaatggctttagcttttgactccaaagctggagattaattttttaatttttaatttttgtgggtacatagtagatgtatatatttatggggtacatgtaatattttgatacaggcatgtaatgcataataatcacatcagggcaaaaggggtatccatcacctcaagcatttattttttgtgttacaaacaacccaagtatactcttttaattatttaaaaatgtacaataaaattatttttgactatagtcactctgttgtgctagcaaatactatatcttattcatcctttctaactattgtttgtactcatcaaccacacccacgtacccccgactcttctcctactcttcctagcctctggtaaccatccttctaactctctatctctatgagttcaattgttttaatttttagctcccacagataagtgagaacatgcgacgtttgtctttctgtgtctggtttagttcacttaacataatgatctccagttccatccatgttgttgcaaatgataggatctcattcttttttatggctgaatagtactccactgtgtatttacaacctttcctttgtccatttatctgttgatggacacttaggttgcttccaaatcttggctattgtgaatagtgctgcaataaacatgggcgtgcaaaactggagaattttgaagtaatacatttactcctacagagatcctgaataatcatagttcttgattacacccacctcctcttcattattttaagtatttttgttaattactaagttgatccttctagtaaaaaggctgccacaacttcgtttcctttggaggactgagaccttcccaccttagcaagagctttccatgttgaggtttgcagtgagagtcacattacccagagaactgaggggactgcagttatgcccttgcagatacgggaacacgagggctgaattaatgagccagagccatagacaatactgccaaaaagtcccaagttcccccgagcaaatacccaggaaggatttgtctggatatcaccttcacctcctacttagaacagggttgccctgaaagtccctccacccatcgcaggagaagaccttggagagtggctagcagaattcaggcaaattctttgtttctgcattctatttgagcagcctggccacaggccaaggaaaactctcttggagaatagacattacctgtggagaatgatttgagaaactctgatccaggaatatccaacactacagtggcctcctggggtccctactaaccggtcccctattaatctccctgccctgatttcctaccatcctctccctcactcactctgctccagccactctggccttcctcaaaaacagacagacttctaccttgaggcttttacatttgcctagaacactctctagcttgctcgtttacctgcgtcatgtcttggctttcatgccactgtttgaacaaggcccacccttattaaccccaatcaatattgcaaacttccccttcaccactcaccctcaccaccctcattattcagctctttttttaaaaaggtacctattatgttctaatacatatcactggggtatgttttatatttattgtatattgtctatctcctcccactagaacacagctccacaaagggtgaaatgtttgcctgtttcttggttgactgctgttacccctgggcctgcatcagcacctggcgtatagtagactctcaagaacagctgtcgattaaatgactgaatatagcacatctgggaaaacaaaggcttgatttggtccctgttttcaacactagctctccctcccccaggactggtcctctcctagcactgccagcctctgccagtccttagtgggacatgacctgcccttgcccacacacctactcgatcctcactcagtagtcagcatccatatcccactgtgactgacccaggcacacagtgccagcagctcgtccaaactggaaactcttcaagtctcaaagtcttttatcagtctattacttgtccctgcattctctcttctgtccccctcactgtagaccttcagacactcaccaatttcctgttccctctctcagtccctgggaagaccggcagtggggtaggacgccaatctccccagctgctcttccaggctcccctgccagaggaggcctttggtctgtgatttttctgccaattattagaaagaaataggcctgggataataaaaacaaccaaggaggaatttaaaaggttatgaaatcttttaaaattctgttttctcaattgtattttctcatttgtacttctcggctcttttttgagacgtttacatagaatcatcatctttccttatatactcccttttggaggaaaaagtactttcagagtttctcaattatgtcaaataacagaaaacatttattgaacaattactatgtgctcagcaccataatgcatttctatgaaaatgagctcatttaatcctcacaacctctcggtgaagtggatgctgtcaatcttcccatttcatggaggaaaactgaggcccagagaagttatatgactcccgagtttacacagctacctagtggaggactctaagttacaacttatctaatttgagagttcaaattttcaactgctataaaatatctctgatacatgagagaagctggaaagtgagatcataaccaccagaaaaatactacttgttagtgcctcagaagaactaccactggtgtgagtagaattacaacactggcaacccaaaagagatacgcatgtcatgttgtctgattttggagacattcttaattttcagtggcaggtgccatacatttattcattgagcaaatgttttactgagtacctttaatgtgacaaaaagcctggccactgcagaaacaggtgagcaaaagcaaacacagcccttgcattcatacaacatatatttcttcttgaaatcaagttcctggcactaggtatcaatagacttgaaaatatgcataaccagctaggtgcagtggctcacgcttgtaatcccagcactttgggaggccaaggcaggcagatctcttgaggtcaggagtttgagagaccagcctggccaacatggtgaaactgtgtctctactaaaagtacaaaaattagccaggcgaggtggcgtgtgcgtgtaattccagttacctgggaggctgaaacatgagaattgcttgaaccagaaaggcagaggtttcagtgaaccaagatcatgccactgcattccagtctgggtgacagagagactccatctcaaacaaacaaatgaacaaaaaaaaaaaaaacaagaaaatatatttagcctataaccaagaatctcatttctagaaataaaaataatctgaaacacaaattaattatacatatttatcagagcattatttgtaatagcgacaaattagaaacaactcatgtccaaccagtccaactcaatgattaccagtaggtaaatcattaggtaagttgtggtacatccacatattgaaatagtcattcataataatgttttcaaaaagttttaatattatgaacaaatgcttaaattataatgttaaaaatgagaaaagtaagctataaaacaatctgtttagtatgctttttggtacataaaataatatatatgacattatttggatatgttcgagtaagctatatgatattaacatttttataggtcaaaaggatcaaatatcaacaatttcataatggaaaaaatctgaaaacaaaaaagccaaaatattaatggtgatgatttcttggtggtggtatcatcagcaattttcactcttttccttctatttttggcattttccagttttcaacaatgtacatatatttctaataaaaacattattggaaaacaaaaagagaacaaatgttcctctttcagctactttactaaatcataatgctaaatgcagtctgactgagtacctataatccatcatgccagtaactgcagcaaatgtagcaatggcctgtaattccattttatacatactgcaatagatattcagcccagaacgatatttcaagacagcagtttctgaagcagggagttggttcagataaaatagatgccagactatcagtgcttcatagccttagagataggttgctaggacctaactcataacatttccaagaaagctgcataaacttcttattgatgatctcaattacttctaaagcatttttgagaaaaaatatttttaggaccaaaataaaagtaggttataaagtcctagctcttgaggacaatggggagagaaagattttatatgctggaaagaggggttttttttgatagattatctgaaataacatatccttcattagtcagtgctaatgaatagtcacatctgttttcatggaacaatggagaattacataattaatagtttattcttttcaaaatttaatataactgctccttttacacttacttttaactctgtaagttattctcttactgtctttatatgtaatataggatacacttgcccaaaatcttgtagaatacatgagaatatacatacactaaaatgtgtatgtacacatatatatgtatacatacacacacacacacacacacacacacacacacacacacacacacttcacagtttaatgagtgcttactatatgccaagtactatgttgagactaggtatagaccagtgagcaaaactgacatgtctcttacagcccagtagcagagacagacaaacatgcaaatatatgcaaaattattaattgtgagaaatcaaatgaaagccaagaataggacactgtaagaaagaattcggctgaaggagaattagactggagagaacttggaatctgaatcaacataggatgatgtctctaaggagaggacatttacacaggagaatgagtggaagaaaaagtctcctgggcttaagaaaagaaggtcctgactcagtgataaggagttaccagtattaagagaaggtcagtaggcccagtgttttcttgagcaaggtagagggtcatcaaatggtgtttggaagggaggcctgggccatgtgactcagaagtctacaggtcctgtggaggatttatcctaagtagaataggaatgtgctaaagtatttgaaacagggaatggcatgactagagaaacatttttaaagcattattctactgaagtattctactgggctctaatggttctactattgtattgggtgaaattctgtgatgtctggtgtttgctttaataaatattccagatataaagaaagaaaatgtgggagtgccaagggaaatgataacagataaaataaaactgtcaaaatattgaaagttgctaagactgggtgataagtacatgggaatttgttatacatctccttgtgttttggggtatgtttgaaattttttaaaataaaaagctttttttcaaaaagataaagagtgagctttggctctgagattaccagttcaattctgccacttactattaggtatgtgattttagaaaagtgatttttcttctataatctttagttttcacatgtatggaatagtgataatgacagtacatacctcataggcctgttaaatatattaatgcaataatagcagagagtttggctcatagtaaaaatctggggaatgttaactattattttagaattaactccaggcatatttattgtgtgtatatatatatatatatatatgtgtgtgtgtgtgtgtgtgtgtgtgtgtgtgtgtatatgtgtgtgtgtgtgtgtgtgtgtatatatatatatatatatatatacacacacacacacacacatatatatttgttttgttctgttttgagacagagtctcactccatcacccaggctggagtgcactggtgtgatctcagctcactgcagcctctgcctcctgggttcaagcaattctcacgcctcagcctcccaagtagctggaattacaggtgcatgccaccatgcctggttaatttttgtatttttagtagagatgggggtttcaccaggctggcctcgaactcctgaccccaagtgattctccctccttggcctcccaaagtgctggggttacaggcatgagctatcatgctctgcatatatatatgtatatgtatttaaaccattctggtgtctgtatggaaaatggatgggagcaatgaatggtgacgtaaaagatcagttaagagcaattggtgagttcagctgagtagcactggagcaatggggaaggagtgacatcgattaaggagccgctggaaaatggatggtgctgaaagccctgcaaaaaaccaagatctcctgagatagttcccaggggttcttgactcctccaacttttttttttttttttttttttttttgccatggactcctttggcagtgataaagcctataggctccttctcagaatgatgttttaagatgcataaaataaaaggcataggataacacagaaaattatcttgaaatacagttactaaaatgtttaaaaagtaattttcgatatagtaaaaagttttttaataatgtattaagtaactagatgcatatatatttcaagctatctaagtataatgtgacataaaaatattgattctttgtattagtaactgtcacagttcagtttccccagaaagcagaatctaagctggagattggcatttggggagtttgctagggaacgctcttgacatcaacatgagggaaggcaaggtggaactggtcagagaaggatgacattgagctgtgatgaagtctgagaggaagcttcagccaaccttacagaaggtctgaagattatatgacccttcagaagtgccctgaatcaaagagggccaggtgtttattacccagctgaggtggctctctgcaactgaggccatttccctggggctgccagctgagggcactctgccaacagctttcatagtagctggggtaagtcctcatttctgaaagaagatctaggtgtaacattataacatcaatcacagtgacaaatttataggttctgcaagttccactgtggcttgctgcctacattcacagttgaagaaaagactgaatttcggttagagattagtggaaatgaaaatgtaattttaaaatcctatccaaattcacaaaccccacatggaccccaggttaagaatacttgtgagtgagaatggggccccatattcagagaggctggtcaggctctgttgtttgctggaacacagtaagctgtcttctgctgtagggaaaaatgagcagattgaacctaagcattaaaataaaaaaatgagcagggaaagtgtgttttccagagcaagaatgatgcccaggaacaaagcaagtcagacaggatagagtccacagtaccagagaaaagacacagattgatgtgcagctgcctgagtctacttttgaattacagattttaatccttcatgaaaccaaacaatacctccagttcttggtgtagaaacactcctatgtctttataatgttattttctcatgtaagctagtttaagtaggtttctgctgcttacaagctgacgtatcttgttgaatacagagatactttaaaactcctcccttaacacacacatacacagaaattcttgaaatttgcaggagtttggggtgaggagcatctagcaaggaacatggagttgggaatggttgaagcattgctgctgggatctattaaggctctgagctctccatgaaagtattggctttctctttgatggcctttgctgtattggataactcacctacaaaaatgacttatttttaatgtagaactgtgataaacttcaacattttgatgattatcatgctttaaaatgagaataaagatagctattatattttttaatttgacagagtagtgcaggcaataatgaaatggtattcatctgaatagcaatctttatttttaaaatccaaaggcactcaataatgtgatctgtgcactttgctattatgatatatagcatataaaatgttaagcacgtctaacatttaattcatttcaatcataccagtctgtcaagatataataaatcaacaaaaccaacaactccctcccaaacattaattacctagtgaactactcttagcttttttatttagtcatgaaatttgaaaattacctctgaattagcatagctattcacacattattttccccaacaacaaaagaaatgccactgtaacagctgcttcgtactttttaacatgaaattgatgttagtgacagattttcaagcatgtaatttgtctcaacatgtgtgtccttttatttgtaaaaactcccaggactgaagaatgaagtttcaaaaagttatttattgtgtctcctggcagggtagaatccatggaaaacaatcaactaacagaactgtgtgatggtctataagatttggaattataccattgttatagaggggaaataaaagacatttctcctgtaccagcttctcctcccccaccacccctagtaagaagtggaaaatgaatataccaaatgaacatacttggatttgattttatgatttgatttttatgatggaacgtcttgtaaatgggagcagattcctaaaaaaattacagtgccagcccagttctaagcactgcatccccaattactttgaaaagaggctcttgtaagccaactgtgcagtcacctctgattataaggtttggaaggagtatcttccaggacctacccttagcctgattcagcagatgacaatccatttccttttaaactttttttttgcatcagaagatgcagtaagttgtaagtattacacagaatacttaggcacagaaaacacaataagtagtaagatgtgtctcttaaggggctcacaattaagtatgaaaagagattattagagaaacaaagagttaaatcttctaatagaggtggtggtagaaaggtgtgttgtaaccagtctctggtcaaaatgaaaccaatttcggctagaggaagcagggatctggttatacagaacccaaaggacttaaagttggtgaaaaaaggaagcagcaagtagagcaaagatgggttgtccaactccccttgattgcactctctccaggggagggaacaataaccccttactccttgagaccagtcaacatgtgtttgcccttgagatagctttccctagtgtctctggggagctaggaaacaacaggttagggtctttgtaattcttgcctctgccagggccttggccagagatctgggaggacaacagactcttcccctatgtgctgctagaaaactggttgtaatactgttttcttttctttctttcttaatttttttaagagacaggatctcactttgttgttcaggctgtagtgcagtggggcagttgtggcccactgcagcctcgaccccctgggctcaagtaatcttcccgcctcaggctcctgagaacctaggacaacaggtgctcactgccatgcctggcttttttttttttttttttttttttttttttaatttttggtagagacagggtctctttatgttgcccaggctggtcttgaattcctggcctcaagtgatccttctacttcagccttttaaagtgctgggattataggcatgagccaccaagcccagctgcttgtaacattcttgaaatgttgaccccactggagtgaccagcagagcttgccatgcctcccgatctgtactctttgctgtagtttagatatttgtccgcttcaaatctcatgttgaaatctgatccccagtgttggaagtcgggtttagtgggaggtgtttggatcataaggatggatccctcataaatagattaatgccctgccatggtgagagtagtgagtgagttctctattagttttcccaagagctggttttttaaaagagcccggtgcttccctctctctcttgcttcctctctcaccctgtgatttctgcacacactggctcctcttccccttttgccatgagtggaagcaacctccagcctttacctgatgtagatactggtgctgatttttgtacagcctatagaattgtgacctaaacaaacctccttttctttataaatcacccagactcagatattcctttatagtaacacaaacagattaagacacttcccacccagttgtctctcagacctcattacggttattcttcttacatgtgttccactttagctgcttgggtccccatgcttttctcaacacacaggctggtgctccttcttgcctttgcattgtcgtcccctctcctgggaacatgcctcctttagtgacctgaatggctcaccacttcacctcctgtaggtctttgctttggtgtcaccttctcagtgtggcattccctggccatcctatttgacactggccctacttctttccagagttctatctttcctgcttgattttcctctgttgtactcatccctacccacatactttgtattcctcttttttaatttgtttattgccttttttcctcctttagaccacaagctccatgaggacagaaattttgctctgctttatcccctgatctctccccagcacctagcacattgtacctggtgtataatacatttttttaagatctctccccagtacctagcacattgtacctggtgcataatacattttttttttttaagagacagggtcttgttctatcacccaggctagagtgcagtggcatgatcatagctcactgcagcctcaaactcctgggctcaagcaattctcctgccccaacctcctaagtagacgggaccacaagtgtgtgccaccatacctggctaattttttttttttttttttttgagatggagtctccgctctgttgcccaggctggagtgcagtggcatgatcttggctcactgcaagctccgcctcccgggttcatgccattctcctgcctcagcctcccgagtagctgggactacaagcgcccaccaccatgcccggctaatttttatatttttagtagagacggggtttcatcgtgttatacctggctaattttttaaaaccatctgtagatatggggtcttgccatgttgcccaggctggtctcctggcctcaagcaatcctcctgccctggcctcccaaagttctgaaattataggtgtgagccactgggcttgcctacaaatattttaaagagttaaattaaatatatatacatttcaaaacttttcctttttgtagaatatgtgccccaaacggccaatattcgaactgttttctcactatttttttgtagggtgagcttgctgatagccatatgtgctagccaatactggattttctgatgtctttattcatttaaaaattatcctttatggtgactttattactgagctctcctcttctgcttgtgtactgtgcagtctactatgggaggagtgagtccagttaaggtgcccttctttaaggggaggcctgctaagtggatcttctctagatagtgaggagaaccggtgagtgagcaatctagaccagaacacgtataatactggaggggtctttagcccagagatttacaaagaagaccaaaggatttatcagtaattaccctatctatgtaatacatgtagataaagatagataggcatgtatatgcatatatacagatacctatgtatatatctatctatatacatatatacatgtagatatatacatacctatatacatgtagaaatacagatgtagatataaatatatatatgtgtatagagatatgtgtagacatatatagatgtatacatatatagatagataggtctatatagaaaaccatctatctatatctagatagagatatgtattgatagatatctctccctatctatctctagatagattatctaatctatctgtaaaactatcttaaaaccatactaatttaaaaatcaagattcatcttaatttaaaaatcttaatttaaaagttaagaaccatctttattttgtggttcatatacaccatggaatgttaggcagccataaaagagagtgagatcaagtcctttgcaggaacatggatggagctggatggaggtctttatccttaacaaactaaggcaggaacagaaaaccaaatactgcatgttctcatttacaaatgggagctaaattatgagaacacatgaacacatagagggaaacaacagacactggggcctctgggagggtggatggtgggaggaagcagaagatcaggaaaaacaattaatgggtactaggcttaatagctgggtggtgaaataatctgcacaacaaatccctgtgacactagtttacctacataacaaacctacgcatgtgccattgacctgaaaataaaagttaaaaaaattattaaaaatatgtcagtaaaagtctttaaccaacaccaaatggttcatcccaagagtcatcttaatttaaaaatcttcacatcttaagaagctacatgggaggctgcggcaggagaatggcttgaacccagcaggcaggggttgcagtgaagcgagatgataacattgtactccagcccaggtgacagtgtgagactctgtctcaaaaaaaaaaaaaaaaaaaaaggagcaactttgctgcttaaattgagtataatacccatttacatttaatgtggtgaatgaaaaatttggttttcatttaccaccctacaactgaatttttaattcctccacatattctatttgcctttctcaactattattttatagataaaaggacttacagaaagcaaatacatgactcaatattccaataaaagtgctttttaaatttatattgagcattttatccttctttcttaaaaatcttaagctacacacattacatagctaggcaccgataagaatctagtactagataaccatttcaaaggcatggatagaatgctttccaggtatggattgtttccataactccccttccatacattttaaagccattgcataaaaaataaggaattttgtagagaggagtgagtttatatcctttaatattttctcactttagaagtgcagtcttggaatgatataaactctgtaaacagactatcatgctacatttacagagaattatatcaaggtgtctatttctaagacaagaataaaaattatgtttttttctaataatagaaatggataagcagaattctggcttctaataatgagaacatactatcccctagtttgaaataagttagataatttaactttctcatgttatcttgaagttaatacatcatttatattgaatatatcagtgcactacatgaagttgtacattgggtaccatcccttttatcttccacataaagtgatttagtgttttaatacacttctttccatatcctgcagttttgcatagcaaaagaagcatgcactttgaggaaaatgtaccttttaattttctgtattttaaatattatgggtacaaaatatttgtatataattatggagtacatgtgatgtttcaatacctcctttttgatcccagatctttcctgaattttttgtccaatttgtattgcgttatttatgtttgaaaaggagtaatgatgtttagtatatactgttataaaataactgattcgaaggatgtaaagtatctgatactatgtccaaatatgatttttaagcaaatgttcctaacaatacataaataataacatggaataataaaataacatggaataaaataaattcatatagctttatgattaataattttacctaaattaaaaagtgttatgtgcaaatagatggtatacgacacttggcatgtaataatgcaattaagtccaattgaatatattgcttgatttatttccacaatctttgatacatgtattgtatatccaaacatcaaaaaccataagcagcctgtataatgccttttttattctctgtaaagtttttaatataaatatataaaagagcatcttaaattatttaaataagtcaattattttatatgtggatttggtattagaacatatatcttcttttgcacaataaacttttttaagtgtcagaaattatataattatatagtgacttttgttcacaaggtagttagttgtacgtacctacaagatacttgaaaaatatttttgccgagattggatgcatttttctcttatagactcttaaaaatgttaacaagccaacacatgaacgtactgaagtattttttaatcatcttttctagtgttgataatgagttggctgatataaagtcattagagtggcaattcaacaaatattttctatggcataacaaatgtcattaacttgctagtctgtcatgatgttgcaaagctaaagtcacattcattagtgttttttgttgttgttgctgtagtggtggtttgttttgttacatgaagtggcccacttcttgtattaaattatttattctttctgaaaatgttcaatcagaatgtaataacacctttaaaaatgatttaaaaatgtattcccataggtgggaattgagcaatgagaacacttggacacagggtggggaacatcacaccccagggcctgtcggggggtggggggcagggggagggatagcattaggagaaataactaatgtaaatgatgagttaatgggtgcagcaaaccaacatggcatgtgtataccaatgtaacaaacctgcatgttgtgcacatgtatcctagaacttaaagtatattaaaaaatatatatatttatttctactgaacacaatgtctatatattagatgacctagaactggtagggggttctaatccaggggattgttgataaactcagacaacttctataatttttacattgttactcttaaagtcttgtcattgattgtctcaatattggaaaataacatgtcaatattcagtgtaataaactggaagaaaaaatgggccaatatcccattcaattaaagacattaaaaagagtgtgtatgtattacttctgctcacatcttaatgttcaacatgtcgtcaccaagccagatagaaccatatactggggaatgtaatgtttatctgagaaaccaaatgcctaaatacaaattttagtagtacgaagtaagaggaaataaatatgggggattttctagtcttctctattatatataaattgcaagatttggctactttaaaaaatattaacatttactaatttttcatcaattcaaatatcatattgtagagtgcaatttaatcaaattagataacagtcccaaatataacatttaactgtacatcttccagaagccaaaaaatgagaaattatttgtggcttttggctagacaaagatttcttagatgtggcccaaaagaacaacctagagaacaaacaaaaaaaccagttacaacaacaataaatatgacttcataaaaacaaaaaattctatatttctaccctatatgcctcaaactaggaatagacatttccaaattatatctgataaagaatgtgtatccaaaatatgtaaactcaattataaggaaaattacagaccaacaataaacaataaggaaaagaatatacttgaacacatactttgccagaggaaattcagagacagcaaataatcacatcaaaagatgttcaatatctttagccattagagaaatacaaattaaatgagatgccattccacacctacatatactttgccagaggaaattcagagacagcaaataatcacatcgaaagatgttcaatatctttagccattagagaaatacaaattaaatgagatgccattccacacctactagaataaatacaattaaaaatactcatcatcttttgtgttggtgatgatttagaacaactgtaattctcaaatactgatggtaggaaagtaaaatgatacagccactctgggaaaaaaaaaatggactgtttcttacaaagttaaatagacccccatcattttacctacttattctactgttgctctttaagcagaaaacagtatagcatatatacatacaagaatgtgtttgcaagtggccatgacaaacttatttataataacactaaactgtaaacaacccaaagtttatcaatgggtgaataaataaaccaaacacggtatactcataacgtgagatataaccacacacacacacacacacacacacacacacacacacacacacacaaccatattttcaacaaacggtactggaacaattggacatccacatccaaaaaaaaagaatctagacactgtgtttacacaatgtacaagaatggataatagatttaaacataaaaatgtgagactatagaagaatgttataagttgaatttaataaaaattaaaacttctgctctaagaaagtcatagttaatatttaaaaaacaagccaagactgggagacaatatttacaaaacatgtatccaataaagaactggtatgagcactccacagaactcttaaaactcaaaaagaaaaaaaaaagataaataatccagttaaaaaatggacaggagatctgaacagacatttcaccgaggaaaatatattgatggcaaataagcgaatgaagtatgctcaacatcatgtattattagagaatcgctcattcgaacgagataccaccgcatgcctactaaaatggctaaaatccagaacactgaaaacactaaattgtgttgaagataaagagcaagggaaactctcatttattgcttgtgggaatgcaaaatggcacagccacgttagaagatagctttgcagtttcttacaaagttaaatgtagtcttaccacatggactagtaacttcactcctatccaaatgagtcaaaaaaacttcactcctatccaaatgagtcacatgactccttaaaatagcttttctcataacaaaacttggtagctaccagatgcccccaacaggtgagtaatggttcaataaactggcatacctataaaatgggatattcagtgatttaaaaataagctatcaaaccatacaaaacatgcaagaacctaaaatgcatacaacttagtgaaagaagctaatctgaaaaggctgtacactgtataattccaatgatacaacattcttaaaaaggggaaaactgtaaaaagatcagaatttccagtagtctccaagggaagggatgaataaatcaagcacagaaatttttaagaaagtaaaactattcttataatattgtagtagtggttacatgacatatgcatttgtccaaacgcatgaaatgtataatgtcaagagtgaaccctaatataaaactaatgtatggactttcatttataatatgtcaatattgatgcatcaattataacgaatgtaccacactaatccaagatattaatcataaagaatatggagagtagaagaaagtgtatggaaattctctctgctttgttagtttctactataaacgtaaaattgttctaaaaataaaatctattaattaaaaaaagaatgaactattgctaccagtatcaacataggcgaaagtcagagtagttatgttgagtgcaaaagacagacaaaaaagaatagattttgtgactccatttacataaaattctaccaagtgtaaaccattctgtagtatcagaaatagattagtagttgcatggagattgagtagggaagaggggaagaagcgattactaaagacacaaaataacttcagggaagtgaatatgttcatgatcttgattgccatggtgttttctcgtgtaccaatatgccaaaactttaaaaatacactggatatgttcagtttatgtcaattacacttcaatgaaaaacattttaaaatattatgtatcttgattttatgcttatgcagagatattatttctctgcataaaaaaggtatatatgcatatatgccatatataccttttggcatagtgtaaagatatataaacatagtatataaatatggtatttgtaatattcttattcatatgcaaaatatagtttacttttaattttttaacttttcttctgtttttattccgtatcctccagacattaacactgagaacttcatatacaattacatatttaaaaatgagtcatgtctagtataatacaaaatatcagcaatgtaacgtgacaggaacaaaatataaatgaagttgctttgtatagattcatttttctcattaaaacatttcatagcataatgcacttattcaaaagtattaacatatatatttaagtgcactatgaaaaacagaatcaagaaatggataccatattgatactaaatcctatgttaaagtatgttgaataattcgtagtttttcaaaagtaactcagtcatgtcacatattaataatgaatatatttatttttaggaactccttttaaataactattaggtatatagttttatgctgagttttatgagaaacacaataagcatatcattttatgtcaggaatagagagtatatttgtccctaggtcattttctatagctgtcaaaatgtttcaacatcttttagaactccagaaaatgaggaagaaatatagaaatgttcctaggttgttcttgtaactttatctagtttttttctattcttaattatattaattcttcccaatggcttatttaaaaatgggtcttcaattgtctttcattaaaattctatggggtctcattacgtgtaagaaggttttatttcacaccaagtatttttctgttatgtaaaaggaaaataaagctctgggctaaagaaataacttttttaaaaaattttccctattgggaagtagttgaatatatactttgctgttttcagctaaaacatattagaatgtgattctatttacaacaaaaatgaaataaggctgtgttacattggcaagctgtaatgggaaatgtatttgtcaccctaggcaaactgaaagggcagatatattgaattcagtaatgctgaataattaagccctcacttataacccttatattagagaattcaacttaataagttaagtcattttccaagtgtttgttaatgtatcaaaaggatttatacatttcacaaagggggactcaagctaagctaaagatttataaacacaaccaattcactagagaaataattttaaccgtgtttttcttgtttttccaaaccttactctttcatggaaaaaaataaaggcaatattataaaatagatgaaagtgcagggtaattaccttgcattgagaagcctagagctcacctgatccacaatatttgataatccatgtcacccctggtttacttccacagttcccttgaagattgaagagctgtctgaataccacagtcttagtatactatgttttgtaaggaaacctgcccactcaagaataccttctatgagagccaacccattcagcatgttaggaagtttgcttccatgtatgattcaagcccacctggtccagtggattggacaatgaatgaacgcttgatttaggtggaagttatccatttattggttggaaatcaataagcctctttcacttgagaattctaattgagatgaaggttataataatgatgcatactggatgcacaaagccatatagcctccataatgttataaagaataatattattgatccacaggcaagcaatggagatacaaagagtacaagagtaagaaaataaatgttgccctggagtgagagaaattgataaaaagccactgccttgatgttggacaggttcttagttctatgttcagcctttattttctgcccttggattctacactgtacatttcaagtttttttacaaaatggttttgactacagaaaaagcaagtgtgccattatcccatttttgacatattttgggagaaataaagtaaaaactatttttttaatatttatttatttatttatttatttatttatttatttatttattttttgagatggaatttcgctcttgttgcccaggctggagtgcaatggcgcaatattggctcactgcaacctccgtctcccgagttcaagcgattctcctgcctcaacctctcaagtagctgggagtacaggtgtgtgccaccacacccagctaatttttgtatttttaatagaggtggggtttcaccttgttggccaggctggtctcgaactccagatctcaggtgatccacccacctcggcctcccaaagtgcttggattacaggctccagccaccgcacccggccgtaaaaagcattaagagagtttttcagagtagtttctgagttacatgtaaaaacaagataaaaaaatttactaatagctctgcagctttcaaaattaagcagtcagatttctgtgtggctgagaattgctagcagtctcctccgttagaatttgccatgcccaaaatgtcccatgctatacagttaaatgattaatgtttgagtaatattcagtttgaaatttaaatttttcctcttgaggggaaaacatgcttagcctttcattataaaattatccaagctttcctctcatttctatgttcaaattcattgcatgagttaaagcatcttaaggcttccttctaaacaatttatatatttgccctacgatttcaactagtcctaatctcagaggatcacttcactggaaaagttgtgcaaaagtaaaacgaaatggagattaactatactaaattgtcatgttgagcttcgtgataaatttagttacaaagatattattcaaattggaattaactgcaaatctccccccaatgaaagtggagtgaaattggccgggtgcggtggctcacgcctgtaatcccagcactttgggaggccgaggcgggcggatcacaaggtcaggagatcgagaccatattggctaacacggtgaaaccccatctctactaaaaatacaaaaaattagccgggcgcggtggcgggtgcctgtagtcccagctactcaggaggctgaggcaggagaatggcgtgaacccaggaggcggagcttgcagtgagcccgagatcgcaccactgcactccagcctgggccacagagggagactccgtctcaaaaaaaaaaaaaaagaaagtggagtgaaattactatataaacctagagttatgaacatcagaaaacatgatatagcaataaagtaatttaatgttgacttagggagtcataaatcagatattttattcaacgaactctgatttttaattataacgtaagaattataaattagtatctaaaagtcattgtttcttaataaataatgagttgacaaaaataatagttgaaaaataaaattatataggatggttatattgtgaaaatttccattaaaaattaaaataataaaaaaatcgcctttggaaactacttttatttaaaatatcaggaatccagaaaattgcaacttttcttgatctacataatcatttttacatgaaattttaattccataaccattgcaaagatttttcttaataaacacagtattaagtatcaaacaccttctgtgaaagtacaatagaacacaaacatatactagagatattgttttctgcatttatgcatgaacaataagattttttaaatttttgacttatctgtggaaatatgatagagaattgtatggtatggtttaagtattattcatttctgcacttagatgaggtaattttttcttttctagataaactctaattccactttttccatacagtacacacatatacatgcatatatatgtttctgttaaacaacagtagtgagattttaacaaatgacttacctgtctttctgaaaagtgtcttgtctgttaatgtcatatgagcctgtaagggaagaaagggactatattacaaaggaacagaaatgatccaggagagtatgaatacaactggattctaagaatactgggctattgggtattgggatatagattgggataaaagagtatacccctatcagagcactgtcagtttcactactgatatggtacaaacacataacaggatggttcgtagcatcaaggaaaaagtgatggcctcaggtgaggttgcaatgtcaaatttcccatggaagatgacagaagatgcatatatcacaaagaaaataatatgtagaatagttaaaatctactctcaataatttttaagttattttaaattatatgctattgttattaactatagtcactatttccatagtcactacaactacaatcactatagatctattacataatgtacaatagatctctgaaacttatttctcctgtcaactgaaattttgtttcctttgaccaacattgagatagcaacttttatcacaatttaaaaattataataacataaaacaatgtaattttataacaaggaaaaggcatttcttgaaagttaattcacaaaattgaatgaatgaattgctaaacaaaacgatgtcaacaaccagaacaactctagatatctcaggcagaatgaattcaaagaaaacgactgcacatatttcttctcaacattagattcacaatggaatcacctggggcaatttttttttaaagaaacgaatgcctacatatcatgtccagactctgatttatttgttattaaatatggcctggacatcactctactcctgacgtccctgctcaagaatcaacttccgggaagagagactgggactcactgattttggtgctattcagttgaactatgcccttactgattttccacctgctggttctattcattattgatagagaggtgttaacacctccaattatcatagtggatttatctgtctgttcctgcagttctatctgttttcacctcatgtgttttgacagcctgttacatgcaaacacattaaggattgttacgttttcttggaaaattaaatcctttgttactatgtaatacccctttgtatccccctataattgttctttctctgaagtctttttgttggaaattaatatattaatccagctttcttttaattagtattatcatgttatatatttttcaaagttaattctcaagcttgtccacaatgtgcttccagaaattaatcaactgcatattaaagttttctactccattactaactcctgtgggggctcctgggcttttgctccactaggctataattctttgcattttcccatctctctaatttaatggggatttagggtgggcgcagcagtttttctgtgacctcagtcctctaatggatctaaaatgagttgttgatagtctgtttgtacagcatttttcttgttgtaaggatgggagtgatgactttcaagtttcttacatacttgaataactgacattttttattatatactcacccctgtggtggtagaagaatgctataaattttggatccacagaactaaagtactaggagagggaatttttcacaggaaagatggttgctacagaaaaaaaaagataaagtcttctctgctatctctgctagactctctaaactcttcctgtctctggagtccagacacccaagcctccttttagttttgagctttcactatgcttttatcttaaagactttgcctactatgtcttttctgctgagaaagcaccttatcccctcaattacctggttaacatcaaatatcaaatcatgcttctgactgaaggccaagtaccacctccagaagaaatcttccctaagaacagcctacatacagttaattgtgtgatcccttttcttatatccttcgaatactcttccttcacattactcttccttcacagcctttagccagacaacacattacaggaaaacagggagaacatgattttgccattcactcttacctttgcctagcccagtgcctggcaaatgatagattctcattatatatatatatatatttgaatgaattaataaatccaagtaaagtaattgatgttttggagttatctaaggctgttaaagtcagttaaatatagttaatgtgaagcaaaaaaccgtaaacaaaattaacgtaatatacacgctgatgttactattttagaaaaaaacacaataatttacaaattcctttcaataattcaattaatgtttatgagatttgattgaagacaaatccatcacggcaatctgtgaatgctttgttgtaaataaaaggtaatccttgtaataagcaaaaacaaattaacataacaaatgtcaatttacagatagacaaaaagtgattgttttctgaatgaaaagaggattattaacagttggcataagaaatcaaaaattagttcaacaattagtcatatggaaatgtcaaatattgacaatgtgataaagaaaacaagagtttctgcaaataacctcccatccctgatgtgagtctttcacgtcattctatagttcaactagttcttaataactcaaaaacaggaaagataaaatccatcattttgttttactacccagatccctcccgtagctgtcacacagagtgtgatttatgacttgtaagttgtgctatggagcttgacaagtaagtttgatttcatttaatattttctttaaaccatcttagatcttctctttgacaagtatttcatctattagtgttctcaaaatgtaaaatgggtaacttaatgagaacaaaaattgtacccaaagatatatttgcactatctacatatttgcaattaaatcttaacagatttaattgtaatagaatctaatggttttcctcttgaatttctttagacaccagaaatttttattactaataaataatgtttagcttcctagtcacaaaccaaacagaaagcaaatttcatcagagtttagaatggttaaaaccaacatagctgcaatatttttagttttgctttaaaattttgtttaatcaaacagtaaatcaatcagagttgatcattatgtaatccacagaccttgaaataacagagatatatttctccgcagatcaatatctatatatgtttttaagataagtagaaattcccctgaagatcataaagaaaaagtatgtcatataatatagttaaaaaaatagttattaattttttctgcttatgatgttccagaatctgtactaagcattttagaggattattttatttagttcccacaataatcccttgagaaatatactacaataatcatctttaattcacagttattgaaaatgagacacaaagaggttaagaattttgtccaaggtcaggcagctagcatgacttagcaagggtgtaattaagaaaaaatatgtttttcttatcttatgggaaatttggaaaagcaaatatctacattctctttttaataaaaaaaataaaatataaaatgtgagtctctcttaaagcagggaatcaactttaattaaattgaaacaatacataatcctttgttgttcaggttctgtattattattatctctgctgacagcaaaagctaagaatagaaaatatttctgacccaagttggcaaattatgaatcaacctgctaaagaatcagaataaactaacaagtggaattaaatatgattattctatattatatgtataatataaaaatttcttattgttataattttactaagattctaccagtttcaactaaattatcttttaaatccaagcttaataaaagaaattggcatgagatgttttcataggaaatagtgacaattcatattatttttaattaagtgcaaatgagatacattatttctgtatttcattttccttctaaaagtcatctttaaagttttagtttttctgaagttgacagctattactaactcttttgggccaagttttttgagatagattaatttataaaattaggaagaaactaaagtagttgcaaaagtttctaaaaagataataaagtagttgtctctatgttataatagaaaatgagaatgtgaatgcagatcattttgactgtttgtgttttcagcaaatattacctgaatattgatatataaattagaattccccaaaggaaaacattttaaaatgttaaaattaataaaatcattaacttacatacttgtccttagtatcaggacaatctccagtggattcaacagagcatctgcagttttgttgaacaaaggtttctgcaatatagacttatggtgtgagcttactgggtcacattctttgttccttcttggagctttgggaggcttttataaaagagctgctgcagtagaaggactgagttgtgtcacactgaggatttaagtttctatgggagaatcaaattcactttagtatagggatttagtgggtttccctagccttattaataaaatactaatacgacattaaaaatgcatactttgtcttacaataatccaattaagacactatttttgcatagcaaaattctttactaaacaccagttgcaaatcaagtgaaattgcattggcaagaggtgatcatactgctctcctactcctgccctttcctcctactccagctgaaaatacttggtgcaaatgtccttttataggagactttgaccccagggtatagaaaaggaaaggaaaaggtcacatatatatatgtcttgtctataactgaaacctaataccagcacaaaagcctaaaaggaccgatttttagagggcgttggcaggaaactctttgctctgctatcatctgttttaagctacttttatacatgatttattttttcagcttctactctgctactattcaactgcaaatgcaatttgttatattgtacacttcaacaccttgaacagcatcctaattattattgaaatgtattacgagttcgtaaagaaaacagcattttgtttcttcagtcatctacttaggatgaaagtgttatttagaaaacaataaatgggaaaaatgatacattaaaaataaaaattgctattaactttttagatcaaataaaccaattttaagcattttcatggacctttataaccaaaataaacatttaaatacagataatttaattcagtattttgtttcttgaaaatattggaatatgtgttttagataatgcatatatttctgttattgaaaaataagctttcaatagtcagctgacttcatacgtaaataataataccattttaaatttattcaaggatttaggtgttcttaaatatgactttataacttattttactcccttaaagtaaatatttatggcatctgtaagtcattgtaaaattgtaaaattggtatagcatagtattcagattgtcctttgtaatgttttatactattcacatttgtatttaatcacaaatttgatacaatttagccaaaccttcaacacatttatgaagagagcactaccgagactttatacaatggaataaaataacaaaatgtgctgacagcattcttccactcaaagaggtatatatatattttttattctaattctttaattttattttttagcacccaatgatagggaaaattactggaagtgtgattaaggctattataagatacataaactgtatggcataagcattctcaactcaacttcacactctacatcgttttatcaacttagtatgccagctttttaagtttggtggaatctggtattccacacctacatgtctctgaatcccatccgtgtactgatgccaagatgaactgaaccagggatgaatttttctcttatatggaaacatgaatatattccaaactggagtgagctctcatcagcggtttgcctatggtaattactttgtgccttgtaatgggtcatgtagtatcctcataagggtgcgtctgagtcctagaccctctcccattccagtacctgtaaatatcaccttattttgaaataggagctttacagatataataaagatctcagggtgagatcatcctgaatttagagtgagtcatgggtatttgggacacagaaacacaagcaaggtcatgtgaagatagagactaaggttggagttatgctgtcacaagccaaggagtgccaggagccaacagaatctagaagaggcaaggaaggattcttccctagagccgtcagagggtgtatggctctgcctccaccttgattttggtcttctggcctctataattgagaattttttttctttttttactattttaagccacaaattttgtagcaatttcttttggcagcactaggaaactagttaatacctctattgtttggttaaacaaagaacactattaagtatttttaaaacaatgtacatcagtgttgattatggtaagcatacagtttataatcagataggtttctgtgtaaaatttcatgttattatattgatttgttttaaccatacaagacttgcttggatgtggtaccattgaataccatccccattccctcctgtcccacagctttttgaaatgtatggggctttgttctagactgaacattccttttccctcaaatttcatatgttaaagccctaccccacaatgtgacagtattgggaagtgaggcctttgagaattaattaggtttagacaaagtcatgagcatagggccctcatcaacggaattagtgtccttataagaacaggaagagagtctatagagtgctctctctctctctctttctctctctatctgctatgtgaggatacagcaagcccggaagaggaccctcaccaggaaacaaatttgctagcaccttaatcttgcactttccagcttctacaattgtgagaaatgtctgttgtgtaagcaattcagtccatgatattttgttatagaagcctggactgactgataaaggctggaacatgctggagagatggtacaaaaactaattttagaaaaatattttaagttgtaagatctgaagcaaaaatcccttacatattaccatttacatcaccaaattactccatttacagtatcaaattaaggaaatttatgttttattcaagccttttaaaatcagcacacccaccttgcagaagtaattaataacccatgattattaattatgttggccaagttaattttcatccagtattacttgcagggaaagtttgaaattgatgaatcatctcccttttgagatgtcacttgtagaactaaaggctacctataatttctgtaattgttactctttaatggaactttaaacttctaagaaaaatatttcaatatattgttaaattgacttcaatgactaagattgtggtggagaggatatttccccaaactaactctttctctgacacttaggggttcattgtaatagtaacaccttgctagcaatcatctgctagtgatttgctcatggaagaagaaggctaaggaaatttaggtttgatgacctttttcagagtttctgggaaagcaaaaccttctctctactactcactgcaaacaagcatgttgtgcaagctactgctgccaaccaggtcacatccattagtgaagtcaatgctgtggagagagacattcaaacctgggtcactgatagtatcattttcaatttctgacccaatcaattctggggcttccaattcctctctccatggtcttatgtgaaataatacattttttaaactgttgaagtcatattgagctgaaatttcccttaattacaactcttaatattttaactatttatgctaagtttctttgttccagaaaaagtactttaactcggccgggcgcggtggctcacgcctgcaagcctgtaatctcagcactttgggaagccgagacgagcggatcacgaggtcaggagatcgagaccatcctggctaacacggtgaaaccgcgtctctactaaaaaaaaaaaaaattagctgggcgcggtggcgggtgcctgtagtcccagctactccggaggctgaggcaggagaatggagtgaacccaggaggcggagcttgcagtgagccgagatcgcgccattgcactccagcctgagcgacagagcgagactgttcaaaaaaaaaaaaaaaaagtactttaactcattttcatttttgtaggacttgaattttttagggcagtttcagtttcacagaaaaattaagaggaagacatagagatttaccatatatatgtagtaatatatattatatatggtaatataccatatattactatatatatatatatatatatatatataacaagcatgtggaggcagggtatattatatatatacacacacacacacacacacacacacaccctgacataatatatatatatatatacacacacacacacacacacaacccctgacataatgtgtatatataatatatgttatatattatattatatatgtaacatatcctgcctccacatgcatggcctccttcattatcaatatcttcctccagagtggtacgactgttaaaattgcctcgcctacactaatacaattttattgcccagtggtaaatatacataacataaaaggtaccatttaatcattttcaattctaaaactcagtgatattgaatacattcacaatgttgtataattaacactgttttcataacttttctatcacatcaaacagaagttctgtaccattaagcactaattctccattccccttgccccagcctccatgccctggaaacatgcaatctgcattcccactgcatgaatttgactattcatgatctttcatataagtagaatcatatactgtttgtccttttgtgtctggcttattttatttagcataatattttcaaggtttacccatgttgtaaacatgtatcagaacatcattccctttttatggctaaataatcttcccttgtatgtacatgccacattttgtttatctacacatacaggtttgttttcactttttgactcttgtgaataagaatgagtgatggtatctggtgtgtgcatacagccattttcttactaaaggccaacagcatcaagcagtctactaatggttgttatttatctgattaggatccagagttccaaaaaggttaattcttattttttccagtttaatggcagtttttgtggagggattgacttctataacttcctattccaatcttctaaaatccactttaaaagaatggtttaaattgtgtgcttgtaagatgaaattgataaacaattattttaataactttcaaaattacatcatagagataatgtcctttgactattgggtgttcatatatttggcatgttatgaacaaccttctggaagataaaggccttttatctcatacttaatattaagacaggaaccagtgtgctagcaatggcttttgggtttgatgtgatatatttgcatgtaatgattttttaaaacttagagagaaaaatcctctcatacaaaacaaaatagtttttactgttatgagaaagtagttattaattacttataaaacatgcaagtatctttatgatatttggtgacttatttttctccagccatcttgtcttgttgttagtggggaaaaaaatggggatgctctttatctatgaaaatgtgaaaagtatatacacattttaactatacatggtttccctaaaaattcttcttctgtttttaatcctctaaaatgatcattgatatgtacaaataaatattgatgatagcaactgaaggatcatttttgctgttatcagaaattgaaaatactgtaacagtctatcaatagagaaatggttatgtacattatgatacatagcatatgtccatatttagaatacgtaccaaatgtatacaacaaagtacaatgaatacatgattatactaagatggataggcatggatccacatattactctgtttgtacatggtcttttccaaacagaaatacaatgtaagaaagaagaaaagaaaaataaagagaaagagaataaaggcgacaaaataaaatataaaccaggatgcataagctggtctcaccttagggctggaacaccagtaaagcttctcttctctggaaaaagcttaggtctctgaagttttctcagtgcatcaaaactgacagcagcaggaatatggttttgctaaaggcaacagaagagcaaaacagtctcaagatttaaatattaatccaaaggttaaactttttaccttaatgttgctactttctgtatgcacatcccacaggatgtaggaaggtggaaaggatgaaggaatgtggaaaatgtagaaaattagaaaataaggtaaatttaaaaggtaatacgactaacattcattcattcacattaagctcctaccttgtaccacattctattgtagacactgcggatatagcagtgaaaaaaagaaaataaagaaaaatatgcctttttggagcttacattctcttggaaggagatgtgtaacaacataaataattaaactatataatatgttaagtgttgctaagtgctatggaggaaagtaaagcagacaaagcaaataaagaacatgaggaggagatataattttaagtagggaaataaggaaggcatgacggagacagtagcatttgagtgaaagacttgaagaaggtgatatggtttgactgggtcccccactaaatctaaagcttgaatggtagttcccataatccccacatatcatgggagggacctggtgggagacaattgaatcatgggggcagttacccccacgctgctgttcttgtgatatgaatgaattctcatgttctctgagggttttatcagggttttttcccccattttgcttggcacttctccttgctgccaccacgtgaagaaggatgtgttgcttccccttccaccatggttgtaagtttcctgaggtctcaccagctgtgcagaactgtgactcaattaaatctctttcctttataaattacccagtctaggatatatttttattaacagcatgagaaggaactaatccaggagataaggaaacaattcagggaggaatttgaagacaggtgttttcagtcagagaaaccatgtacaaagtatctaatatgagagtgctatggtctgaatgttgacaacccccccccccattactgttgaaatgtaattcacagtatgatactattaaaagttaaggtctttggaaggtgattatgtcatgaatacagagccttcatgaaggagattggtgcctttataaaggatgcctgagggggctggtttgtcccttccaccatatgacgactccaccatgtgaagaagaagatgggtctatgaactaggaaatagggcctcatcatatatggaatatgtgagcactttgatctgggacttagcttccagaactgtgaaaaataaatttctgtcatttataagctacttagtctatggtattttgttatagctgctcgaatgggctaacacagagacaattcccagcctgcccaaatagcaccaggaagtgttgggtacagcaaacctggaacagaggcatgaggggaagagcaacagggctgtgatcaaagaggtgtgcctggtggggagcatgagtagagctatataatctgtacaataatgactcagagtggaattagaagtccttaaaagtgagtgagcagagtggcatgatctccatgatactatgttatattcttgcttgggtattgagaaaagactgaaggtgagggctaatgcagaagcaggaagggggataaaaattcagatgagacatgattttggcttggcctgggtggataacagcagtagtaaaaattatttaaatgttttgaaggtgggtttgctgagaagtaaaggatgtgtggagaaaactggattgagaattgtataaggactgtattgtatattgtatgagagtgtagatccaggatgagtcacagtatttttgaagttgtagtaaatggaatgaactagaaagatagaagttaatgttcagaaggcaggagacttaaaagttagattgtaaaaatttgcaattaggagtaataacgtggtttgagctgagatcatgagattgaatagctagatactgaagatagcaagtacattggaaatgacgaggtcaaatgtcaaagaagataagtaatttaaatgagacatcaaaataatggcagtaagtcaggttgtaaagacttcaaagaatgagggaaagtgactaaacattgggagagtgatcaatataatcaaatggtatgagattccaagctggaggggtttgaggagaaggaagtagaagtattctgcaagaggacacttattttacttctagaggcagtggttagagcgctgagggtgagaactagtctgcacttagggggagacatgagaagcagcagcatcagtgagagacagatgacaataagaatgaaaatgtaaagggaaaattgagaaacttataaaaattgagattcttctatgcactctgtacgtttcttacagaagctttcaacgcatttaatttcatttaaatcttgcaatactcttgagagatattatcattccctttttaccaaaaaaaggctgaatggccaagatcacataaaatcacataagtaatagaagtcaaaagtatgactttaacccatctagtgttataagaaccacataatcttcaataagttgaaagtatcttaattaaattaaaaaaattaataaaatttttttcaaaagatgtattcaagttatcaatgtgaagaaaaatgaacatattacttagaaacagccctggattagagtcccaattatatcacttaataattgtgtggtttaggtaagccatgtaaagttgctgtactacttaaatttaaaataaagacaattttacctaaacataaaattgttgtaatgttattgtgcagttataaatcacttattaaattataaatttatgataagtattaaacagaatacttaattttaagccataaggtcttctattagaaaaatactctaatataatgtgatacatcactcatttttataaatataaatttaattatagccttaataaaaaattttggaggtgcattaccaaggctaaatttatatttcataaaatgaacaaatttaagatgtgtaccttaactttatgtatttctgcactcatattcacaccagccatatcaagataaagaagtttcactaccacagaaaatgttgtgctgctttattccagtcgataaccactggtcaaatttgtctggaatcatatagattttatgcttttgtgtctgacctattttactcaacatgatattttggagatttatctatgctgttttatgtgtcaatattttattttgtattgctatgtattattactctgtaagtcaatatcataatttatctcttctccactttatagatgttacatccagtttttgcctacaaaaaaaacctgctgtgaataattttatatcggtctctattgtgtgaatacacaccctcatttatttttggtacatacctataaattgaatcacgatgtcactgggtatgtgtgcaggttaactttataagaaattgccaaacttctttaaaatatagctgtaaatttactctcccaccacaaatgtatgagattttctttgcttcataacctcttcaacacttgctatattcagtccccaattttctttcttaagagatggagtcttgctctatcacacaggctggagtagagtggcacaatcatagctcactgcagccttggactcctgggctcgagctatcctcccatatcggtctccaggtatttagccattttaattttaccagttctcttggatatgtaatgacatctcactgaggtttttattttcattttttctgatgaccaactatgtcatcaggagtgaaatcactgagtcataaagtcattgcctgttaaactgtttgtttgctttttaaagaaagtatcaaattgttagagaatggctttgttattttacattcccatcaaccgtgcagcagttaagtagtttctttgcagccttgctagcactcagtgttgtcattattttttattgtaactattccattgggtatatattgaaatcccattggggttttaatttttcattccctaatggctaatgatgttgacgtcttttcatgctctgattttccaaacatatattcttttcagtgaaatgtatattcatgtcttttgcccactttctaatttgactttgttcactcttaagttttgaaagttctttatatattcttgctactagtctttttcagacacatggcaagcaaaaggggaaggaaggagcacctttttactgtcaagttgagatgaaggtcaaggttccccattaggcctcctttgccacacaaaaagtaaatactctgtgtttttaagataaagtaatggatgccaagaaagactcaaattttttttatgtactaatcataaaaatgaactatgatttataattcttctcgtccattttcattatacataagttaagaaaacaaaatacatcatactcaataataagaattctgagtagaaactcaccagttcaccttagctatattttcccttttgggtttcttttacttttttttctctctctcctttttctttaaaaattttggagtgtgcagagggataagggtgagggagcgtggcaaggagaggagttcagatcaggacagggaatggaggagggcaaggagtgaagggcacaacccacagcctgggaaagagaggcatgaaacccagcgtgtcaggtggacggatcatggaatggggggccagcggaggttaaggaaggagggcccaaaggtaggggtgggaaaaagagaagaggaggaggaggaagtgcgcgtgtgaagagtgttaagaaaacgacaggacagagcggggaggggaaaagcgggccgagggacagggtgaaaggtgagaaaggagggtatgaggaaagagggtccggggcgctggggatttggggagacgatggagcgacgggtagagcagcttgggccgagccgcgggggtggaatccagacgccgggcgggggagggggcggcggggcggcgggacggtgggtgggggccaccaggcggcgccggagaccaccaaacattacagcgagcgagcctgcttcctggagggagtgcagacaaggaccaggagcgggagccgagcctcgcggcccggggcacggcgccgcccgcccctccccggcagtgcctcccgaccccctgccctccgctgggacatggcctgaggccccgcccgccgcccgggacccctcccccacgctgcccccggaccctcgccccaggaccgcggggtctcttcccggccccgccgcccgccccggcgagaacaggcccggcgggcaaggcggcggcggaccgagggaggcctggcccggcagcggggagaagggtgcggcgcagcccgagtttcccaccttttctcctggcccagacgcggctggggcggacgggatctctcgcgctctgcctcctcctcttgcttcatggagccatgcgcctgggtggaggctcccgagagaagctggcctgcgggcgggccggacgagctgcgcggacggggcggggcgaaggaggccggcaggcggaggaggaagcggcggggcggaggcggcggcggccgggaagaactagaggtattccccgggcggctggaggactgagtcgagccgggacccgagtcctccggtatcccagcagccaccggaggcagtgagataatggaggaagaatg

SEQ ID NO: 578 - DNA, 9530 bp, Homo sapiens
aggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccaaagcccttcacagaatgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttctcattgcggaaactgccagacagcggtggtcagtgcccagcctgaggggatggcttcaaatggaggtaagcctgtagggatgggggcattatctgagtctgccatgcctcaactccttaggaattcaaatttgacactgccccggggacagttgatagggctgatgttgaggagggagggaagactggatgtccccaaggacatcacacctggggatggccatggcaccctgagtctgtgtttagggaggacggccccttagaggtggaacaagatgcctgggggaatacaccgtgtaggagaaaggacagagtggatggattgatcctttctagaaggagacaggtcacgtcattgtgtgtttgtagggagtggtgggatcatgttgtgctggtggccccgggaggatgataggcaagcctgaaccctgtgccatatcttcaggcacctggaaggtgcccttccatagtgttcagagagatttggactggagttttctagatcttagggaggagtggggagaagtggtctcagccagaaaactgttgggtgggttggctgtgacagagcatgtagtgacagcccctgggtgggcgaggctgggggctgctgtaactgccacagcccagagcccctcagctctctccctagagatggcttctccatcagttcaggtagctgttggctttgatttaacaggggtgggggcagatgaggaagttcaggcaacacagggcctgggtttcctgagttgttctgaattgtttgcccttttgtggaagctcaggtcttcagacccacttcctcttgtctgctagctcatggcctgtcctctgcactttgtgttactgtggagatgaagaatttgctcctattccatttatactacctcatgaacggggggcaggtgtggattcttgctggttctcagtggaagggtctggaaaggctggtttccttttcagtagaggaaggagagtagcgcacgaataggaagatggttctcttattattattattcaagttaggatacgtgtcctgaatgatgaggtgcatgtgctgtatcccttattccccttgactagagactgcatgaggtcctattgaacagggatgagttccagacaactttgcctcacccggcccatggcccaagaacccctggtttttggttggtcactatgttcagtcattgggagctcaaaggagaagggccagggatgggctccttgtcccactacctattgtaacatgaccagcagctgtgaaaatccctagacacctcccctgttagctctgctgctcgccatttgctggctgtgttctaatcgtgtgtggcttttgctggctatgcagtgacactgtctcaggggactccaccactgcctctcagacctgctccctgggaacagagcttcctgagtggcagccgggaccatcgagtactgcggaaagggtggcccgaatctgacccctatttagcacttgctgtgggtggtgccaggacaatcacttgcatgctgggcatgacgagttatggattatcttcagggttcctagggcgctggcttgggaaagatttccatccagtggttttgttttgttatgtctgagctgggaaagaaaggggtttacaagagcgtcaggaaaaggaagattgaagaggagatggggccataatattcggaagcttctggcttcctgtcggccttctgagtgccgagcactgccctggggtaggcccctcacctgttgctgagcacgctgaggaccaccaagccgctgagagactcatccctgacccatggcttgggagatgcctgtgaggctgacagggtctgccagggacacccgagggagaccctcgggcagcgaaggcttggctgttacttcttgggagacaggggtcagggagtcttggtgaccggggccaggctctctagtggagcgactctccgtggaggaacagagcatccgatgcacactcagggacatttgcaagctgcagtttccctgtcatacgcccttagctgttgggactcccctctgattccccagtgactagtgtggacctggagaccccagctcattcacctctttcctttgtctccacagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccctccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatgtgagtgtcctcggggcattggagctggtcctgcagctcacacgtaaagaggctgctggatggacgggaggtcacgctgttcaggggagcttgcagggcggttgtgagggtgatgggctgcactatgggaaggtatatttttgaccatattaatctggctgcggctcaggacagactgtcaggggcctcatctcaactgcccgtcactgtcccgtgagtccagccaatccttactttcaataattttcacaacaatgtttacagaagacccaggtcagagagggttcctggtgtgacgtgagctacggtttgggtttaggtctttgagtacacgccccagtgcctcccctttaacccagtattgatggccaggagcacctcacatggggccggggggaggagctgcaggacccagcaggaacctgacacatgcccgcagttccgctgaggtccagttagcacagcggtggtggagcctgcacagggggatggtcttgggccctgcactggggccgatgccgagcaggtatttgcatcttcaccctcaatccctcctagaaaaagggacaatgatgcttcattcagaggatggtgaagagataacttgagctcacatatgacatgcatagcacagtgcctggcacatgctatgacacattacatgacagcagttatgattactgtccccattactatcattatcaagactaggccatctaggagagcactccccaaagccacgggctccagtgatagctctgagtgcaccatgagtccagcagcccagggccatggactgtggtgactgtgaggcagcaacgtcagcatctgggagagtttgtggtttcattcccagtccctgcctctctccaccctgcggtgcctctgtgaccctgtgtttcccgctgatgagcaaacgggagcttgagcacatccaccgtgcaacacactggccgttcccctagggaagtcccctgcctggggtgtaggtggaaggtggccccattttcatcccccaaaatctcgctgttcccgcaccctggaactggttgcattcctccttggagcggagtcccggtgcactggggaccctgattcttggggtggagctgccccaggctcacaggcctttgccatggctcctgtgggaatgtgggatctggacctgctgcttgcagtggcgtggacaccgctctgctttggttctggacgtgtgctcctgctcctcatgctccagggccctgaggctacgtccccaggggctgccttgctccagagtccccaggaagccggttaaatgctcagtcttggggccctggaacctgcactttaaccctcacccccaggtcattctgtgtgcacgctgtctcagtcagctcaggctctgccgtaacgaatgccgtagactgggtgctttatcaagacacattcatgtctcccagttccagaggccagaagtcccagatcaaggtgacagcagatcgggtgtctggtcagggccctcctcctggctggagagagctgtctctggctatgtctcctcgtggctgagagcaagagccctggcgtctccttctgcccttatcagggcttggattccatgactgggacccacgctcatgacctgctttaaccctgattgcctccaaatactgacacattggtgctgaggacttcagcacaggaatgttggagacacacatgttccacccatagtactgagtccacttctcaacactgaggactcgaggggcagtcggagaggccacttggtagcttgtgttgatgtttgatcttgggggtgtgtcctggggcctgaggagcccacatgggggagaacaggacagggacagatggcaggacaggtgtggggaggacaggggccaggtgttgggaccaggtgggcttgggatgaagggtgggcttatagactgagactgactgcactggtttacagcccagttctccgatccctggcccggcggaagcccaccatgaccctggaggagggactgtggcgggccatgcgggaatggcagcacacgagcaactttgaccggatgatcttctacgagatggcggaaaagtgagtctggggtcctgggagcggggcccgcgtggcagggtgagagtgaatgacagaggcccggtggccatggtggcttctcaacgtggagtatgaggagggtgtggagaaacccaggacactctgggcccctggctccctcaggaagctgctcctgccacctagagtgttctggggtctctgtcctggcctattgggaagcaccccctgcctggcctggggccatccctgccttgacactggaggtcatggcaggagcagccagcatcacagaccaaagtgggtcacctccagctgtggggatggggagaaggggcgctagtgactatggacaagagtagggtgcaggctcctcacagcagtggccagaagtcggttttctcccatcccagcctggccagggagttgggttggggagacctgcacctgggacaccatgggacccatctctggcctgactgcctttgctcctgggcagtcccctccatgaaggcagacagatagacagcagcctcaggggaaaggggccctgtcctctgagctcagcttttgcttcctcctgaccaggggtctcccaggcctcgtgcccctgggttatctttcaggggcccacagtcctagcctcaggactcctgcatctgggcatcatccctgatgccttctgccataaatcccacccctggccagctgaaacctggaggaggggtcccccgagaccctcctggacctcgtggccctgagttgagtcaggaagccccgttgatgccatgggctctgcaggggccgggtgagggagggtgagcccagaactctgggagcagctttctcctgggactgggggatgggacacagtgagggcctggacagcccacccgaggcactccctcccatccctgccctcggccgctgcctggtcctggggggagggggcctggaccctctcagcacagcctgggcctccttcaccgccaggttcctggagtttgaggctgaggaggagatgcagattcagaaatcgcaatggatgaaggggccccagtgcctgcctcctccagccacaccgaggcttgaacctcgaggacccccggcccctgaggtggtcaagcagccaggtatggcttcccacattcccacaggagccatggcaaaggccaaaggggccaagggaggccactgtccccacaccccatgcttcccttcgagagggggatttgctccctccaacaggacagtttccaggagcatatgttcggtattgacctggtcaagtttcctagctactctctcccctcgcctgtccaaaactccacatatgctctgcccaggaagcagggatgagcggggagagtacacggcatattggtggctccaaacttcctcccaagcgatgctgtctcagatgtgcccctcctgcctcctccgggggcgctgcggttcaggtggtcctgacccagctgggacccacttcacatccccaagccctgccctcccctgtgtggtgccagcaggaggagcggccctcaccacgcccgtcctcctccctctctgcctcagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtgggctggcctggagtgctggggtctgctggattccagggggtggcactcccaggtccttggaattaagctctgttccttagctactcagcagtgtgtgtatttccatggatttgagtatctgtgtatgtgattgtgtgtgtgtctgtgtgttgctgtgtgtttgtgtctgtggtttgttactgtgtgtctttgtgtgtctgtgtgggtgtgagtgtggagtgtgtacgttacctgtgtctgtgtcttttcctgtgtcatatgtgggtctgtttgtgtgtctgtgtgtggtttgtgtgtctctgtctgtgtgtgtgtagctaccaggtctgtggtctgtgtctgtagctggtggtcaccatgatatgagacagccccaggagggtggggacggggcgctcgctgctttctgcatctcctccaggtgtccttggctccaggttactccctgcccaggaagctcacgccttcttccttctgtttccaggtggaggccgtcattcatccccaattcctggaagaattgctttccccagatccacagatggatttcttggccctaagccaggagctggagcaggaggaaggactcacccttgcccaggtaccccaggggcaggagggacctggcacacaaggcccacctgattgtctaatcccccctgctggggatgctcggcttcttggggagccactctggagtgggaagatgcaggttcagagggagtaggatggacaggagccagggaggggagtcagcatgcaagctgtggtgaggcccaacgggaggcccggcagagccacaccctctctctttgacataaagcccagctgcctcaggcttccctacctgccgcctaagtgccctggtctccaccaccctgggccccgctcacacctggggcagtgcccgtaagtgccccctttcctcccgcagctagtggagaagcgcctcctacccttgaaggagaaacagcatgcgagggcagcccctagtcgtggcacagcccggttggactcaagttcttctaagtttgcagctggccaaggagcagagagagacgtccctgtcccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagttcccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgcgttgggggcctcgtgtgtaagtgtgaataaatgtagttgtcttggaa

SEQ ID NO: 579 - DNA, 1165 bp, Homo sapiens
cggaggaggaagcggcggggcggaggcggcggcggccgggaagaactagaggtattccccgggcggctggaggactgagtcgagccgggacccgagtcctccggtatcccagcagccaccggaggcagtgagataatggaggaagaatgtagggagacctccagtggaccgcactccttctagcgagccgcggaaaccatagagatcagggctcagccggagggccggcccactgctgtcacgtggcctccatccgtgcgctttattggctggtgctggctttacggggttgaattttggacgctgcctgccattcgtgggaccgagtttcaggcagctggaataaagagagacatcgggggaaagccgcgagaaggccagcgtccctggctgggagcagagctagccgagtagggcgcccggctgtcaaactggccggcgcagtgcacgctgggccgccccggagcggtcgcagagcccgtcgggagtcgtagtccgggacgggcccgcggcattgtccgcgacgcagctcgggatccgggtcggggtgtcggccgggttgctgccgggcaccgtcgagcgttagccacccagcattgagctgccagcggctgttctccctaagcaccctcgctcacgtcgcctcgcctcgcctcgcctgaccggccgcagccttggataccagccttaaatcgagccgactacggcccagccccgcccgcggcgaggtgcgcggggttcggtgccagccgctcgcccctggcggggccagcctcttgatgcaccggggacgggcgcccccatccgactcttcgaggggcggcagggccccatctgtgtctttcgctctcgagcccccagctagagttggcttcagcggaatacctactgtgcgggattattcaacaagccgattgatcacattcttcagctctagcagtgcaaaggcttcactgaaaaagaacattacaaattttttttgaaagaaatttgggggtaaatttaattttaaatactgatttttgataacatttgatcttatgacagcatttgtatttttaattacagataggattacactaaaagtcatttctgacctgctcccttacccttatggctaaaataaactgctaggccctgaagcaaaggcgagccatgttctaga

SEQ ID NO: 580 - DNA, 12977 bp, Homo sapiens
aggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaatgtcccccacccctaacagctgcccactgcccctccccctctgcagaatgtctggggtcctatgttccaggaacctgtttactttcaaattttcctgtttcagttggactcaggagcatctggtgagccaggtcactctctgggtcttacccttggcttttctcattgtggaaactgccagacagcggtagtcagtgcccagcctgaggggatggcttcaaatggaggtaagcctgtagggatgggggcattatctgagtctgccatgcctcaactccttaggaattcaaatttgacactgccccggggacagttgatagggctgatgttgaggagggagggaagactggatgtccccaaggacatcacacctggggatggccatggcaccctgagtctgtgtttagggaggacggccccttagaggtggaacaagatgcctgggggaatacaccgtgtaggagaaaggacagagtggatggattgatcctttctagaaggagacaggtcacgtcattgtgtgtttgtagggagtggtgggatcatgttgtgctggtggccccgggaggatgataggcaagcctgaaccctgtgccatatcttcaggcacctggaaggtgcccttccatagtgttcagagagatttggactggagttttctagatcttagggaggagtggggagaagtggtctcagccagaaaactgttgggtgggttggctgtgacagagcatgtagtgacagcccctgggtgggcgaggctgggggctgctgtaactgccacagcccagagcccctcagctctctccctagagatggcttctccatcagttcaggtagctgttggctttgatttaacaggggtgggggcagatgaggaagttcaggcaacacagggcctgggtttcctgagttgttctgaattgtttgcccttttgtggaagctcaggtcttcagacccacttcctcttgtctgctagctcatggcctgtcctctgcactttgtgttactgtggagatgaagaatttgctcctattccatttatactacctcatgaacggggggcaggtgtggattcttgctggttctcagtggaagggtctggaaaggctggtttccttttcagtagaggaaggagagtagcgcacgaataggaagatggttctcttattattattattcaagttaggatacgtgtcctgaatgatgaggtgcatgtgctgtatcccttattccccttgactagagactgcatgaggtcctattgaacagggatgagttccagacaactttgcctcacccggcccatggcccaagaacccctggtttttggttggtcactatgttcagtcattgggagctcaaaggagaagggccagggatgggctccttgtcccactacctattgtaacatgaccagcagctgtgaaaatccctagacacctcccctgttagctctgctgctcgccatttgctggctgtgttctaatcgtgtgtggcttttgctggctatgcagtgacactgtctcaggggactccaccactgcctctcagacctgctccctgggaacagagcttcctgagtggcagccgggaccatcgagtactgcggaaagggtggcccgaatctgacccctatttagcacttgctgtgggtggtgccaggacaatcacttgcatgctgggcatgacagttatggattatcttcagggttcctagggcgctggcttgggaaagatttccatccagtggttttgttttgttatgtctgagctgggaaagaaaggggtttacaagagcgtcaggaaaaggaagattgaagaggagatggggccataatattcggaagcttctggcttcctgtcggccttctgagtgccgagcactgccctggggtaggcccctcacctgttgctgagcacgctgaggaccaccaagccgctgagagactcatccctgacccatggcttgggagatgcctgtgaggctgacagggtctgccagggacacccgagggagaccctcgggcagcgaaggcttggctgttacttcttgggagacaggggtcagggagtcttggtgaccggggccaggctctctagtggagcgactctccgtggaggaacagagcatccgatgcacactcagggacatttgcaagctgcagtttccctgtcatacgcccttagctgttgggactcccctctgattccccagtgactagtgtggacctggagaccccagctcattcacctctttcctttgtctccacagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaacttccccagcacacctctggtgacagaacaggatggctgcggcccgagtggggccggggcttccaacgtctttgtccagatgaggacagaggtggggcctgtgaaggccgctcaggcgcagaccttggtcttaactcagacccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatgtgagtgtcctgggggcattggagctggtcctgcagctcacacgtaaagaggctgctggatggacgggaggtcacgctgttcaggggagcttgcagggcggttgtgagggtgatgggctgcactatgggaaggtacattttcaacaatattaatctggctgcggctcaggacagactgtcaggggcctcatctcaactgcccgtcactgtctcgtgagtccagccaatccttactttcaataattttcacaacaatgtttacagaagacccaggtcagagagggttcctggtgtgacgtgagctacggtttgggtttaggtctttgagtacacaccccagtgcctcccctttaacccagtattgatggccaggagcacctcacatggggccgggggaaggagctgcagggcccagcaggaacctggcacatgcccgcagttccgctgaggtccagttagcacagcggtggtggagcctgcacagggggatggtcttgggtcctgcactggggccgatgccgggcaggtatttgcatcttcaccctcaatccctcctagaaaaagggacaatgatgcttcattcagaggatggtgaagagataacttgagctcacatatgacatgcatagcacagtgcctggcacatgctatgacacattacatgatagcagttatgattactgtccccattactatcattatcaagactaggccatctaggagagcactccccaaagccacgggctccagtgatagctctgagtgcaccatgagtccagcagcccagggccatggactgtggtgactgtgaggcagcaacgtcagcatctgggagagtttgtggtttcattcccagtccctgcctctctccaccctgcggtgcctctgtgaccctgtgtttcccgctgatgagcaaacgggagcttgagcacatccaccgtgcaacacactggccgttcccctagggaagtcccctgcctggggtgtaggtggaaggtggccccattttcatcccccaaaatctcgctgttcccgcaccctggaactggttgcattcctccttggagcggagtcccggtgcactggggaccctgattcttggggtggagctgccccaggctcacaggcctttgccatggctcctgtgggaatgtgggatctggacctgctgcttgcagtggcgtggacaccgctctgctttggttctggacgtgtgctcctgctcctcatgctccagggccctgaggctacgtccccaggggctgccttgctccagagtccccaggaagccggttaaatgctcagtcttggggccctggaacctgcactttaaccctcacccccaggtcattctgtgtgcacgctgtctcagtcagctcaggctctgccgtaacgaatgccgtagactgggtgctttatcaagacacattcatgtctcccagttccagaggccagaagtcccagatcaaggtgacagcagattgggtatctggtcagggccctcctcctggctggagagagctgtctctggctatgtctcctcgtggctgagagcaagagccctggcgtctccttctgcccttatcagggcttggattccatgactgggacccacgctcatgacctgctttaaccctgattgcctccaaatactgacacactggtgctgaggacttcagcacaggaatgttggagacacacatgttccacccatagtactgagtccacttctcaacactgaggactcgaggggcagtcggagaggccacttggtagcttgtgttgatgtttgatcttgggggtgtgtcctggggcctgaggagcccacatgggggagaacaggacagggacagatggcaggacaggtgtggggaggacaggggccaggtgttgggaccaggtgggcttgggatgaagggtgggcttatagactgagactgactgcactggtttacagcccagttctccgatccctggcccggcggaagcccaccatgaccctggaggagggactgtggcgggccatgcgggaatggcagcacacgagcaactttgaccggatgatcttctacgagatggcggaaaagtgagtctggggtcctgggagcggggcccgcgtggcagggtgagagtgaatgacagaggcccggtggccatggtggcttctcaacgtggagtatgaggagggtgtggagaaacccaggacactctgggcccctggctccctcaggaagctgctcctgccacctagagtgttctggggtctctgtcctggcctattgggaagcaccccctgcctggcctggggccatccctgccttgacactggaggtcatggcaggagcagccagcatcacagaccaaagtgggtcacctccagctgtggggatggggagaaggggcgctagtgactatggacaagagtagggtgcaggctcctcacagcagtggccagaagtcggttttctcccatcccagcctggccagggagttgggttggggagacctgcacctgggacaccatgggacccatctctggcctgactgcctttgctcctgggcagtcccctccatgaaggcagacagatagacagcagcctcaggggaaaggggccctgtcctctgagctcagcttttgcttcctcctgaccaggggtctcccaggcctcgtgcccctgggttatctttcaggggcccacagtcctagcctcaggactcctgcatctgggcatcatccctgatgccttctgccataaatcccacccctggccagctgaaacctggaggaggggtcccccgagaccctcctggacctcgtggccctgagttgagtcaggaagccccgttgatgccatgggctctgcaggggccgggtgagggagggtgagcccagaactctgggagcagctttctcctgggactgggggatgggacacagtgagggcctggacagcccacccgaggcactccctcccatccctgccctcggccgctgcctggtcctggggggagggggcctggaccctctcagcacagcctgggcctccttcaccgccaggttcctggagtttgaggctgaggaggagatgcagattcagaaatcgcaatggatgaaggggccccagtgcctgcctcctccagccacaccgaggcttgaacctcgaggacccccggcccctgaggtggtcaagcagccaggtatggcttcccacattcccacaggagccatggcaaaggccaaaggggccaagggaggccactgtccccacaccccatgcttcccttcgagagggggatttgctccctccaacaggacagtttccaggagcatatgttcggtattgacctggtcaagtttcctagctactctctcccctcgcctgtccaaaactccacatatgctctgcccaggaagcagggatgagcggggagagtacacggcatattggtggctccaaacttcctcccaagcgatgctgtctcagatgtgcccctcctgcctcctccgggggtgctgcggttcaggtggtcctgacccagctgggacccacttcacatccccaagccctgccctcccctgtgtggtgccagcaggaggagcggccctcaccacgcccgtcctcctccctctctgcctcagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttctctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtgggctggcctggagtgctggggtctgctggattccagggggtggcactcccaggtccttggaattaagctctgttccttagctactcagcagtgtgtgtatttccaaggatttgagtgtctgtgtatgtgattgtgtgtgtctgtgtgttgctgtgtgtttgtgtctgtggtttgttactgtgtgtctttgtgtgtctgtgtgggtgtgagtgtggagtgtgtacgttacctgtgtctgtgtcttttcctgtgtcatatgtgggtctgtttgtgtgtctgtgtgtggtttgtgtgtctctgtctgtgtgtgtgtagctaccaggtctgtggtctgtgtctgtagctggtggtcaccatgatatgagacagccccaggagggtggggacggggcgctcgctgctttctgcatctcctccaggtgtccttggctccaggttactccctgcccaggaagctcacgccttcttccttctgtttccaggtggaggccgtcattcatccccaattcctggaagaattgctttccccagatccacagatggatttcttggccctaagccaggagctggagcaggaggaaggactcacccttgcccaggtaccccaggggcaggagggacctggcacacaaggcccacctgattgtctaatcccccccgctggggatgctcggcttcttggggagccactctggagtgggaagatgcaggttcagagggagtaggatggacaggagccagggaggggagtcagcatgcaagctgtggtgaggcccaacgggaggcccggcagagccacaccctctctctttgacataaagcccagctgcctcaggcttccctacctgccgcctaagtgccctggtctccaccaccctgggccccgctcacacctggggcagtgcccgtaagtgccccctttcctcccgcagctagtggagaagcgcctcctacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggcctgaatggggagggcaggaagggagggtctggggggaaggggctggggagtgggggtgggaagcagtgtgttgggggcctcgtgtgtaagtgtgaataaatgtagttgtcttggaaaatgctcttggggctgctgcctctgtcctcggtgctgtgctgctccgtggagggtgtctgtgagggagggcagaggaactggcagatgccaggctctgggaacccacagaggccggccccactctttcctcctgacgtagggagccccttcagatgctccagggactgacagatgctgaggaagccctgatccctcccaccacccactcacaaggccctgcctgctttagggaggcttcttggggccccctcatcgttatcagcatccctggaaaatcctgggattggagagagctggctggctcttgttctgctcggtgggagctgaggagaaggcagccgcctgcaacatggacatggggagaggaggctgctcctgcttaaccctcatcaggaagagcgcgggcactgggctgaggggagacgttgaggtgaccatccacacaggtgtgtttgggatacgatgatgggtggggagcaggggaagtccttctgcctgtttctgggcaggagagagtcttgtccaactagctaaagcagatgctccttgctgtggccacagggactggcctcggggccctcaaggtcctgcatggagccccccacagctatgattcccttcccatatgatgactgaactcatgtggaattgatgtagacacagatttacattggtttctaaaacagttccctcccaacacaccatcaccaatgggaacaagcatgtccagtccatcaggcgcagggtgggggtttctgctggttccagggcccggaggagctggggcccaggccaagaggggccgagggtcagccgcccttctgccaggcacagaccccaagggcagagcaggggctgcctgggatgtggcattggctgtctgggaagtgccctgggagttgggggctaggtgttcgccaaagggagacttccagagtctatgagtgagatgaggactgcatcaggagagggaccgaggctggggaggatgctctgctctttcccaggttgtcctgtcttcccaatctctgctgaactgccctcaccccatgggccaactctgccccccttacccctaacccacctcttagaatctcagatcccagcgtggacaggacccggcacccaccctggttccctcctggccaacaccttcttctccacggtctgagttctgattcctcccccagggcgcttattggctcaggacccctgtgactgccagggcactggtcccagcactgcctgcgtgcagagctgtggtcacggccctgggggctggcccagcagcagaggctggtggggcaaagctgtctggtacacggtggcctggcccctcggccaagtgacaaagggagccatgtttgggtcctctctggccccatctgcccacagaacacagcagtcagcctgacagatgcccctctgccccgtcccttctgctcgatgtgggcagtgtcggaggcctgctgtcttctgtggcctttgggaaggagagtttatcttggcagggcttccccagctcagtgcacgtcaggccctcggggaaaatgtggggagcgaagagtcactggtgggtgatgtgggcagctcccgtgactcctctacattcacggccatcctcaggagataaggtagcactgcccctttgcagggtttaggaatgttaagtgagccgtgtttgaagggaacatggtccatactctggcgtgtgtgggtgcccagccaacttcctcacctaagggtgaaagtgacaccttggggctcctgctggttaccccactggctgttgtctatcccactgtccctgtccttgtcttggctgagccattcctaggaagcagaacttgtgcttcctccacctctgtgtcccacctgagccctacaatctgcccctaaatgggcacagtggggctgactggggggctctggtagactgaacatacgtcccccgcccagttcctgtgctgaagccctaacccccaacgtgatggtatttggaaatggggcctttgggagttattcagggttagaagagaccatgagggtggggccctaatgatgggattagggccctggtaagaagcagagaccccagagctctctctctccctgacacgaggacacactgagaaggcggccatctgcaagccagagagagagccctcaccagaaccttgcccactgggatgctaacctcggacttccagcctccagactgtgacaaatacatttctttttttaatatgtgccaccacccccaagtctatggccctttgtccgagcagccctatgtgactaggacaaagtccataatctcaagaacttccttcatgactggtatctggaaaccgtgcatcagagccacgggaaagaaaggctcagccctttacaactgtcagcacacctccaccccaagtgcagtgtatcacacatgaaccaggagagcctgggacacagtgaaaaggaatctgtaaatacccatgatgtcatcgcatccacacttggggaagccatgcagcttgctcacagcaggtgctgggggtgtgctgaggctcttggtcggcttggcctccctgctcacacacccaggtcactctctgggaaccagtgcggctggggtggcccctggcaggtttgcctccagagacccctcccttcaccattggatgacagatccccgaagaagccatagcctcctgggaaactccatctgacaacgtgagcaaggcttgcccccgttagtgaacatgctgtgctttctgacagctatgaggatggacttgatccaggtggctgcccttttgtagctcactttgattctaacttcagcgttgcatgatgccctatgaatggaatatacaatgtgtgtctttcacatctgtcttctttcacttagaataatatttccaatggcatctacatttttagtatgtatcattacatcaaacctttttgttgctgaataatattccattaatggatatactaaaatttatccatttatcagttaagaacgtttgggtttttttcactttttggctattgtgaataacacttctaagaacatttgtgtacaaggtttcctggggatgtatgtttccatttctcatggctacatacctaagagtgaaattggtggaccatatggaaactctgtgtttaaccatttcagaaggtgccagactgttcccagtgtacatgaaccattttatatacccactagctgtgtgagggtcccagcgtctctccatattcgagccaacatttattatcaactctctttttgataaagtcatcctagtggttctgaagttgcatctcatcgtagtttgcatttgtgtttctctgatgttgaacctctttcacgtacctattcgccacttgtatatcttctttggagcaatgtgtactcaacatttagtaatttttaactggtttgtgttttgtcattgagttataagaattctttatatattccagataaaaatgctttacaag

SEQ ID NO: 581 - DNA, 11128 bp, Homo sapiens
agtaatttcacaccactttattgtggaatcaaagacagaattcttacagaggtcttggttagttaagaaaacatccattcaaagatttgattcacaggacaccctcactgtctttctctttttttttttttttttttttttgagacagggtctcacttcgttgcccaggctggaatgcagtggtgtgatctcagctcactgcaacctctgcctcccaggctcaagagattctcccacctcagcctccaagtagctgggattacagccatgcactgccacccctggttaatttttgtatattttttagagacggggttttgtcatggtgcccaggttggtcttgaactcctgggctcaagcaatccacctgcctcagccacccaaagtactgggattacaggcgtgagtcaccacacctggcccttgcttactttcgtacttcccatgaggcaggttaccaaattggtgaaattaaccataacgtcattgtggtgggcaagcagatatattaaaagcaaagatacagcaggttaacattaaattttgctcatcccaggacaaacctggccacaggaggcctttgccagtattctgaaaagtgttgtgaccatctcctttaaagctcagttaaaggtttctggctggactccaggctgcttcaagctctttgcttgtctttatcattctttaaggagggacccagacacagtgtgcagaggcctgaatcctccagaccattctctctccaccatgagtcctgccgtggggacctttccggctccctttggccttatgagccagaaaatcaggctagagcctaaagagaacagaaatttcataatcaggcctgttctgtgactgtatgggggagctgaaggacacaatgggctttctatattggagactacccatcatactctctctgaccagggagaaaggacagatgctgtgtgattttgcagtctgtgatttggcttcttattctcgctgctctctacacctcattatttacttcactcccctgaaaaaaatgctccctaacaggctcagtacccaacttctgggtattgctgcccacatttgccttggttctaccttttcagattgcaggatcctgaggttttgcttggagcaactcagattctccactagatctaagatctcacctagtcctgaggatttccttaaagggaaggggaaattagatagatagatagatagatagatagatagatagatagatagacagacagatagttgctgcctttgctctacagcatctgcttggtgaagaggctcaggatctggatcctggcctctcagctctcaggaaccccattcccccctgacaggggtggcaagttcatcctattattcattaagaaatttgaaaacaatcattcaggaattttaggtcaagagctggaaaaccccaagcctccgtcacctgagcaaagggagatactgtgagaacctgcaggatacacccatgttccaccacctgcccgaagaagcctgtggttcttgtcagcttctcaagggtgaagcgcagatcattttctgcttgagcagaagagcagaccaaagagctcattgactcaaggagcatcacggcaactgagctgcacctggaagagaagaatccagggtgtgatccatagccaaggcctgaagcaatggggcccatacttggcctctccagggtgagttgtgacccaagtgctgggctttagcccatgagtggtccctcttgccattttgtttcctcccaaagagaagccagtgttggtgatttcatttctcataatctccttaggagcacaggttttggtttgtgccttttttggatcaggttccctgcattgcagctgctataattaaaactattaacaacaacacagcaccacagaagcaagttagttgctaatggaatttgctgataatgctatcttctagagaccactctagtaactggagagccttggtgtagagctgatgataaaacctgttcctgcttttgtcagccatgaggagcatttcctttctagacagaggaactgaaacccacatgccagcccaaatttaccaaaagcagtcactggaatactcatcacaccatcatgtctcatcttatccctttcgttaccttcaaatacggccccatttcctcaggaccagaactcccttatgtgggcagcaggactaaggcccttgagttacctgtagtgactcctcatcaaatggaggaatgtgccagtattttcggcaaaacatgaatctgatgaaacactgactgaactgtctcctagtttcaaaacaaattattaccacttagggcctctatttagggcaatcagagtcagaagtgggaacgcatcttgtcctcctaccttgattaacagtaactctagttgcaggatgatggtcaaatcctctctcctctaatgtgcagttgtgaaggatttaggctccactgctcctgcatttgggtggggcctgaatcactttcagtctagcacaggcgggtcacttcaggccttcccacctccatcagcatccttcaatcctcccctgacatctctcatttatgcttcctattgattcagagatcccatcccgagtggctaaaagaaacattcattaacctttctacaaagtcatgaataatccatggattacattgaattcatccctactaaaaccatcttcagaaattcagatgtagtaaccttctttctgaatttttttttttttttttttttgagatggagtcttgctctgtcacccaggctggagtgcagtggcatgatctcagctcactgcaagctccacctcctgggttcatgacattctcctgcctcagcctcccaagtagctgggactacaggcacctgccaccatgcccggctaattttttgtattttgtttagtagagacggggtttcactgtgttagccaggatgatctcgatctcctgacctcatgatccgcccacctcggcctcccaaagtgctgggattacaggcgtaagctaccatgcccagccaagtattctattcttaatgaacacatatatgcataatatatctattttttataatatatatatttagaattgaatgtcagagtacatatcagtgttggaggaagggaataaggaggaagcacagaaagtaaaaaggaaaaataggcaccaaaaaagatttggagaatggcagatggccaaggagatgcagctgggaagtgcctcttccatggagaggaacataatatctagtaaaccttcacattttaaacagatcttttgagagaaaacactgaaagttgacacagaggtgacacagacaccatggttgaagagggaagaaatggggcagtctgctcagagtcactagacaccaggactggcccatataccctgaacaaacccaaggaaggggtgagtgaagaaaccctgggacactacatacccataatgtatctctgagatcctagttacaggagtttctacgaccctcatagatctttggactggtaggagagctgcctcgagcacatgcagaggcacagtttgaacccacacagagcccagaaggctttgttgtgctgtgcagctgcagcaaaatgcaaccctaggtgcccatcccacaagtctccatttcatactgagtggctaagttcctgctgtctgccaggctgggagtgaaccacgcctggccggctcacatgcccaagataggccccatcaccaatgctgtgtgattaagttgcatctggtccacatgcccccttgcctgtcaaccccttcccagacctcatgcctggtcacgcctgcaagagggtgtccacagcacagcatccactgcatagcttgagtgttttgttgacagcctgggaaaagctcaccaccctgtccccaaatcacagccagtgcttgaagcttagaggccagaggacaaatccgtgagcccagtcccaactccccaagactcaagtataccacccagggacattgagctgagatttgtaacctaatctcaagtgaaggaggatcctccatagtcagaatgcagagaagggtgtggtatgggttctcatgggggcatgggagctggacgcccctccctttgcaagaccagaccatgaagggtatggcctgatggtggtagcttctttcccagggagtgtccttgcacagaatgcctggagcagctcaacaatgtgggagcagatagcttggggaaagcctagttggttgggcttgccgccagggcgagtgtctgtgggagatctgctgggtcaggggagtgtaagctaggcagactccatggttgcctgctgggctgaaaatcatgggctgcagactccatactggtgttgcacccattgtgccactgccctgcctggagatcctctacccttgaaatactgcatcatcagagcaactgcagacataccctaaaacctgctctgactttggtaagcacagtggactggtgggtctctggagagttgtgtgtccctagagatgtaatcctcagtgtggaccatccctaggggaagggggagtgcagcctgccaaagcacaacatgagacaaagaaaatgcgaccatggcataagccactgaaaggagcaccaccaaggcccagaaccagacttggagaaggaattatgtctcacctccatctcccctccccagtgcactgttgcagatgcaaaaatagctcttcccataggggcccagaaagcatgcactgaaagaagttgtttctcatgattctccagtgagggcaagcatgcaccaagaccccacctgccagctcttactcttaagtccatctaccagattgaagtttgagttataccatcatataaaaatacattgctaaaacaagcaacatctgtgaaagccactgcagcaacctatctgtaaccaaggaacatatatggaaacttcaccgtctgcaactacccagaaatgaagccaatcaatcacatacaccacagtcatactttcaaagagaataaaaaatataaaagccctgtgatggttaatactgagtgtcaacttgattgtattaaagggtgcaaaatattgttcccgggtgtgtttggagggtgttgccaaaggagattaacatttgagtctggactaggagaggcagaaccaccctcaatctgggtgggcaccatctaatcagctgccagcatggctaggacaaagcaggcaggagaaggcagaagagcagacttgctgagtctcctggctttcatctttatcctgtgctggatgcttccagttcttcagcttttggactcttggacttacaccagtggtttgccaggggctctcgggccttcagccacagactgaaggctgcactgtcagcttccctacttttgaggttttgggactcgaactggcttccctgctcctcagcttgcagatggcttattgtgggactttaccttgtgatcatgtgagtcaatgatccttaataaactccccttcaaatgtacatctatcctattacttcggtacctatagagaactctgactaatacaaaccccatctaaatgaatcaaattcaaaaaagaagtgtcaactcccgcagatggaaaggaataagcacaagaagtctggcaatacacagagccagagtgttttgtgatctccaaagcctctcactagctccctaggaaaggatcctgaccagatgtaaatgtctgaaatgagacacatagaactcagaagatggatgtcaaggaaagtcaatgagacataagacaaaatagaaatccaatgcaaagaaaccagaaaaacagtccaagatttgaaagacaacatagttatattaagaaagagccaaactgaagttctggaactgaaaaattcactaaataaatttcaaaatatagttgggagacttaaaaacagactaggccaagcagaaggaaacatttcaaagcttgaagactgattcttcaaattaacccagtcatgcaaaaataaagaaaaaatattttttaaaaagacaaagccttcaagaaatatgggatcatgtaaagaaaccaattctaccacgtattggtattcctgagaggaaagaaagagtaaccaacttggaaaacatatctgaggaaaaaattcaagaaaatattctcaattttgctagagatgttgacatgcatacaccagaaatccagagaacccctgttatatactataaagacagccatccccaagacacatagtcgttagactatctaaagttaacacaaaagaaaaaacaaatctcagacacagctagagaaaagagcaacactacctacaaagggaacccatcagactaacagtggacttctcagaagaaaccttacaatccagcagagattagaggtctatttttagtactctaaaaggaatgacattccagcataaacattcatattcttcaaaactaagcttcataaacgaaggagaaattgagtctttctgagtcaagcaatcggtaagggaatttatcaccaccagactagccctgcagaaatgcttaagggagttctaaatgtggacatgaaagaacaatacacagaaaaagcacagttaagtacatagtccacagactctataaagcaactacacaattgagactgcaaagaaactagctaacaaaactatgacaggaacacaatctcacatatcaatgttaaccttgaacataaatggcctaaatcctccacttaaaagacatagagtggcaaattggaataaaaaaatcagaatcacccatctgctgtcttcaagagacccatctcacaagtaatgacactcatgggttcaaagtaaagggatagagaaagattaatcatgcaaatggaaaacaaaaaagagcaggagtttctattctcatgtcagagaaaacagatcttcagccaaaaacagaaacaaggacaaaaaaagttattgcataatgacaaagggctcaattcaataagaataattaactatcttaaataaatatgcacccaacattaattggagcatcacgatacataaagaaatcactactagacctaagaggtagacagcccctcagtaataactgggaacttcaacactccactgacagtggtagatagattattgaggcagaaatctaaacaaataaattctggacttaaatttgccacttgaccaattgaacctaatagacatctacagaatactctacccaacaaccacaatatacatatatatttcccatcttcacatggaacatactctaagagtgatcacatatgcagttataaagcaagtgtcaagaaataaaaaaaatcagataatatcaagcatcttcttggaccgcagtagaataaaaatagaaatcaatagcaagaggaactctaaaacacagacacgcacacacaaacacacacggaaactaaagaaattactcttgaatgacttttgtttgggtaaacaataaaattaaagcagaaatccaagaattttttaaacaaatgaaaatagagacacaatgaacaaaaacctctgggatgcaataatggcagtttaaaaaggaaagattatagtgctaaatacctacatcaaaaagatagaaatatctcaaattaacaacctaacattgcacctaaagcaagtagtaaaacaagaaaaaaaactatatccaaatatagcataagaaaagaaataacaaaaataagaacaggactgaataaaattgagactcaaaaatccacacaaaggatcaacaaaatgaaaagttggttctttgaaagtgtaaacaaaattgatagactgcaagcaagattaacaaaaaagatccaaataagcacaatcagccataacaaaggcgacattcactcgagtcccacagagattcaaaagattctcagagactactatgaacatttctatgtgcacaactagataatctagaagaaatgaatacattcctggaaacacacaacctcccaagattgaaccaggaagaacctgaaacactgaacagaccaacaatgaattacagaatgaattgaataagtaatagaagcctgggactagatgaattcatagctgaattctaccagacacacaaaggggagctcatgccaatcctactgaaactattccaaaaaatcgaggacgagagattctcctctgacttactctacaaaacctatatcatcatgataccaaaatatggcaaatactcacacaaaaaacaaaaccctaggccaatatatctgatgaacatagttgaaaaaaatcctcaacaaagtacttgcaaaccacattcagcagcacatcaaaaagataatacaatatcaagtgaactttattcctgggatgtaagggttgttcaaatatatacaaatcagttaatgtgattcaccacataaacagaatttaaaatgaaaaaaaaaaacataagattatctccacagatgcaggtaaaacatttgataaactccaacatgccttcataattaaaaccctcaatagactaggcattcaaagaacatacctaaaataataagaaccatctattgacaaacctagtctacattatactaaacaggcaaaagttggaagaattcccataagaacaagaacaatacaagaatatccactttcaccattcttattcaacttagtactggaagccctagccagaatgatcagacaaaagcaagaaacaaaaggaatccaaataggaaaagaggaaattaaattttatttcttcactgatgataggattctatacctagaaaaccctaatgattctgaccaaagactcctagagttgattaaaaatttcagtaaagttttaagataagaaatcaatatacaaaaagcagtagtatttctatacaatgcaatattcaaactgagaaccaaatcaagaacacaatcccatttacaagagccacagaaaaaaaaaaagaaatacttaggaatacctctatccaaggaggtaaaagatctctttaagtagaactacaaaacactgctgaatgaaatcatagatgacacaaacaaatggaaaaatattacatgcttatggattggaagaatcaacatcattaaaatgtctttactgcccaaagcaatctacaaattcagtgcagttcctatcaaactgccaaagttatttttacacagaattagaaaatcaattctaaaatttgtatttaactaaaaaagagcctgaatagccaaagcaatcttaagctaaaagaacaaaggcaggggcaacacattacctgacttcaaactatactacgaggctacaataaccaaaatagcatggtttgggtacaaaaatagacacatagaccaatggaacaaaatagagaatccagaaatgaagtcccatacctacaaccaactgatctttaacaaaattgataaaaatacaatggggcaaggataccctattcaattaatggtgctgggaaaactggctaaccatattcggaagaatgaaattagactcctgtctctcaccatataaaaaaattaactcaagattgattaaagacttaaatgtaaaactttaaactataagaagcctagaattagacctaagaagctcttttggatattggcctatgcaaagaatttatgactaagtactaaaacacaaaagcaacaaaaacaaaagttgacaagtgagaccaaattaaactaaagagcttctgcacacttgcatgttatattgcaaatatgaaatagcaaagacatggaatcaacattggtttccaacaatggtggattggataaagaaactatgatgcatatacaccatggaatactatgtagccagaagaaagaatgaaatcctttcctttgcagtaacatagatgtgcctggatgccatcatcctaaatgaattaagatgtaaacagaaaaccaaataccgcatgtcctcacttataggtgagagctaaactttgggtacacaggagcaaaaggatggaaataacagacactggggcctccaaaacaggggaaggaaggagggcaaggtttgaaaagctacttattgggtactatgtttactattcagataataagttcaatagaagcccaaacctcagcatcatgcaatatgttcatgtaacaaatgtacacatgcatgcttaatctaaaataaaaattaaataatcaaataaaatgatttccatgaataaaatggtagatatgattatgtggaaaatgctttactatttattatgtggtgaataatttaataatatttaataaatacatgaatgaaaaatagctacaactgtgtgttaggatttcaataattttttatttcattcctaataacttttatgtattattatatacataataatatatatagttaataataacaaaaacaacatggtattgaaataatttccacccagacggaggatcaacatatttaagtgattacactactcaagataaaaatcatttatcaaacagatcaaagtcatttacctgctttcctttttataggtcctaggaacacacgtgccacagacaataaaacatcacttcccccatcccactactttggactttatttaacatctttgggtagaacagaaactgttgataaggtgagttttgttttatagacaagagaggaaaatggatactttgtgtggtctgggccttagaaacagactaagatctttttttttctattttgctttttttactaggataaaatattaattggcaaaacatcgaatacaagcttcactatcataaaatcaaaacatttaagcaatattccaaaaaagatttgacaaaaactagacaccaagagtacaaaaattacacatcaacacaaagcataaaaaatgtgaactttcaaattaaacagtcaaaaacatgtacctgcatgatcacctccacaccttgactgccttcgtctgcagcacgctgctggtaaaggctgggtggctgcaccgtcgtcccctaacctaacattgctttcatctgtgaaaattcgcttgatagccaattaagccatggaggctattacatttacacggaggctacgcacaatctcaggggaggctcaaacagcagttc

SEQ ID NO: 582 - DNA, 1135 bp, Homo sapiens
acctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaagaactgtgagggaagttgtggataaaaatggtggaacacaggtcatttttagtttgtgcttggaatatgacttaagtatctcctaaatgtgatacagaagaacatctcatcccatatgcatgagatactaattaatgatgaa

SEQ ID NO: 583 - DNA, 8759 bp, Homo sapiens
attactttatccatgtaagatttattaaacatgtaacttcgttggaaccaacaaagctactttcatgtttttatgttgttctttttagatatttagattaaccagataatcttaaattatcttagaaattagaaagtttctgcagtattgttacatttgttccaagtatacaagttgtttctatgcactaccttctcaatcctgtgaaagaagtctattaccaaagcaatttctaacacattgctcaaaagacacagtaacgttgtgaaaggcattttgttggatttagtcccattttagtatccccttaaaaagtttgactgatgactctggatattcagccaacagtgttgtgtcaaaaacttgcttgaatttatctaaaaattcatagtcggtgctgaacctgaatttgtttgcccaaagcagcaccgtccctggctgggaaaggtacaccatggtggtgagcagcttgtccaggaagtagtgatggtagaccacatctgaggctaggacgtaatcatagtaaaaagctgacttgggaaagtttttgtccaggtcttccccccataccagttctttcacttcaggcagatgtgctgtacattgtagtgtgttttttaaaagattgtattgaaggtttcccaggacatcaggcaaatctgttgctgtgacttgagctcctaagagaaaaagaaaacaatgacctggaaacatctgggcagtcacagtgtacatatacccagggagaaacacaagaaacaactggattccttagccttggctctattggtgggtgggctggacatgtttgacctaatgtgggctggctaattcttgtgggtggtccgtcccgtgcactgtaagatggtgagcagcctccctggcctccaaccacctgatgtcagtagctcccccacctcacctcacctgtgggattgacaacagagattcagagtcatgcctctggactcaacttcgtcccatggaaactggttgattggagtttattaacctctctgagactcaatgatctctgtagataacagcagtaattcctgccgcatgacattttggggagagtcactgagtgaagttagggccaggcacctaaaccacagcctgtcatagagtaagcacttgctattgttgttacagtaaagatctggatactaggtcaggaataaacaaacaaacctaaaatactggccacaatggaaacaaggcctggtccggcaccaatttcaagtatttttgcatcttggaaattcaattcctcggcatgttcctccaagtattgacacaaagccatagcctaaaaaataattataacttttcatgtgggcattggaacattggaaaccagtagcaaccctttctggcacccaaatttaaatactaaaagacatgttattacatatgttcagtttatattcataagaacccaaatgtacactcaatgccatatttagacctctgaaataaagaagttataataaattgcatctcaggaactggggaaaaagatttgttaaattgcctcctaaatctccaaagaataggaagaacagtagatcagcttagctctttcaaatcagggcaatgttgggctaaaagaacagcaactccttccactggtttaatcatgttggtctccaactgctttaggaatgttgttttatgttagaattctttcttgtaagagagttttttaaattatagaagtaattttttaaaatgtcaatttataaacttgaacacctctttcctgactcctttaccaaaattcaggttggcgagcactttgccgtattgagcgacgggttagtgactttttttaaagtggttcttctaagaaacagacagttcagaaactgcttctcagacttcagtgtgcaaacagattccctggatagcttgttaaagatgcagatcctcattcagtaggtcgagagtggggctcaagatcctgcacgtctaaacaagccctgacatgatgctcatctgctggcccatgtacccactttgagtagtagcaagcagatttttttaaatgttttatatatcaacaaatattgttagttttttatacaggaaatcaaacttccctttcttctttattcgttctcttctccctccaccttcctctaacctttccacaaagagtaaagggtatttgatttgcattgattgctgaggtgtttacgtgtatggcaatgaggcatcaactagcagtgcccttgattggagagattaggaagagttatgagaagaaatgacaaaaagttacttaaatttgagtataaatagcccagcgtgaggaacgtgaacactgagatttaaaaaacaatgaactctataatttacttatacatttaggccctagctaaagatatgcccccatcttcctctggactctactttctatttggggcccagtttggagtgggggcagccaggatgattggagacgtgtcactcttaggattaccagtggtaggtttggtagccaacctgaccctgtacgtcactccatttcatcctcatctgttcatattgaactgccacgggcaaagatgaatatgacgcagtcacctctactgtctgggaactcagtggtggggcttaggggccatgtcagccaattacaaactgaattctggggaggtaagtgctgtagaggaggcagacagctggttgaagggagaggggtcaccacagagccgccgaggagtctgggccgacttcatggggccggggagaagccagctggtgtggaaggccagggcggtgggtaaaatagcaacatggtgtgacataaatagcaccaactgcagcacgctgcagggagctccagagcttagaagggaagttttgaagaaaggagttctttggtccttaaggagagaagagaagtatttgctgtgggggctgggaggagggggtcaatgtcaggaaaagagtgtcacctagagccattcagagggcagctctgaggaacttcctggagatggctgcaggggtccttcctggtgccctgccctgtgaggggctggccgcagggtgtcatgcggagacaaagcttttctcagggacagctgtgtcttttgacattgcaaacattcccccgccagccccttgtcctgttagcaaactctgaagagatcttttcacagagttgcacctgaagtcgcacaggaaaagggcgccttcccactctagatgcccttcttgtgcagctttcaggaagcaggtttcatgagaggctagtgtttggtgcatgagtgataccttgttcagaataaaacagggggacaaatattcttttttcaatttctgatcttttttttaaaattattatttttaaaagggagatggggtctcactatgttgcccaggctggtctcaaactcctgagctcaagcgatcctcttgcctcggcttctgaaagtgctgggattacaggcataagccacatgcccggcctctgatctcttactataccactttctcgctacaccactgctgtcgtctatttgctgaatgtgttacaataggaagctgtgagtagtttggtgattttcaaactcgtttttaaggcaaagaaaagcctttagttgaaggaaattatatgcataaggtgtaaaaatagagctccctgtttgggagtgagtgaaggtcgacacctaagagcctgaagccctttggctacccttctccccatcctgtgccatcgccagatgacctgagggagccccgtggaaccactaaccaggaatactcaatgtgggcaccctggcccagcagataggcatcaccccggaatgtgtaagacctcctgaatcagaatccgcattttaacaagactgcagattgagaacttctgatctggagcctttctaatcactgacaacatccgcagtgggaaaagcaaccacactggctctgagggccactgtctatcttggctctgccctgcaccccagtcgggagctttaccacgccagcagactggcctgcgttcccatttcctcagctgaaaggtggaaagaatattacattaatgaggacagttcatgtgagcttacgctaggacttcatttaatctcacaatctgaaattaattctcacaattctgacaaccacgtcaggagcactgtagacattacgaccaccctaggttttaaatatggaaatgaaggcaaacggaggtgaggtgaacatttgtgactacccagccctgaaatggcagcttttctgactaaaaatccagaggactgcccccatttcagcgccatcctctcagggctgtggcaggggtgacatgccacaaagtcatgcttcctaaacatccctaccgacacagcccccatggaaaagagatgaatggctggccggccgggcgtggtggttcacgcttgtaatcccagcactttgggaggccgaggtgggcagatcacttgaggtcaggagttcaagaccagcctggccaatatggtgaaaccctatctctactaaaaatacaaaaattagccaggcatggtggcgcgcacctgtagtcccagctactcgggaggctgaggcaggagaattgcatgaacccaggaggtggaggttgcagtgagccaagatcgtgtcactgcactccagcctgggtaacagagtgagactccatctcaaaagaaaaaaaaaaaaaagagagagatgaatggctgagggtcgatgggcgtggctcggagatgcccactgcaaaatctaaactctaaatccctgggtttattcttaacaatttatacaagttttgcattcacttcctcatatagctgagtttatttaatataaaaataatgtttcgagaaacagagcttgaagcaaaaccagtgtttctgaaagaaacactgtttttgctgatcccaagcactccaccaacaccctccagggggcaagcaactgaacctcaaattgagaagcaggatatgaaggaacttgacaaattgtccaaggcaactctgaagtacggaattgttatctccagaaatcctgacatcacaaatatgacagttctctcacccctggccacaccaccgctccgtaactctctatggattcctggatgacaatctcctttcctgcaaaccgataatgctcctgagtgtagctggcgtaatctgtaggaacaaatttctggaggctatgaagagatggttctatcttgttggattctgtgaagcagaaaaataaaatggagttcatgatttgttcaaatccagtgcaaagacacacttggtataattgctaagatggcattagattgaatgacctttacataaagagaagggatgatgctatcaaggagaacggctgcaaattggcacaaaattgaattatatggggtgatggggacatgaaatttggatgtgacagttttatcagatgacaaaatgccaaagaatgctctgggccttttctttatttaggggaggacagaagatgtgtggatcggtccccaccctaaattttgctgatggaaaaatggcgaacttaccagcaaaattgcacgaatgagctgtctggatacagaggaactaggtaaacacaaacctgcctttttttttttttctttttgagacagagtctcactctgttgcccaggctagagtgcagtggtgtaatctcagctcaccgcaacctctgcttcccgggttcaagtgattctcctgcctcagcctcctgagtaactgggattacaggcgtgcgccaccacgcccagctaatttttgtatttttagtagacacggggtttcaccatgttggtcaggctggtctcaaactcctgacctcgtgatccactcgtcctggcctcccaaagtgctgggattacaggcgtgagccaccacgccccgccagacctgcctatttttaggtcttgaagtgaagtaacattcccacgtgttggctggagcatgttccttcaatctttcctacaattgctgttcaaaaggtagaggcccagccagccccacagccctgggggaggatgtcagctgagctctggctattaagttactattgctttaaatactcctttaaacccatgacccatctagcagctctcagatggcatataaaatgagaggaaaagagcacctgatcgggctgacatcaagagatcacaagtgtttgcaggttttccagagtgtttaggaataaaagagcagtgagtcaaagtgtgtggaagaaggagcaggagcagaggaaaaggtgttggtcccagcgggtgggaaagaattaacagtgcggagagtaggggggaggaaggtcagttttgtttgcacgaaacctgcctttgtggcctgggatatgactgtaaaatgtttaaccgggggtcaaatatgggctttggacaaaggtagaagggggcagccggtgaacattggaagtgttttaatctgaaatagcctctcaaggtggaaggcaggaggaggtgaatacgaggcaaagggaagtgggtcttgggagaaacctggtcagcagggcatccctcaggtcgggggcagggcctccgggtgtttcaggtctcactcattccatacacactggaacagttccctgccactgctctgcaaatgctgataacagctccacagtaagtagagggatttggagtgagcctttagaaacagtcacaaccatttgacgatgcctgttgaatctaactacaaacaaaacccggagcttgtattttatatgtctgtatatattttcatttaatttctctagaaattcatttttgttgtatattacaaaagtatcagtgtgcagcacactaaaaaaaaaatgtgaatgaagtgactcatttgtaaattagcatcatgggtgccttcagttcttcagagtgttgttttagcctgtgactttgatttagtatgttctaccactttgaaggagaattctctgccctgacaaaaaaggtgagcttccagaaacctgggacctcagtgaacttgcaagacgcctctaataaaggtaaccaattcagtcctgagaccttgtcctttgcggtcacctgccctggtaggaggctgtagggagattgtagggaaaggagggagccctgtagctttccccacctcttttgggaagccactgacatctagcagaaccccagctcccaacacagggctgagaggctggctctgaattctggtttagaggcaggaggaaggccgaaaaatagggtgattaatgtttaataactagttcagcaagaggggaagaagcggtgattgacagcgtttgacgattgctctggagtaaatactcccaccgtgccgttttcagagaagcagcatgacttcgctggggaaagacgtgcagtacctcgccactgtgtagtgttcctaccgtacagacaccacagacacgattaacctcgagagcatagatattaggaagaggtaatagaataattgatgatgagttttgagtgtttatcaactttgcttttaatatacctttgtctttaatataatctatttaatcataagattctaacttaaatttaaatgatggttatatataacaatcagctacaaaaaatgctgaaattcaggtgccagtacaagccgtcgccagcacaccactgggtggtggctcagagcatcagggacctgtaccagcccctgccggcttccctgccctgccccactctcatccaggccatgcctgtccctccttccaaatgtcaccatctggggacttatttttctctagagactaggaagagtaagtaggctgattttgaatggctcatcatttcacaggtaaataaactgacaaatattaagcttgacagctgcacttttccaatcaacattgtaaggaaacatagacatacacgtattctctcataagaccctgtgaggttctacaacgataaagaaacatatgtttttgtgcctgaaatattttcatttattctctgtgctattctgatagttttagagagatcagattttcagataaggtagagttgcatttttacgtaaacaatgcagtaaaaatagacaacattctcatttattggagttgggatacattttttaccacctttaattatgaacactgtaaatgctgcatcttggcttttattagatcatttgttatgtctattatttatttacaactgaatccatgcccagaaatgtaaccctaaactgttacattgtcctaacggggaaatacagtttgatttataaagattcactgtatgacaaagctaccaagaatgtattttggtgaaaagcagaaatgaacctagattttttgttcttcttttaagttcttgttacaaaaatacagcaagcttagatctatacatagaaaaaaaacaaatgtgcaaactttgataagtaatgaaaaaccaggaattacttttaataagtaaataatgaaaaaacaggaattatgtttatacttgcaaaacatttttctgctaagcttcattatagcaaaaaatctaatgttaaaaggaaatggaaattcttgtcactgaaatttacttgaagatgtcatcgccaggaaaacaactgaggaaaactgttgaagtgatgaagaaggaggttaccttctaggactcccccggtgctgtctttctgcggagcccccttcttctcagcctctaaccagccacccggggagctgagtccttccccccggcgcccaggctgctgcgcggagctcagacacacgtccatagccgg

SEQ ID NO: 584 - DNA, 4584 bp, Homo sapiens
gatccagtacaaaaccaatttattttacattccatcgtgggcgatgggagaagctaaataataatttagcatgcatacgtagacgtttctttttatatataaatacaatatacaaaaataaagacagtacagttttgagatttccagcagtttgaacgctcgtgacataatccccccgaccccagagacgtaagcataaacccttttttctttttccaaatactctgcagaatggcggctccagaggcggtttcaagtttcataagtcaggtaacactgtgggtttccgccttctcggacgcggggaaaggggagacaggaggcttccccttgcgcggggtgggtcggttcttctcacacgcactcgcgcctcccccaacaccaaccaaaattaattttaaaagaaccagagttcaagtttcagccccctgggtctccctctcgctgtttcttgaagagcaggtgaggcgcccttgcttaaaagggaagcgcccaggaccggagccgcggccgaatccctccagccccggcctgggcgaggggtccatggggcggcggtcgagcctgctctcggggccgggccgggtgggtgcgggcgccggggcctccgggagaagccgccggccggggcgctccgtgcgcgccgcacctgctgggccgcggggctcctactggggcgcgggctggtggctgggccgcgggggcggcgagtcgtcctccgaggagcagtcggaggaggcggcgtggacgctggcgccgttgctgtaggggaaatggtcctcgtcgtcctcgtcctcgtcctcctcggggtcactgtccctcaagtcccgcaggcggcgtccgctgcccttgtctccgggcgctggcggccccagcagctcctcggctcccggctcctccgcgccgcccttccccgcgcccccgccgccgcccttctgtttctccgcttcctgcgccgcctgctctttggcctttttgctgcgtttccatttcatccgccggttctggaaccaaatcttcacctgcgggcacaagcgggcgtgagaaaccggccaccgccaccccagggcttcctgtccccggagtcccccggccgcgtgcgcctgggccccattgggtcggccctggaatggcctcagggtgagacgacttagaagcagaatggggagggggctcgtagcttcctcctccccgcaaccccccactcagcagcaaaccccagagctgggctggagctccgtgggagctaggactatgtccccaacgacccaggccggggacttttctacccgcgccctccgtctgcggaggaagggtcagggcagctggctacgtcgcggtaaatctcaggatgttccctcctctctttctggaacaaaatttctcgaatgcggcctggggatcaccttcttcagaatgaaaggaggggtggttaagtgctgattcttgggccccacccgaagctactgaatcggcgctctgggcaccttagatgaacccgtgcgcccgccgtctgaaccgtcgaggcgcagcgctagatgcctcagaccgcccgtgggtcacaagtgcaaaggtaacagtgtcccctgggaggccgggatgcgtcgggggcggggagggcgcgcacctgggtctcggtgagcatgagcgaggtggccacctcgaagcgcttgggccgcgacaggtacttgttgagcttgaactggtgctccagctccagcagctgctggctggtgaaggcggtgcgcggccggcggcacttccccaggaggttcgactgcgcctgggctggggaccaaagggcagtgaggcccacagccggctccggtcctcgccccagcccctcccgttgctgcttgtaccactacactcaaggccccagcgccaaggcctggccctgcagagggcggggctgttccctcactatcagtgcccactccccaaggaatgcggactcaggaccaccaagtggaaatggatagtttggagttaatgagaccaatttttttttttttttttgtctaggagacgtctgagtgtccctgttaaacagggcccatcgcaggaggcttcctctccacaggagccggctttggtagcagtggattgacccagaggcaagaggagaactgaggccagtcgggggccaggaagggaggttccgggaagcccaggagttgaaggctgcagtgagcgagactgcacccctgcactgtaccctgggtgacacagcaagaccccatctctcaataaataaaaaataataaaataataaaataaaggagcagtgagtgatgagaaccaaatctctccccctctcctcactgcgccttcctagagattcaggctcagatccaaacaggtctgggaagagctggtcctgctgttccaggtctccctgcactgcctccttaagacagaaaaggaggaggaggaggagaaaaagaggaaggaaggaagggagagagggaaagagggagggaggaaggaaagaaggaaagaaggaaggaaggaaggaaggaagggaggaagggaagggagagaggacaggtggaacaggaccaaacccagggtccaagtctgtgtattcaccagggaccctcccaccttccaaatgttttccttggcatgccccctcctcagggtgcgggcggcaggggcaaggcctgaggagactagaagccttttcaggacaattctcattacgcaaattacaggcagaggcgcaggcaggatccggttctctgtgtgttcaaggaggcctgcccggctttatttacataatttcgcacggttacatcacagagaattttatgacctcaaaacgagacttcccttgatttcccaggagcctgacaagtgttggacaataaaagaaagaaagcaaaggaaagaaaggaggccagccccaggcctggatgagctcaggtcccccgggatgggcagtttgctttagaggatggcccacgccccctgctttagtcaaacaaggccccgaattcccaacttgacaatacattagaactttaattaaaccactggctccggagggaccatttgggaaatgccatccaacaggcagagacaaccaattaaagaaaccaaacaggttttccccggaccagcgaggaggacttctcagaacacattccgccgtctttggcacggttatgcctgcccttttggattgccaggtgcagatacctcttctgaacttaagactggttgtgtttaaaatttggccaactctaggtcaacatttggaatcagaaataggcaaggtgtctcactttaataaattttctgagtgaccctgggctccacgaagctccagaaagcacccctaggaggcctaggaccacgggcccccggggctggccagccccctccgtgggcaacttagcgtccttggctctgggaaatgcaggtcatattggtggctttctatcagaagggatgggccctgggtcggcaccctgggtttaagcccaggctggcaggggattcgcagacgcagacgtgtctgaggtgaggggcagctttccctcttccagccagtcagtagggctgactctcccaggtgagggatgggtgaccactggggccttcttggagctgagctaggaaagcctggggcggctgtgggcaaacagccttctgcagggattcttctcaccctcttgtgacttctccagcctctggggtcctagattttctctgtttagtcacaaccacagcttccagcaaaggaatctgaattctggagtgtttatttctgttttcttttttgcttttcccctgctctgcctgcatctccccagtctaaacaaatccactcagacagaaacaatggggtctctttgtttgggtgttcggcggctgaaagcgttgagccatatacatctgctcggcccgactcataagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctccgaagcccatttctcttgtttgctgctcctgaagcactccctctccctggaggggccgcgggtctctctaacgccccagtgggggacctggcccaagttcctttccccggtgataagccctgacccccattcccgggcctgcctaattcagggcgctctcggctcgccttcccccggcgacttccttctcctgcagccttcgggttaatcattagatctcagtctcacacctccaactgccccttcccgttaagaga

SEQ ID NO: 585 - DNA, 5802 bp, Homo sapiens
gatccagtacaaaaccaatttattttacattccatcgtgggcgatgggagaagctaaataataatttagcatgcatacgtagacgtttctttttatatataaatacaatatacaaaaataaagacagtacagttttgagatttccagcagtttgaacgctcgtgacataatccccccgaccccagagacgtaagcataaacccttttttctttttccaaatactctgcagaatggcggctccagaggcggtttcaagtttcataagtcaggtaacactgtgggtttccgccttctcggacgcggggaaaggggagacaggaggcttccccttgcgcggggtgggtcggttcttctcacacgcactcgcgcctcccccaacaccaaccaaaattaattttaaaagaaccagagttcaagtttcagccccctgggtctccctctcgctgtttcttgaagagcaggtgaggcgcccttgcttaaaagggaagcgcccaggaccggagccgcggccgaatccctccagccccggcctgggcgaggggtccatggggcggcggtcgagcctgctctcggggccgggccgggtgggtgcgggcgccggggcctccgggagaagccgccggccggggcgctccgtgcgcgccgcacctgctgggccgcggggctcctactggggcgcgggctggtggctgggccgcgggggcggcgagtcgtcctccgaggagcagtcggaggaggcggcgtggacgctggcgccgttgctgtaggggaaatggtcctcgtcgtcctcgtcctcgtcctcctcggggtcactgtccctcaagtcccgcaggcggcgtccgctgcccttgtctccgggcgctggcggccccagcagctcctcggctcccggctcctccgcgccgcccttccccgcgcccccgccgccgcccttctgtttctccgcttcctgcgccgcctgctctttggcctttttgctgcgtttccatttcatccgccggttctggaaccaaatcttcacctgcgggcacaagcgggcgtgagaaaccggccaccgccaccccagggcttcctgtccccggagtcccccggccgcgtgcgcctgggccccattgggtcggccctggaatggcctcagggtgagacgacttagaagcagaatggggagggggctcgtagcttcctcctccccgcaaccccccactcagcagcaaaccccagagctgggctggagctccgtgggagctaggactatgtccccaacgacccaggccggggacttttctacccgcgccctccgtctgcggaggaagggtcagggcagctggctacgtcgcggtaaatctcaggatgttccctcctctctttctggaacaaaatttctcgaatgcggcctggggatcaccttcttcagaatgaaaggaggggtggttaagtgctgattcttgggccccacccgaagctactgaatcggcgctctgggcaccttagatgaacccgtgcgcccgccgtctgaaccgtcgaggcgcagcgctagatgcctcagaccgcccgtgggtcacaagtgcaaaggtaacagtgtcccctgggaggccgggatgcgtcgggggcggggagggcgcgcacctgggtctcggtgagcatgagcgaggtggccacctcgaagcgcttgggccgcgacaggtacttgttgagcttgaactggtgctccagctccagcagctgctggctggtgaaggcggtgcgcggccggcggcacttccccaggaggttcgactgcgcctgggctggggaccaaagggcagtgaggcccacagccggctccggtcctcgccccagcccctcccgttgctgcttgtaccactacactcaaggccccagcgccaaggcctggccctgcagagggcggggctgttccctcactatcagtgcccactccccaaggaatgcggactcaggaccaccaagtggaaatggatagtttggagttaatgagaccaatttttttttttttttttgtctaggagacgtctgagtgtccctgttaaacagggcccatcgcaggaggcttcctctccacaggagccggctttggtagcagtggattgacccagaggcaagaggagaactgaggccagtcgggggccaggaagggaggttccgggaagcccaggagttgaaggctgcagtgagcgagactgcacccctgcactgtaccctgggtgacacagcaagaccccatctctcaataaataaaaaataataaaataataaaataaaggagcagtgagtgatgagaaccaaatctctccccctctcctcactgcgccttcctagagattcaggctcagatccaaacaggtctgggaagagctggtcctgctgttccaggtctccctgcactgcctccttaagacagaaaaggaggaggaggaggagaaaaagaggaaggaaggaagggagagagggaaagagggagggaggaaggaaagaaggaaagaaggaaggaaggaaggaaggaagggaggaagggaagggagagaggacaggtggaacaggaccaaacccagggtccaagtctgtgtattcaccagggaccctcccaccttccaaatgttttccttggcatgccccctcctcagggtgcgggcggcaggggcaaggcctgaggagactagaagccttttcaggacaattctcattacgcaaattacaggcagaggcgcaggcaggatccggttctctgtgtgttcaaggaggcctgcccggctttatttacataatttcgcacggttacatcacagagaattttatgacctcaaaacgagacttcccttgatttcccaggagcctgacaagtgttggacaataaaagaaagaaagcaaaggaaagaaaggaggccagccccaggcctggatgagctcaggtcccccgggatgggcagtttgctttagaggatggcccacgccccctgctttagtcaaacaaggccccgaattcccaacttgacaatacattagaactttaattaaaccactggctccggagggaccatttgggaaatgccatccaacaggcagagacaaccaattaaagaaaccaaacaggttttccccggaccagcgaggaggacttctcagaacacattccgccgtctttggcacggttatgcctgcccttttggattgccaggtgcagatacctcttctgaacttaagactggttgtgtttaaaatttggccaactctaggtcaacatttggaatcagaaataggcaaggtgtctcactttaataaattttctgagtgaccctgggctccacgaagctccagaaagcacccctaggaggcctaggaccacgggcccccggggctggccagccccctccgtgggcaacttagcgtccttggctctgggaaatgcaggtcatattggtggctttctatcagaagggatgggccctgggtcggcaccctgggtttaagcccaggctggcaggggattcgcagacgcagacgtgtctgaggtgaggggcagctttccctcttccagccagtcagtagggctgactctcccaggtgagggatgggtgaccactggggccttcttggagctgagctaggaaagcctggggcggctgtgggcaaacagccttctgcagggattcttctcaccctcttgtgacttctccagcctctggggtcctagattttctctgtttagtcacaaccacagcttccagcaaaggaatctgaattctggagtgtttatttctgttttcttttttgcttttcccctgctctgcctgcatctccccagtctaaacaaatccactcagacagaaacaatggggtctctttgtttgggtgttcggcggctgaaagcgttgagccatatacatctgctcggcccgactcataagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctccgaagcccatttctcttgtttgctgctcctgaagcactccctctccctggaggggccgcgggtctctctaacgccccagtgggggacctggcccaagttcctttccccggtgataagccctgacccccattcccgggcctgcctaattcagggcgctctcggctcgccttcccccggcgacttccttctcctgcagccttcgggttaatcattagatctcagtctcacacctccaactgccccttcccgttaagagaggaagagaaggcaaggcctgcgcatggccattttaataattcgctgcccgtctcatgcctgggggtccgggcgagtcctcgcaggccccgggcagagccgaggcggcttcgcagctcttcccccgctcgctgggagccaagcgcagagaggggcaggcggtgccggtggaggatgcgcgaggccctcccgccacgcgcatccacgggggccgcagggtactcacagttgaagtcgggcatcttaggcaggatcatgcccgcggtggacgcgcgcagccactggtccagctggaaggtgccggcgcccagcttgatggggtcggcggggtgcgcggggtgcgcgccttgcacctgcgggtacgagtaggagagcgccgggtgctggcccgccagcgcagccgccgccgccgccgcggagtagccgtagaccgggtggccgtagagcgccgcctgcgccgggaggcccgcgccgccctgcgcgcccccagggtgcagccccagcgccaggcccccagcggcggcggcggcggcggcggcggcggcagcggccgctgcgcccggatgcgcgtggtggtggggccccccgtgcccgccgcccgtgccgccgccgccgccgcccgcgcccaggaagcccggcttgggcagcagcgcgcagtgcgcggccagcaggcgcggcggcgacgggctctcggcgcgcaggcggtcggcgggcgcagccggcggctccgaggacgcggggctgcagctgccgctagtcccgccgctcgccccgccgccgccgccgccacctccggtgccagatgcggcggcggcgagcgacgtgaccaaggccagcggcgcgctctgcgcagaggcggctcgtggggggtccaccgccagcagggcgtcgatgcggaaatttttggatttttccatcggctcgtttggggctggcgctcagggcccggtggcgggcgacgcggccgtgtgcgggctcgcggagtcagtgcgtgcggtgcaagcccgggggctcggtattgttatggtggttatttgccaataatcaaagtcgccgccggaaactcagccgagggtgaccatggtcccggcgcctcctccgtgcgggccccgccccgggccgcgctcgcacaaactcccacgcgagtgcttccccgcgtccgggcccgggagcccggttctttgcgctgcagccctcaggcgaccgcgcggaggccgctg

SEQ ID NO: 586 - DNA, 65646 bp, Homo sapiens
atagatctaaatatatattcgattttattagatgaaaaatgcagcctctcacatcagtgggggaaaagaggtactattcaataaatggtgtcagaacaggtggttagctctctggaagaaaatgaaaggatcagatgtcccccataaacaactactctactcagtaggaagaaaaaaacccacaaaacaatagcattagttcagttcagaaaatccagttcaagccaattattcaaacagtttttgggaggtaacactgtccctatgggaagacttggtatttttcagatttccctgctgtttatcaagatggcatatgggtgtagggagaagaagaggtgctggagccatctatccaggtccctgtactctctctggccctctggtctccacagcaaatgcccctgtccaccttgtctctgggcacatctgatgataacgtctgtggctggtttattgaatttgttctaggcttgtgtcccccaccgaccacctggctcatctcagctcccagcggcactgtgttacccctgaggttggctcctcttcaatgtccagaccgctgagccactctgcagtcctcaaatgcagagtgattgggtcactctccatggtgtccatgagaggctgccagccacctcggtggggtcctcccacaatcctccatgtggcacgtggggatctccaaatgacttctgtgcaacaacagagccgagcccggtcccaggggctggatggtgtccctccctctgatggacaccagcacagcacggactttcccgtcctgtctcttcatggtgggtgaagagcacagggagagtgtgcttcctggctgtgtcctctcagaggccctccagtccagtctactccggccttggagatgactgccgagagagggagggcgggctctgggtcacccagcttcatcctcttcatcttgccagttcaccagaggcagaagggatgaaggttccccgatccccttctctcctaaactgcccctagagctagtccaccaggcttggctcctaatgtgttaaatgggggtgaatggaatttagaagatctctttttctgaaaactatatatggctttcaagacttgccttgagactcagagctgtttcacaaccctttgttccaggcagggcccaggatccccttccaaattactgaggggcagtaagtcctggcactcagcacatggcaggaaggtcacttaaccagggaaataagtatcagtcaagttaatgtttccaaaatatactccttgtaacagacattacctaaatttggaaaagtgacacaatttcaagcagcagtcaactaaaacgattccttttgcaatttaggttaatatcataactataccactggagagaaaggacaatgaattagacgtgtgccacatacttctctcaaaaactttatgactcagttgtctggaagttgttttgtaaccttctaaaattcacacgtcacaaattcagaatttactataattataatcctgaacaatcaggactgttagcttcccacgatgaaagaatgactagctatgatgatttatatttcccaagaaattaacagcaaaagttcatatttaacctcattaagataataaattgctttaaacaactttgagcactttcttagacactagtattacatagtaatattcactattcgttaactgctgggaaatttaaaaatgtttgttgatactctctgttgctatgtgtcattgaaaaaaaatgagaagaaccaacgaggtcgctgtggtgtagcggtgagagcgtctgagactctggacaaggcctttgctgtgaaccacggggagaaggtggaagcagagtttgtggtcagaaggcctcgctctgctctacatggtctatagaccgctgggaaggtggccaggcacttcccttctcatctccacctctttctcatgaaatgggcgtggtaatagcccttaattcatggattgtcttgaggattaaaagagatggtgcatgtgaagcttttagcatgatcatggcatgtagtaagcactcaatacatggtaactactagcattatattgatattaccttcagcaaataagttgataacattatatatgtaaacatttatttaaagtatttttgtacaattccaggcataaagtggattctttatatgcctgttttaaaaatatgctgctttaaacagttctacaattcacgctatttattaatggccttttacccaatctgggacactattacagttgtggctttactcaatctcttccttttctttgggtaatcttttatcttgaactaccaagagtagatgaattgtgagctcatatagctggaacaaatctgacattgttggtttgttcaaacaattttttcaaatcagatttacagagggatagaaatgagaaaaggagttttatgttaggaaaaaaatggtttctgagaattctgaggctctgatctgatgagtgaagggaaccacaggcttatctgcacatcacttataccatttggtgagatctctggagaatggaacaccttcacagacaacatcagggataaacctgatcaccgtcccctttgttgccacatctcgcagcttctcccttctgtttttcctctcactctgactcgaggagggccctcagcgcagagaaaattaagtctagtgtttgcaggagggcaagactgggagtgctgggggtggggaggccagagtccaccactctggcaaagagcagtgtttatttgtgtgtttgaacgtttgttccctttgaatatgaaagaaaaagaaatgaggagtaattttagtaaggaggatttctaaagaagcagtcatttgtcaatctgaaattttttttaaaggaagaatacttgggttgggcttacaagaaaaataaattgcagtaagtgttaaaacttgccagtcaattacaggaatatattagtgttccatcgtagtttctaaaaccagacaaaatcatttcttgcaagcaggtaattccacagaagtttccaaacccatgagtttcactctcaggttccctctaggagcagaagtgcaggtttgcttgggctcctagcctctccctcagctccctcttttccctctaatggatccctagatgctactgatggctcccctaactgacggcaaattgcttgtgggcagggtctgtgccttggtttacaggtgtacatccacacagctcttagcacagtatttagattcatcgagtatgtgtgtaataaaaggtgtggctacgaaaaatcattttacaatattgtctggcacatggctgggaaagatcctgaggctctggagctggggtgtatgggacctggagcaggggtgccctacaactttgcccatttttattattctgccagtgtcatcccctcatttctacacttcctcaggatcagaggcaggcacacagggcatagacagaatatgacaagtcagagagaattcgaacacttattttaaccttttcaccaaatttttgtcagagaaggaaatgaagcaagataccaaggtcaaatcctcctctcttttcctttttcctatccgctcttctggtggagatgctcggctataaaacggctcaaaagaacagctagaacatggaaaaagcaatgtaatcagctggtgctgcaaagggcagtgatgtgtggacgaaggggttgctggggtgacccaggcagcaaggaccctgagggggcaggtaaccagaagctgccttgtggaggaactaaacctccggaaggatttttttttttaagaatgaaatgggccgggcgtggcggctcactcctgtaatcacagcactttgggaggccagggcgagtggatcacctgaggtcaggagttcgagaccagcctgaccaacatggcaaaacctcatctctataaaaatgcaaatattagcccagcatggtagcacgcgcctgtaatcccagctactcgggaggctaaggcatgagaacctcttgaacctgggaggtggaggttgcagtgagttgagatcgctccactacactccagcctgggtgacagtctcaaaaaaaaaaaaaaaaaaaaaaaaaaaagaaatgcgccaagtctcaggtatttatggactggtgaagagttgtgtggagggtggcattcccatcaaggtggcatcaggggcagaaatggacaaaagaactccaatgacatcattgtagaagatgtgggccacagagctacatgaatgggcaccaagggaggtcttaaaatctgcaactaggtatgagcccaaaggcactggagccattctctgagtaaggctagtcaaggtgatgatagaaatgcccaatcttttacacaggcacaggagtcagctggagcagaagacctgcagggagaagttgaattttcttctctagctatcccaggccacccagaagtcaggggatgtgaccaaaggaaaaggtgatcagaaggcaactatacctgctagcacagtgatgtcactgagggatgtcaatgccatcctctgctcttatgtcctgcagggatatgggaattagacttagttctagtagacgtagttctagtagacaggagactctggagtcctaattcaggtcagtttcccagtgatctgtcctcagttttttacctctcccctccccacactcaccttctaagttcaattaataatgaatataaatgccacaagccattaatgtgtgagattgtgatccagggaaaccgacaagttagaaatttgcaatatgaactcattcattcaacgaatattagtttacagcccatgggcaaagtatgagcaatgtagagacacagcaacgaattacaagggattctttacccctgaagcttcaaatgaatataacattaattttctcaaatcctttcatataaaatccccaagaacccccttcagtggttctctagagagatatttttttcttcagagactttcataatataatctatttgcaaaacaaatggtcagaggggagaaaaaaaaaaaaacctgaagaaaccaaaactagaattatcagccaaaaacagagaatagtaagtcttatctgaaatatactgtgataggccaggtgcagtggctcattcctgtaatcccagcactttgggaagctgaggcaggaggatggcttgagcccaggaattcaagaccagccggggcaatatggcgagaccccatctctaaaacaaataaactagccgggcatggtggcacacgcctgttttgaaaccctgagaaagcttctgaaaccctgaaaaactgaaaccccgagaaaggttctaggggatgatttgtctcttaaaccaaatttattttcccttaattactatatgcatttaattttaaaaatcaaatctatgaggcttctatcaaaaattatcagtccctggcccagttcccccacctaagttcatccacagagttaatacttcccacttcgtcagctctttattctgctgcactaaattatatccatattgtatgatcttgaatcagctttttagacatccactgacttccagttgtggtgggtgaagatttcactccccactgccatgtcaaagctggtgttcagacagtcacactgttacaaacatatggattgtactggttggcacagaagcctcctcactatccctgccactctggctgctccagctccatgtcctgggacaccctaccctgccccaggacccagcagctataagggcctccacaccccaccttactgctttaaccaatgtccatctaactgttcagtgcctgtgctgtactaattgctaattcccatcctttagcctcccagtgtaactgtcccaattttttttttttttttttactgaattcagattcagggtttttattattatggctatataaatattgttcactggagaactaatttgtaaccatgattacatttctttttttgtacagctttctgcctctactgtagtgaataactgccttattttttgtttctttgaacatcttaatcatattacaaaacatctcctttatacaattttctgcatagttaacattatcactcgtgttgtcacttttatttttttctgaaaatatctcttttggagtcctacatagtcctttttttttttttgagatgaagtttcgttcttgttgcccaggctggagtgcgatggcgtgatcttggctcactgcaacctctgcctcctgggttcaagcgattctccagcctcagcctcctgagtagctgggattacaggcatgcgccaccacgcccagctaattttgtatttttagttgttggtcaggctggtctccaattcccagcctcaggtgatctgcctgtctcggcctcccaaggtgctgggattacaggtgtgagccaccgcacccggcctacatagtcttattccaacctggtctgcctagtctccaaatctgctgattagttagtagcctgtagactcgagtgtgctgtgttttgggagccttagtttcccagatcccatggctgctgcttttttggtttaccctttggaatagagcacagcccctggtagaacccccaaacgggatgccttggaggtaattttttttgacgctttgcatatctgagatatcttttagctaatcatgcacttgattattagtttgactgtgtataaaagcctaggttgtatatcatttatgctgagaatatttctccagatgcttctagattttaggattgttgtttagtaatctgatgccattccaattcctcttggtattcctcaggtctgggaatgtttcttgtgttatttctatttctttattctctttttaaattgagatatactttaccatctcactcacccttttaaactgtattgttcaatggttttcagtatattcaacaagcagtcgtgaatcaccataatcaaatttagagggttttcatcaccctcaaaagacatcccaggccaggcgcagtggctcacgcctgtaatccagcactttgggaggcagaggtgggcggatcgcttgagctcacgagtttgagaccagccacatagcgaaactccgtctctacaaaaaatacaaaaattagctgggcatgatggtgcatgcctatagtcccacctacttgggaggctaaggtgggaggatggcttgagttgcgggggcagaggttgcagtaagccaagatagcaccactgtactccagcttgggcaacacagcaagaccttgtttcacaaaaaaaaaaaaaaaaaaatcccatacccattagcagtcacttcctattccttccaccctctccatctttccagccttaggcagtgacagatctattttttgtttctgtagatttgcctgttctggacagttcatttacatggagtctacaaaattcagcagtcttttgtgagaggcttctttcacttggcatgttttaaggttcatctacactgtggcatttaccagtacctcatttcttcttattgccaaataatattctattgagtggatagtccacattttatttatccattcatcagttcatgaaagttcaacctgctgctacaaacatttgtgtgtaagttattgtgtgagcatgttttcaattctcttaggtttagaacgtggagtaaaattgctgggccatatggtaactgcattatctctttgataattttgactctgctgctttttctgcatgctatctctggaatgggtatcgattagactttgaactttatgaacttattctctttattcttacttttctaatttgccatttcttaatctttctgttttatttttgggaaaatttcattttatctcccagccctcccactgaatttttatttcaactttcatatttttaattttcaaaaactttttcttatttactgaacattatttaatagcattccgattttccaaaaaatgtatgattttctcttctttctgggagtacagtcatcattctgggattttgctttgtatgtatctgttttctttgaggtcctttattctctttggtttttgttttaattcactcagttaaccactatgcatcgagggcccatcatgtgccagcaattattccaggtggatggaacaaagattcctgccattaagggacttacagtttttgggtctgtctttgatgctggagacgctcctcaaatatttggtgaatcagttttgtgcatttttaaaatataaaacttaaataaagtgcagaaattttaagtgtatagttcaacaaaattttacatacatatacagccatgtgagcaccactcagatcaagatacagaacattttgctcacccaaaaatgtttcccgtgccattcccagttaatatctcccctctccccagagggaaccaccatggcttagttttgcccattctgtgattccatacacaggatgtattctcttgtgcctggctttgcttcttttattcaatatagtatctttgatattgatccacattgttataacagtaatttgttctttattcctgtattccttccctgattatttgcctaaaacattcaagactgctcaaatgccacctcttctacaaagacttccatgactactcccctaagttccacacatacatctatcataccatttgctgcatggcattatcattgtttgcacactcatcctcttcactggaatatgaccttcctgaaggcaacacttgtcctgagtgttttcatttcctttatcaaaagaagtaataacagtgatcatagagtactcatatgcaccagttattagtctaaggccttcacattatgaactcatttacttctcagaataacgctatgaggtaggcataattattatccccattttgcacatgagaaaactgcagcatagacaggttatgtaacttgcccaatgtcactgaactaataatggtagaactgcaatctgaacccagatgatctggctcagagactatgctctttaagatctctgacttttgatcatagacaggttaagtaacttgtccaatatcattgaactaataatggtagaactgaaatctgaactcagatgatctggcttagaggctgtgctcttaagatctctgacttttgatccgagtaggtgtccaactgtatgtgttgaacagatgaataaatgaatgaaggtggatagagaagataggtgttcaccagaaatcaaacaaattcagccttagaaaagaaaaagtacatcttacaagatgaaatcatactgtttgaagcaataaaaaatttggttttattcactttgtcctctacggagcccaagccataaagggccagggaaagaggtctaggataagattttctgtgggcttgtgttatggactcaatgtttgtgtccccctaaaatctgtatgatgaagccttaactcccatgtgcctatagctgtatttggagatggggcctctaaggaaataattaaggttaaatgaggccataagggtggggctctgatctgatacaattggtgtccttataagaagagacaccagagagcttgcactctgtccctctctccacatgcatgcactgaggaaaggccatgtgaggacatagtaaggaggtggtcatctacaagtcgggaagacagccctcaccagaaactgcatttgccagcaccttctcatggacttctagcctccagaactgtgagaagtaagtatctgttgtttaagccacccagcctgtggtattctgttatagtagcctaaataaacaaatgtagattttggtaccagttttcagaaaccagctttgacagtgttctctcttctttgggactagacttaaccttcttgtgttcttcttattattattttgaaacagggtctcactctgtcacccaggctggagtacagtggtgccatcctggctcactgcaacttctgcctccagggctcaagtgatcctctcatttcagcctcctgggtggctgggactacaggtgtgtgccatcacaccctgctaatttttgtattttttgtagaaatggagtttcactatgttgcccaggctgggctcaagtaatctgtccacttcagcctcccaaagtgctgggattacaggcatgagcccaccgcgcctggctatttcttttctgaaagataattttaagaccctattcaatccagactctttttatcatagagcaagatttgattttcaattttttccttcaacctttccaattccttaaaactacagactttcttgcttttaatccttagcttactagttcttggcctatgcagaaatgcaacttctcctcttacacagtatacttattcaatattattactgctattggtcatgcttttcttagttaataatgctaatacgtactgtctttcccagtggtatttctattttaaactctgctataactatggagtaaaactttgggctctcaagaggatttcaaatctcagctgtctgcctggggactttaaaatataaccattttttaaaaacttataaaaatttccaacacaaagtagaatatagtcattacacagattcaacattaacaggatttttgtcacatttccttaatcgattccttgtttctctgctgaatacttcagagcaaatctatcatgtcatttaaaaactctatgtagcacaatatacctctcttaaaagggagggaccatgttcttatataatcaaaatgcaagtagcttatataatctaatagaattaacaataactcttttgtttggggacctctgaagtgaaacaaatcatacagaattttaatactataaaaacattagcactgtaaaaacagcaacatattatacagcctcaaaacagttttaaactgaagtctagtatgttcagaaacgcagggtgctgacccaccatccaactgaagctgagctcaggaatgcctaagacaactcataaaaatacacagcatcaagatcagtctttgtacattatttcaatgaaaaacacatagctgtgtacaaatatacagatctcaaactgtaacactgaaacacaaaatgcaacaaagtggctttataagttttcttcactgagacagaccttctggtgacttctggtgaatctagacatttatgattattaatacataataagcaagagaaatacagattttccaacctcatgatcagtaaattcctttgaaaaatgaatgaaggtatcagagtcatcaaaaggggaaacagttggtaagtttgatggccctgcctacactgtataatgtaagacacacaataagagctataagaaactatagttaaatgttagaagtaaagccaatatcgttttctcagacttctcccagtgattatatacctgatatataaacatcttcaaatgtgaaatagttcaataacacaatgacactttgccagtgtattaatctgatatatattttgaactggaatgatttgtaaagaaataaataagaaaccctaaaaagaaaccattagttccaagtcaaattatgttaatggtctatagaaaaaagtgagtgtgggcaggaaacattggctacatgccaatttttatttcaaagagtaatgttgcacaaataatagttatcattgtcttacacaacaaaaaatcctaaagttaatctcacaaacctaaattagctgaacatggagtaacaaagtcaaagccagtattatcatcagcacattaatttgataaatcaaactacatctttaaaaaaaaaccctgcatctgctgctgtgcagaactgataattacttttcagcatgtaaacgaaaaatcattatacagctctctctcttttttttttttttcctagaaagatgtataccagggaaacacaacagaatttgttacttgttaaatcccacaaaagctacaagggagctgagagttgatggcacttaaggacagtaaaagtctgcacttttaatatttttaatgcccactgatgggctttgtgtcaatactttttaaaatgctttttatttacaatagataaaacagtaaggaaatacaatattatatcatatccccgcacagagatactatatctgtataaatgaatcactagtaaaagagttatttcttatttcaaatgaagtcttatctaggtattaattaggctgtaatctaaatgttgatggtgcctattttcaactcccaaaataaacagaaagagctcatgtatcaagattaattttctttggccgcaatggataccattttctctgggggcagtctttagtttgctttcttttcagtaccatgtcagaggttttcctggaagcagtctctgttggtgtggtttctatctgtgttataaagttctcaggtttagcatctggtttcctatgacaactggaaaagacttcttggtgaatcctctggaggtggataacaggctgcatcctgagaacttgggaaaatccctctccttgttcaattaatgcaggcaaggacttcaaacaaacaaacagtaatattcaacattaatctcaggttgaaacacaaacagacaaagatggatgcagtactctaattttttttttttttcttgagaagtcttgctttgttgcccaggctggagggcagtggtgtgatctcagctcactgcaatctccacctcctgggttcaagcaattcacctgcctcagcctcccgagtagttgggactacaggcgcgcaccaccacacttggctaatttttgtatttttagtagacgtggactttcaccatgttggccaggctggtcttgaactcctgacctcaggtgatctgactgccttggcctcccaaagtgcttggattacaggtgtaagccactgtgcccttgctgatccaggctttaaatgctggattgtaggttacttatgtgcgcaacctgcttagcctctctgtgcctcagcttcctcatctacaaaagaaataacagtatctgtctcataggatgtaaggattacatgagacaatacatgtaaagcagttggatggtgcccataccaattattcaatacattttagctggtattattatccaaaactgttcggtgaactgctaacacccagaacacaaaaatataatcaacctttaaagaagacaggtatattacctggcacatagtaggtacctgataaatggcagctattctaaatgttactgttgcttaataaattcattaaagatttatttaaaggaccgctgagaattcctgttagagcagactaaaacacatatgaatgttgaatgcaaatacctagccatacattttgttcatttgataatttttttagcacatagcttttaccttcatggcttcactgatctcctttgctactgtttcccctctgcatttcaaattttccatatgaggggctgcaaaaacattgccaaacagtattttaggtttttatctaatagcaaatcataaaaggcatatagatactatctgaaaggcatatagatgctatctggacaaaaatctgctaggacgattcacctcagcttaatctttctcagagtgagaccattataataatagagtaaaactaaaagttataagcataagatggtacacaaaattctattacgagtagtcataacactgtgtgcccctaaaagagagttcaatgttcattctatacattacctaccactatgtttaacatctttgagcactatcatcacatttttaaataaatactttttatattactctgaattttataaaagtaacacatattcgatcttagaatatacaatcacactgcactgagatcatgcctagatggaattaatctggaacagattatcagtaatactactttctctttccttacttcctaatacatattttcttcttccaatctttgcatattcaatgatacagaaagataaaaatcttactaaaactctaaacaaaactgaaaatgagaaaaaattgttccattatgaaatcatctatgaattactttttagaagagtagttctcactagaaatttcttagagtcaaagcaagtacataactatgttaggagggccacattttcactggctagaagagattggtcaataacccaggcaaaatatttctttcataactgctatttttcttttctgacttgtcttaggttcatctttaaaaagtgagaacacatttagaaaaatggaaatgaaccacaaaaacagcttactgaaagagggcactcaaagaaggagacagacaatggcaacaggataatctcagaaaagggttttttttttgtaccagaaatttctttggcaatttggtgaaacctatgaacaccttctcagaaaaatttttaatgtacttgttttttaaattgaggtataatttatatatagtgaaatgtatagacagtaagttcagcattcaattgacaagtgtataccaagacacaggacattttcatcaccctagaaagttctcttgtgcccctttcccagtcaattttctccataagaagcaaccatttatctgattttaatcactatacattagttttgcttattctaaaatttcagaatgttttaaaataaaatttaaaatgtaagtagaaaattgtgataggtaatatatgtgcttctttattgatgatttaaataacaaaattgatggcatagtgattaccataatataaaaacaatgagtgtaaacaacagtgtgaggtatctacaacaacagaaaatgaaaatatctgtagctttaagtaacagaaagaaagttagtgatactgataacatcaccactattacctacattcaaaatggaaggaaatgctaaatttcagtttgaggctagtaaaaataaaaatgtattttttttcctatacaagttcacaggagggtcctaaggatccttgccttgaaataacatcataatttctattatttacgatttgaggagattccccaaaagtactcaggggcataacaattgttaaattttctctgtggtatggcaaataaataattcatcctttggtcctcctgtggcaatatggattctagccaggcccacacttactctctcttcaagcttgcacacctgtgtaggagctatctgttcaacgaacatttatgatgtatcttccatgggctaggcttatgatatggtttggatctgtgtccccacccaatctcatgtcgaatcataatcccaatgttagaggtggggcctggtgggaggtgattggatcacggggcgatttcccccttggtactgtgttatgatagtgagtgagttctcatgagatctggttgtttgaaagtgtgtggcacctcacccccaaaacagcttcttcctgttccatccatgtgaggtgctagctcttcctttgccttctgccatgactataagtttcctgaggcctcccaagaagctgagcagatgccagcatcatgcttcctgtacagcctgcagaactgtgagccaattaaacctcttttctttataaattactcagtctcagatatttctttacagcagtgtgagaagagactaatacagctgagcagtaggtacttataataagtaaaaatggtccctgcccatcaaggaacattcagtttagaagagagaaacacaggaagttcttcaaaattagctcaaacttttcctgggtagtctcatgtttccatgatctcggttaacacatacctcacctcctgcctgaatggaccctgccttgctacaggctcccactgggtcctgcacagttctagtacaatgcctggaagacatcattgcactaatttgtgtagaataaatttctcaaccctatcagacccgacccaacaccaccccccacttcagaacatattttgtaaagatcccattactattctaaagcaaaattcataggtaatatttctacacatataaatagaaataaagggagaaataatattcatcaaaatatgtacttaatatgtttaaatatgctcagacccaactataccaaagacataatgaagtactctcagacttgtgcctacttataatgagtaagcttggacttaagaaaatttacatttgaagccattctatacagaaagcagaagatcagaagtatggatggaacttgaataaaacttaatgttacataagaaataatagattagatttatttgaatataagaggaagaaaaactgaaatagagataacataccaagacaaagtactgactgttgaactggtgaaaattaggaagtacattatttctacaaatgaaatgtccttattaaaagtgtagtgtcaaaattatcccctataacatgaaaaagtgcgagattaaagtctaccagaaaacatatctcctgcttcaaaattcccataatttagactatagtcaatatatacattaacttaaaaagacttcaaagatcatactgtcgaaaggtgatgagaaatagaggatggattaggcaaaatattaatacaagaaactatagagatgatatgtggctgacctctgtagttaatctgactgacactcaaaacaggcaattcaaaactataattagaatactttaaacattttaaatcttcacataatttcttatcattgtggtacaaaaatataatttttaatatttagtttgacaatagcaaatatacctaaaccacttttgcttaaaaaaaaatgagatccctgtattttgtgtgcttctgttaattcagtaacatttggttctagtcctaaggactctcaaactttgttacatattttccatcagctttgctgcttttgcaataactaaatactgcatttaattaaaatcccttttaattaaaattgttggaaatgctctaagtaattccttaggaaaaaacaggtatgaaagtctcaactgaatctaaaacatttacggattaaatgtagctctagctgcaaagatttttgtttactttggtttttttttctttttttttgagatggagtctccctctgtcgccagcagcgagtgcagtggtgcgatctcagctcattgcaacctctacctcccaggttcaagtgattctcctgactcagcctcctgagtagctgggactacaggcatgcaccaccatgcccagctaatttttgcatttttagtagagacagggtttcaccatgttagccagaatggcctcgatctcttgaccttgtgatccgcccgccttggcctcccaaagtgctgggattacagccatgaaccacagcgcctggcttatttgtttttttttttttagctcaattttcccttcctccacatgttcattaacaggttccatgtatactccaaatatacttcatgtatattcaaattcttaaataccttgtatatacaatctttaaatataatcaccctatcttaaaaatagcatgcataggagtgacatcatcaaaaatggtggcataggagattccaaaggcccatccctccacagaaaaaagctggcaaaatctgtcacaatcaactttatcaaaaatctggaaaacagtcaagggttttcaccaatcaacagaatgtttaatcaaggcaagagcaagtgaaatctggtaggagaacttggtatattttaatttacccttgccccattcccttcttcctggctcggtggcagtaattcccagagtgggttactggtgctggagataacagagtagactctgctctcaaagaattgtattgttttgacctggtgagtggctctctgaaggactaacacaaaaggcttgcctttatttcacctgatttggaactctctcagggtggaaaagtggttacctggaggttatctgttaaaaacattgaaaggtaacgaagcagcagatgcagcgtgcagcacaggaagtcagttggggcaaacaaactgcttgctgaaaagctccaaacaagcaggatgggaaggcaaaggccgttatgaactgcctggctgagagctgaaggcatatcccgacatacacctacagagtttaatgttttgttttgctccaggcatttaaggaaatctctgacaaatcactagctgaccactaagctaatggaatggagacttcagtgactacaaacaacaaaaaacatggtatttccaaaaaagctttagaaaagtcactaaacaaacaaacaactcaccacaagcagcaacaacaaatcctgggaagatggaagaatctcatttctagagttaccatattaaaatatttgaaatgtccagttttcaacaaaaaattatgaggcatgcgaaaatacaagaaagtatggtccattcacaggaaaaaaaggaaattaacaaactgtcactgaggaggttcagacactggactgactagataaagactttccatcaattatcttaatatgctcaaagaactaaagaaaacctaaataatgtgtgtcaccgaacagagaataccaatggcagacagaaattataaaaaggaacaaaaaaaattctggagctaaaaagtataataactgaaatgaaaaactcagaggggagacggtgagtgttcaacagcagatttgggcaggcagaagaattaaggaacttgaaggtaggccaaatgaagtctaagagatctgtgggtaccatcaagcccatcaatatatgcataacaaggccaggtgccatagctcacgcctgtaatcccagcactctggaaggccaaggcggccggatcacgtgaagtcaggagtttgagaccagcctggccatggtgaaaccccgtctctactaaaaatacaaaaattagctgggcgtggtggtgcatgactgtagtcccacctactctggaggctgaggcaggagaattgcttgaacctgggaggccgaggttgcagtgagccaagattgtgccactgcactccagcctggacaacagagtgagactccatctcaaaacaaacaaacaaacaaacaaactatatatatatatatatatatatatatatatatatatatatatgcatatgcatatgcataacaagagtctcagaaggggaagagaagagacaggggcagaaaaaatatcttaagagataatggccaataacttcccaaatttgataatacatgcatttacacatccaagaagctcaacaaactccaagcatttacacatccaagaagctcaacaaactccaagcagaaaaactcaaggaaagccacatcaagatacatactaatcaaactgctgaaagctaaagacagaatcctgaaagcaacaagagagaagtgattcattacatataagacatcctcaatcagattaacagccaatgtctcatcagaaaccatgaagaatagagcactgggaggatatggttaaagtgctgaaagacttctaaaaaaatctgtccaccaagaattcactatctgccaaaaatatccttcaaaaatgaaggtgaaattaagacatttccagataaaaactgagggaattgtctggacacagtggctcatgcctataatcccagcactttgggaggctgaagtgggcagatcacttgagcccaggagtttgagaccaacctggacaacatggcgaaaccccatgcctaccaaaaatacaaaaaaatcagctgggcttggtggcacatgcctgtagtcccagctactcaggagactgaggtggatggatcacctgagcccagggaggctgaggctgcagtgagctatgatggcaccaccacactctagcctgaatgacagagtaagaccccatctcaaaaacaaacaaacaaacaaacaaaacaaaacaacttgaaggagttaataattagtaaacctggactacgaaactgctaacagtgtttcaggctgaaatgaaaggatgctagacagcaccttgaagccacacgaacaaataaagaataccaataaaggtaactacataggtaaatataaaagttagtttgtgacgtctcctttttttctacataatttaaaagacaaatgcatcaaacaacaattataaatctacattaatggatatacaatgtataaagatgaaatctgtgacaatgacaacataaagggggagaaacagagctgtatagaagaagttctatacagtattaaaactaaagtggtattaattcaaactacattgttataaatttcagatgcaaattgtaatccccaaggaaaccactaaaaaaaacccctaagaactatacagaaaataataaaagtggcacacttcaaaaagctcaattaaacaaaaaagaagacagtaatggaggaattgtggaagtaaaaaagtatagaaaacaaataccaaaatagcaaaagtccttccttatcagtaagtgtaaatggattaaactttccaattaaagacaaaagttggcaaacggataagaaagacatgattccaactctattctgtctataactcactttagatccaaagacaaacataggttgaaaatgaaaaaataaactaagatgctccatgccaaaggtaagaaactgcttagatgagttgcacaactttatgaatgtgctgccagtgaatcatacacttcaaaatggttaaaatggtaaattttatgtgtactttgccactgccacaacaaaaaataagcatccatatgtgtggtagtcttcaagatggcccctgtggccaggtgcggtggcccaggcctgtaatcccaacactttgggaggctgaggtgggtggatcacttgagccagaagttcgagaccagcctggccaacatggcaaaactccatctctactaaaaacacaaaaattagccaggcatggaggtgtgtgcctgtagtcccagctacaagggaggctgaagcacaagaatcactggaacccaggaagcggaggttgcagtgagctgagatcgcactgcactccagcctgggcgacagagcaaaaaaaaaaaaaaaagatggcccccagtgatctctgccttgtgcagggtattcatgcctccttgtgcagtcctctcccacagtgtactaggtcagcctgcatgaccagtaactaacagctcaagtaatagcaaatcacttccaagattaggttataaaaaagacaacttctgtcttgggtattcatttattcattcattccctatgcctttcagatcattcgtcctgcaagaagtaggttgacatgttacagaagcttatggagaggcccacgttgtaaggaactaaagtctctaacacaccagccagggctgtactgccaacaactatgtgagtgagtttgaaagtggatttcccacagtcccaggtgagccctgaaagataactgcagctccaaatgacatcttgactacaaccttgtgagagccctatgctagaactacccagctaagctgctatcagattaatgaccctcagaaacagtaagagataacacatttattgttttaagcagctaaactttgggataatttgttaggcagcaatagataactaatacaacatgagagcaatatattttcaaaggaataaatttaggcttatcttaggtagaaataaaattcctagtgagatttattttcttttttctttttttgacacagggtctcactctgtcacccaggctggagtgcagtggtgtgatctcggctcactgcaacctctgcctcctggttcaagtgattgtcatatctcagcctcctgagtagctgggactacaggcatgtgccaccaggcctggctaatttttgcattttttggtagagatggggtttcaccgtgttggtcaggctggtctcgaactcccaaccccaagtgatccttccaccttggcctcccaaagtgctgggattacaggtatgagccactgtgaccagccttactttcaaataatatatgattgtagataaatactataattccttcactttaatgtgatttatgtcatcttcttgcagtttcaaatatatttaatgatatgataatatctgttaactttttacttatcactgattgaataaatattatgtaatctagtaacactatgaattgttgttagggatatggaacaactgtaactatcatacctgctgttagaagtataaattgaaataaccacttcagaaaactttttagtaatagctataaaagccaaacatatgcctacatgtgacccaaaaattctatttctagatatatatctacgagagatgagtataaatgtggtataagaatgttcatagtagctttattcatatagccaaaatctggaaacaaatcaagtaacaacagaagagataaattgtctgtagacacacaatggaatactacacaacaataacaaagaacttctgctacattcaaaacgtggatgaatctcataggaataacaccaatttaaagaaggtaacacaagaatgcatactatatgattccatttacatgaagttcaagaaaagacaaaaatctatgatgatgtaagtcagaatagtggttatacctgatagaaatggtataatgactaaaaaggggtatgggaaacattttggggtactggaaatgttatacagggtatccataaggctggggaacaggataaatatgtgctagttacattttcaaataatatgttcaatatctttttcttcaacctcaatatatttttccaagtaaaacacttctaaatttaaagcagtggccccaattgtgaatatttttaaaaatacaataaacgcactgttttctttatgcttccaggttttttggacactctgaattgtatttattgtatacatgaaaacataataggcacagtattaaaaaaatataatcaatatactgtttaaaaataagtttatcctatattttccaactatgcagatattctatttctagatcatggtggcagttacatgtgtgtaggtgtatgcatgtaaataaattcataaagctgtgcattatatgttatactgcaatatatgtgcacacacacatacaataatgaacaaaatatttattaacatttaatatgaaaagttatcttttatgaatagggtaaggtaaaatcatattcttcttcattgttattatattgtttacattacaaactttacaaaataatccatcacttaagggattttgcgttttattgtgtttttttttttttttttttttttgagacagggtctcgatctgtcacccaggctggagtacagtgatgtgatcactgctcagtgcagcctcaaactcctgggctcaagcatctcactctgtcacccaggccggagtgcagtggcacgatcatagctcactgcagcctcaaactcctggactcaagcagtcttcctgccttagcctcccaaagtgatgggattacaggtgtgagccactatgcccagcctacactttattttttaattaacagcactgataaccatattcactgatttgtgaagcctctcactaggattcttagagactaagcgccatcaatgaccaatataaagaattcttaaaatatctcatgctaccttaaaaagaaatttgtctctaaactcacattgctgaacaacagctgttttctatcggttgcacaagcaatgacaatgtaaaaagtgctaagagtagtttgggtttgtgtgtaaaatggaattaggtcctaggctgaataattataaacatattttaacaaatgaatgtctagtgagatatcctaaagttgtgctggacatatgagacatctagtatgcctggcccctgactacaaagtgccagctacactttcccattaatatggcaaccaaaaactttctttcactttttcaaagggtccactagagggcagtactaaccccagtgagaaccctggcattctcatttagcttccagaactcccttgggaacaggaaacacattcttttaatctcagaatccctaatgttgaacagagtgcctaacgtgtacagtaggtgttcagtagtcatgatggaccaaggctatgatagagggtgccatggaggcacaaaggagggtgagatcaatctaacaagggaaccgaagggagagggaaatcttcacaggtgatgtaagaaagttgccttaatagaggatttggggctaggtgagctgggaggaggtgggtggtagaggatgtgatacatcaaagacaagagaataaatcaagaaagagtagaaaacaggaaccaggaaacacgatttaaaacatgagagaaggaagggaaattcccaggacgatgatgaaaggaacaggcaggatgaaaattttgcaccaggcctagacagcagccagtccagactggaataggaggacagaaggttcccagagaagtatctccgaggaaaagataaagtttaaaaatggatctgagagataaccttaagtgtttgccatattgagatgaattttacagttctgttagacacaacagaaaacaaagcaaacagaaaaataggccaggtatggtgagccacacctgtaatcccagcactttgggaggcagaggcaggtaaatcacctgaggtcaggagttcgagactagcctggctaacatggtgaaaccctgtctctactaaaaatacaaaaaattagccgggcatggtggcgggcgcctgtaatcccagctactagggaggctgaggtgggaggatggcttgaacctgagaggcagaggttgcagtgagccgagatagcgccactgcactccagccagagtcacagagcaagactgcctcaaacgaaaaaaaataataataaagcaattattgttccaaaaggggtagaaagctattcaagaaagaatatactcgtagtaataattatctgactcaggaacaaaataataattacctgactcagattgaagaacacttacatagtcataaaaatacaaatatgaaatactattgattttttttacaagaatgaaagattaaaagtgaagctactgagtatagattattcatttgagaaacttagttataaaaggaagaagggtacaaggaagaaaaacacaatggcatgaaaactttccctacctgttccatggacagcccattcctatagtagtatgggctgacatacattctcaatcaatcttatgcaattttagcaaccctgggaggcaagtgggtttcatcagcctccttttgtaggtaaagaaacagaagctgagaaatgtatctagacttgaataagaactcacatctccctcctagaatccaaagcacacactcttctacattctataactttccaaaatactgctttgtcaggaattatactgtcctcataagaatataagttaactaatggtaaaaagttagcttcaacataatgaaaatctcttgaaataattgtgcctggtaaagaactaaaacattaaaactctagaacaattatagaattaaatgtttaaactattaactttatggtacctttttttctttttaaatgaattaagtcctttacatttaaaactaagtagcaccaataattaataaaaccattttttttaaagacaaaagaaggaaaacacaactaaaaatggtcactaaatatatgaatatattatctgtaaatgcatgaaaaaggcatttttccaacaatatctgcttaggaaatttcaaaatatatatacttttcactccctcactcaagattattctaaatgaattttttcacattttgcaactagtaagatcatacaatactcctgatatacaagtatgtgacttaagactgtctcacatgcagatggctggtccatgccacacaggagatgggatgggctttctcgaggaccattctcaatgtcttctctctagaacctcgtgacaccactacttacccttctcaccaccaacaatggtgttaaaggagccaaactattccatataaaatcctacttaaatgtcatatagtggaactaatatgcatctgaaatatgattttcctaattttttcatcataaatgtatagtatttcagctacattatagattaaggtttaataagcctgtaaagggttgcctagaaacatatttatttatttatttatacatttttttcccagtgggaagtgtatttcaaattccaaaactcagacttacatgaatttttaaagtgtaactatttgtgagtggctacctgtaaatattgtgacagtggcttaagcaagacagcattattaggaaagaagcggaactgcctctgagtcctctgcctgtagggtcagcaaaagaactggaagtatcattaagtttaccatacagaaacttaaaatagctccttgccatcgctacatgtttagcgaaggacagggaaaaaagggatcttcagttaatttcaaagaacttttaaaaaaaggcaatatggaagcaattattcattacaacaggattataaaaggttgtaaatgtcaaatgagaccacatcttattggtggacagctcatcagtagattgctataaggatatttttaaaaagagtttgctcttaaaaatgtggaagttaggcatccttgagaacactgccttccctagtcacttgctttctaaaacacagggaaatgaaaaagtggaaatgaaagattgagtaatcaacctagttttgctttcaggtcactgtactgactaaactaggaaacatgaacttccaaaagcctgcccaaattcagaaattcagcaaaaaaaaaaaaaagcactaagtgagtacttcctttctatttccaatgtattttatgaatataaacaagcaatcacgcacagcatcagatgtgtggcttctactggtttctaaagaggtaattaagccattagaaccaagaattagaaagcagcatccctggtgaaaatgaaaccaaaaacacagcagtgatttgtgattttctgaaagataaccctttgctacaatttatagagatgtgttgaacccatttgctcagtagatgaaatcctctgcagcacaccttcccacctacacctcaccacctccttcagtaccatgttgcacctctcttaaggcacactttcaaactcctgaccctcgctcgttattatctggcctcagccaagtttttgacattgtcttgcaatgcttcttccctctattactcacttcactacagcctctctggtcttttgttccatgaatactcaagctcattcttgatttaagaactttattctagctcttccctctgcttgacagctctttttcttgatcatcaccagataaattccttcctgttactacctcagaaaagtgtttccccatcacctaaacacaccaccctaaagcactgatgtcacttatttatttttatatttattacttttcttctcccactaaaatataaactctatagagtaagaactttgtgctgctcactaatattacatctgccacattgagaacagttctgtcatactgtagccattcaatatatacaactgaatggaccaatgagtaacagtcactcatgatgtatttattgggcatgctgctatatgctggctatatataatgtaaatataatattaaaaaactcatggagctttcagttttgtgagagagcataaacaagaaaataaacacaaatacttataagctgtaacaagtactattaaggaaataaacaggtgtcatgataaacaactggggagagtattttaatgagggtggttaggtaagatctctctgaggaggtaacatttaaatgagaaaagagaactgggaagatgtcaaacttgggcaagggggcatgcatgtgtgacagtgaggcactttcaaagaactgaaagactggcagcaaacaggaaagtgcctgaaataaatctggagaggtaggtaggggccagatcacctaagggaatgctaaaagtctagagtttaggattttaagcagaggactgaaaactgatttgcatttttaaaagtatcctaagacttcctagtcaagttgatttcagtagtgcataaaactcccttcctatgtccaaaagcatcagtgaatatagaaaattaaaatgacatatcctaaagcatatacaaaataaaacatttcaatgaaccagaaaaaaaggagaagagaaaaagctgcaagtcaggctaaagctgcaggcctaccggtaagcagaagtagccaggaattggcctcctgcaagataaaaggtgttcgaagtgctccagaagaacaggaaacgaagagacagcttcactgtttgaaaccgagggctgagacagagtttacccaccctgaaaaggtggctgaaaaaaactgccactaaccagcccggcgcggtggctcacacctgtaatcccagcacttaaggaggctgagatgggtggatcacgtgaggtcaggagttggagactagcctggccaacatggtgaaaccccgcctctactaaaaatacaaaaattatccgggcgtggtggtgggcacctgtaatcccagctactcaggaggatgaggcaggagaatcacttgaacccaggaggcagaggttgcagtgagcaaccattacattccagcctgggcaacaagagtaaaattctgtctcaaaaaaaaaaaaaaaaccaactcaaaagacaaaactgctcctaaccgctgccaggaagcaaagcttacttaaagctaaaccagaaatgatgggaagcagataatgcctccaagcctgggcctggaccaatctccagtgtcacactgggacagaggccctctgttgccagtgttaagatatggctccagcctgggattgtttggggccagatggaaggcaaccaaacctactagacagagggagtgaaagcagtggtagacagatatgcacatgaaaaattctagtcaagaagcacttgcaaatcaaaagtctaaaatacatgaagaaattaaaaccatgaaagacagccagtataaccaatgtcagggagaggaatttactgcagatgaaatgaaaatagagcaatataaaaatgactttaaaatgctacacagctccaatagctaaagaaaatcataagacattgcaaaagaaaaataggttataaaataaaaacataaaatacaaaaatagaagaaatgagaaagaagcaaagttgaaggattaggttaaagattttctagaatataggagtcctcagataaaagtatatatggagatgttaatggaagatgggagaaaagaggaatctagcaaaaccaaataatctctcacaaaaaacaaaaatacatatataatattatttaaataaaattgtctctgtgtatataagcaagaaaaaaattaccaataaaaaccatggagttgaactatgttacatgttgagtgaaaaaagaaaaacaatgacagaataaaatgcattatgtaatatttatataaacaactaaaaaaacccctgtgtctacctatgtgcatacaaatgcattgataaagatctaaaattagacacagcaaactgataatagttgcctatttgaagatgtgtgggatgtgacagattgggaggcgaagttatggtatatttcatataaatatgaatatgtatatattttcatatatatctatatgtaattattaaaaattttacattaagcttgcatttattaaaagcacaagaaatacaatttaaaagataaccacaatttaaaacaataaggttagagctacggcagtcgaatggaggatgtctaccataaacttaagctaggaaattgcagataatttgaacacatgaataaattttctgtaaattatgcccccaaaatgtccagtgcatatttattcctgtaacaattatataagcacagaaaaaaggataaatgaattcataccaggttaatgttggatatctaaaggggtgacaggaagagagagaagaaaccaaaaacaaaaagtaaaaatacaatgctatccttgttgggtttttttgagacaggttctcactctgtcactcaggctggagtgtagtggcaggaccatagctcactgcagccttgacctcctgggttcaaatgatcctccctctgcagcttcccgagtagctggaactacaggcatgcaccaccatgcttggctaatttttgtattttttgtagagacggggttttgccatgttgccctagctggtctcaaactcctgtgctcaagcgatcagcttcccaaagtgctgggcttacaggtgtgagccactgcatccggccgactttggtttttaaaagggacaatgtaatatgtaattcaatcctatttatataaaattatgtattgtttgcaaaaatataaatatttattgagtgtaccatgtcagaaaataatcttaagagtcaggggctgggcgcagtggctcatgcctgtaatcccagaactttgggaggccgaggtgggaggatcacccgagttcaagactttgaaaccagcctggccaatatggtgaaaccttgtctctattaaatatgcaaaagttagccaggtgtgatggcgggtgcctgtaatcccagctagtctagaggctgaggcaggagaatcacttgaacctgggaggtggaggttgcagtgagctgagagcgtgccactgcattccagcctgggcgacagagcaaggctccgtctcaaaaaaaagaaaagaaaagaaaaaagagggaaaactgggcatcccaaagttcttgctcacagggagcttacaatactgtggggagggaagaggaaaataaggagaaattatataatatctgtaagtggcagagaaaaataaagcaggttaaagggatacagtatgatcaagggagtcataagagaatctgacacaggttgtaaggtgtatcagatgaagtgacactttgaacagagagctgaatgaagtgcaagagtcaggcaggtagtttcggagagcagtttcaaatacagggagttgcgagtatgaaagtcgtagggccagtgtgttcttggtatgtcctgaaatagcaagaatattagtgttagtggagcacagtaagcgagggtgagatggtaagtgaacactgtcagagatgagatcagagaagcagccggggaccatatcattgagggcctcttagaccaaaggaattataatggggagccactggagggccttcaacagggagtgacataatctgattatgctttaaaagaaattgtttggatgctgtgtgaaaagtagaactggatggaaggagaccagggtgttagtctgttttattactataaaggaatatgtaagactgggtaatttataaagaaaagaggtttaattggctcacagttcggcaggctgtacaagcatagcaccaacatttgctcagcttctggtagggcctcagtgagctttcaatcatgatggaagccaaaggaggaacggtacatccatggcaagagatggagcaaggatgtggatgtggggaggtgccacagtctttaaaacaaccagctctcaggtgaattcagagggagagctcactcattaccacaaggagggcaccaagccacggatgagggatctgcccccaagacccagacaccttgcactaggtccatctacaacattgaaggtcccatttcaaccatgagatttagaaggaacaaaacatccaaaccatattaatcagtgagaaagctattatagtggtcctaagcgaatatggtgacatggataagagcaggagagacagatttggttggtaagcagcaggatttgaaatatgtttccaaggtaaaggcagcaggatctactgatggactgaggatgtacaggcatcatgcaatatatcataatactggttactggtcataaacatgctaatagtgtttatctctgggcatatgatttcatgtgatttaaacttgtttcttatgcttctaacatttttggaatgtgcatgtattgttcatacaagcaagaaaaagcaataatattattttcagtgtgaaataaatcagaaaatgtacatatcaaacaccatactagaaaataaacatctagctatactgtggtaaacttcagagcattaagaatatagagaaaatccgaaaagtcagaagagaaagaacaatatctataaaggaatggtaatcagattctcaagacactgctcatcaacaatgaatgtcaggcatccagattagaaagaaaagaagtaaaatatctgtttgcagatgacatgatcttttatatataaaatcctttaaaacatccattaaacaactattagaactaataaatgagtttaacatggttgtaagatacaagattaatatacaaaaattaattctatctctacacagtagcaaagaagaaaccaaaaataaaatttaaaaataattcaatttacaagggcatcaaaagaataaagtatttaggaataagtttcacaaaagaagtgctaaaagctggaaaacactgttgaaataaatcaatttccagatggaaagccatccattattcagggatcagaaaacttaacattaagatagcattactctcaaagtgatctacaatttcaacacaattcctaccaaaatcccagctgacttcttgacagaaattgactgactgatcccaaaattcatatggaatttgaatgtaagggatcagaagagccaaaacaaccttgaaaaagaagaacaaggttggaagactcatactttctgatttcaaaatttcttacaaagctataataatcaagacagtgtagtagtggcctaaggacagacaaagatcaatgaaacagaattgagagttcagaaagaaatctacatattacagtcaactgatttctgacacagattccaacaccattcaagcattttcaacaaatggtgcttaaaacaactggatatatacatacaaaagaatgaaggtggaaaactcttaggagaaaggcaagcataaatctttatacttttatattagacaacagtttctaaaatataaaactaaaaccaaagcaaccaaaggaaaaaaaaataggtaaattagattttgccaaatttaaaatttctgtgcttcaaagaacatcatcaagaaagtgagatggggagggggcttcaagatggctgactaggggcacctggcacctgcctcctccacaaagaaggactaaacagtgggtagataatcacatgtcaaagacagcatccaagaaaaaacagtggaattcagcagaacagtgacagggaacaactgaggcatgggaagaaagggaagcagggaaaatgtaaatgagagatcccacatttctactgcagaatcctgcagtactaaccacaggagagccccttggcccctgcaggccctaagactagtatagggagctgtctggagtccatacaacattaattccagagagatagcactgggtacctcacatacccccaaggcccaagacaccgcagcatagcaccattttgagaattcaacccccaccagactgtatccttccctagggcccaaaagcccctacatctccacatccctggagccttgctgacatccccactgcatccacctggagagctgcagtggcacaacactgactgaacccaatagtaaaaccaggtccccggcactctagcctacacagtgtcctacaccccaaggaaccagcagtgcagtgcaccagggaggctgcccgtgggacagagggagctgaagcgcacactcctcagagcctgagagccatttccctggggccacccagcagcaaggctactgcgcactggcatgtgcctttagtgtgcctagggacaggcccacccagatgctgtcctgggatcctgataatcaccctgccctatctgtcatggtgggtgtgtgagcacatcaagacaacagaccaccaagacaacagaccatcgccagtgcccaatcatactgtccagggcctggggattgacctgccccgccagctgcttctggggcacacacacacacacaccataagggagcttaacagcaggtccagcctgtgggccactggtacctgagcacactaaccaagggcaaagggatagccctgccctgcccaccacaactttaggcacaccatcaggaggctaagatcaggcccaccctgctctgcaccactctaccacaccagtgtctgagagcgccatctaggggcccaggaatagcctcattctgtctgttgctgtgggcaggtgcacacactcagccatcaaggggcctgataacaggcccagccaacatactgcgggtgcctgagcataccgtttgaggtcctgaggttcaccccactggccactactgccggcatccacacactcctccccagggcttgaggacgggcctgactagcctatcatcaccaccaccatcaccgccaggacccccctaaatgtgctctggggggactggccagcccagtccattgccaccaccactgccgcctgtgcttgctgcctgggggcctgacggttgacccgccactgctactgccatcaccaacaccacgcatactgcccagggactcatgaaaccacctgcctgcccatcccattgctgtcactgctggtacctgagcaagccacctggaggcccaagaattggtctgcctggacctgataacactagtatctgtgtacactgccaagggaaccaaaaatggatgtatttggcatgccatcaccaccagtggggcccaagaacaggcctgcctggagtccccatcccaagtaaagacctatcataccctctagtaccaaccatagcgtaagtcactaaggaactcacaaacatcactgacactgattacacccaaagaaatcatgcagagactatactattgcacacacccggaatcaaagctaaagcaccctacccaatcaatattatagatacaactacaggcaaaagtcttttcctatgaaagccaatctaaaaatctgaaagaagtaactgtttcaccaaatgtgcaggtatcaacttaaagacataagaaacatgaaaaagcaaggaaacatgacacttccaaaacaactatgataattctccagcaaaagattccagtgaaaaagaaatctataggacaggcattgtggctcacccctgtaatcctagcattttgggaggctaaggtgtgtgcatcacctgaaccttggagttcgagaccagcctgggcaacgtggcgaaacctcctctccacaaaaattacaaaaaattattagggaggaggatcgcctgaacccaggagtttggggccagccttagcaacacggcaaaaccttgcctttacaaaaaacacaaaaatagctgggtttggtggcagatgcctgtcgtcccagctacttgggaggcggaggtggaagaattgcttgagctcaggaaggctgcagtgagctgtgactgtgccactgcactccagcctgggaccctgtctgaaaaaataaaatataaaaaataaaagaaaacatgaaatacctgaaaaataattcaaactactgatattaaagaagctcagtgagatccaagagaacacagacaaacacaaggacataagaaaaacaattcatgatctgaatgagaaatttaacaaagagatatcattttaaaaaatcaaacagaaatcctgcatctgaagagttctatgaatgaaataaaaaatacaattgagagcttcagaaacagactagatcggggtgtccaatcttttggcttccctaagccacactggaagaattgtcttgggccacacataaaatacagtaacactaatgacagctgatgagctaaaaaaaaaaaaaaaaaaaaaaatcatgttttaagaaagtttacagctgggcgcggtggctcatgcctgtaatcccagcactttgggagactgaggtgggtggatcacctgaggtcaggagtttgagactagcctggacaacatggtgaaaccatgtctctactaaaagtacaaaaattaactaggcatggttgcgcatgcctataatctcagctacttgggaggctgaggcaggagaatcacttgaacccgggaggcagaggttgcggtgcgccaagatcgctccactgcactccagtctgggcaacagagtctcactctgtcttaaaagaaacaaaaaaaaaaaaaaaaaaaagaaaagaagtttacgaatttgtgttagaccacattcaaactgtcctaggctgcataaggcccatggatcacaggttagacaagcttgaattagatcttttatttatttactttccaagatgacagataagagtcagtgttagcatgcctctcccacttggaaggaaagaatagtggctagagagtcacactgtgaattttcttttttccaagaaccaccacaggaagatggaaggaatccacaaaccctctgaaagaagcagcaggctggagcctactgcatgagacaggtgaaaaactaagttcccagagtgtaagcaggggaatgagcctgtctcggagcacacatccccacctgcaagtctgaaaatccagaccatgggagaaagccttaaccctaccgagagctggaatggatttagtctatgtgaaatacaaaagtagacgcagcagcatgaagtgccttgtaggcattcccagtctccagcatgaacagaggcaagccattcctgactgcatctcataggggccctcgaagaagcagtcaatgagttcagggaggggtcatagggtgaaagaagctcccagatgaattttgcgatataatcttgagtagggatgagctctcctgaacagaacccacagggtgagtgtaaagtgtgctacagacatgagcagaggagctgggcgtccggccttatgggcatatggagaaaggcatggttatggccttgggcaggtctgagttccgtgcgcagactgcctggaactaaatccagtaagcgaagcactgtgggagtgagaccagcgtcgccaactgtgaaagagctgggtgaggctcattgttgcccactactctccactccctttgggaactcttctatgcagcagatgcagttaactaccctctggaacattatcccaggagcctgaggtctcaaagaagttctgaaagaagttctgaatcttgaaacaaaagctctgaaatgcacctatatagaacctcctgaaagcataaatctcacagggcctaaaaaacaacaacagaatgaaaaaaaaacaaagtatctaagtaacaactaacatgatgaatagaacagtacctaacatttcaatattaacgttgaatgtaaatggcctaaatgttccacttaaaagatacagaatgacagaatggataaaaaaccaccaagtatctgctgtcatcaagagactcacctaacatataaggactcataaaaatttaaggtaaaggggtggaaaaagacattccatataaatggaaaccaaaagcgagcagtagttattcttatatcagacaaaacagactttaaagcaacaacagtaaaaaagacaaagaaggatgttatacaatgataaaaggattagcccaacataaggatactataatcctaaatttatatgcaactaacactggagctcccagatttataaaacaattactattagatctaagaaatgagactggcaacaacacaataatagtgtgggacttcaatactccactgacagcactagaaagatcaagacaaaaagtcaacaaagaaacaacaaacttaaactatatcctagaacaaatgaacttaacaggtgtttacacaacattcttcccaacaactgcagaatatacattctcctcatcagcacatggaacagtctccaagataggtgatatgatgggccacaaaataagtctcaataaatttaagaaaatcaaaatcctatcaagtatcttctcagaccacagtggaataaagctggaaatcaactataaaaggaactctcaaaattatacaaatacatggaaattaaataatctgctcttgtataatttttgggttaacaatgaaatcaatatgtaaatttaaaaattctttgaaatgaataatagtgacacaacttatcaaaacctctgggatacagcaaaagcagtgctaagaggaaagttcacagtgttaaatgtctacatcaaaaaccctgaaatagcacagacaatttaatgtcacatcacaaagaaatagagaaacaagaacaaactaaacccaaacccaggagaagaagtaacaaagatcagagcagaattaaatgaaattgaaacaaacaaaaaaacaaaaaatacaaaagataaatgaaacaaaaagctggttctttgaaaagataaacaaaattgatagaccattagtgagattaaccaagaagacagaagatccaaataagctcaattcacggtggctcatgcccacaatcccagcattttgggaggccaaggcaggcatatcacttgaggtcaggagtttgtgaccagcctggacaacatggtgaaaccctctctctactaaaaatacaaaaatcagccaggcatggtggcaggcgcctgtaatcccagccacttgggaggctgaggaaggagaattgcttgaacttgggaggcagaggttgcagtgagccaagatcacaccactgcactccagcctgggtgacacagcaagactgtctcaaaaaaaaaaaaaaaaaaaaaaaaaaaagaaagaaagaaaaaaaaaagaaactggagatattgtaactgataccacagaaatacaaaaggtcattcaaggctactatgaacacctttatgtgcacaaactacaaaatctagaggaggtagataagttcctggaaatatataacccttctagattaaatcaggaagaaatagaaaccctgaacagaccaataacaagcagtgagactgaatcagcaattttttaaattgccaacaaaaaaaagtccaggaccaggtggattcacagctgaattctatcagacattcaaagaagaattattaccaatcctactaaaattattccaaaagacagaaaaagaggaaatcctccctaaatcattccatgaggccagtattaccctaataccaaaactaggaaaggacataacaaaaaaagaaaactacagaccaatatcctgatgaacatagatgcaaaaatcctcaataaaatactagctaaccaaatccaacagcatgtcaaaaagataatacatcatgatcaagtgggtttcaaactagggatgcagggatggtttaacatatgcaagtcaataaacatgctacataacagaaacagaattaaaaacaaaaaccatatgatcatctcaacagagatggaaaaagcatatggtaaaatccagcatctctgctgggcagagtggcttatgcctataatcccagcactttgggaggctgagacaggcagaccacctgaggtcaggaatttgagaccagcctggtcaatatggtgaaaccccatctctactaaaaatacaaaaattagcatgcctgtaatcccagctactcagaaggctgaggcaggagaatcgcttgaacctggaaagtggaggctgcagtgagccagatcgcaccactgcattccagtctgggaaagagagtcaggctctgtctttaaaaaaaaaaacaaaaaaaacagcatctctttatgattaaaaaccctcgggctgggcgcagtggctcacacctataatcccagcactttgggaggccaaggtgggtggatcacgaggtcaggagattgagaccatcctggccaacacggtgaaaccctgtctctactgaaaatacaaaaaattagctgggcgtggtggcgggtgcctgtagacccagctcttccggaggctgaggcaggagaatggcgtgaacctgggaggtggagcttgcagtgagccgagatcacaccactgcactccagcctgggcgacagagcgagactccatctcaaaaaaaaaaaaacaaaaaaaccctcaacaaactaggcaaagaagagacttacctcgaagtaataaaaaccatatatgacaaatccacagccaacatcatgttgaatggggaaaagttgaaagcattcccgttgagaactggaacaagacaaagatgcccactttcaccacttctattcaacatagtactcagccagagcaatcagacaagagaaagaaatgaagaaaatccatattgcaaaagaggaacccaaactgtcactgtttgccagtgatatgatcgtataccttagaaaaccctgaagactccatcctggctaacatggtgaaaccctgtctctactaaatatacaaaaaaaattagccaggcatggtggcaggcgcctgtagtcccagctccttgggaggctgaggcaggagaatggtgtgaacctgggaggtggagcttgcagtgagccgagatcgtgccactgcactccagcctggggtgacagagcgagactccatcttaaaaaaaaaaaaaagaaaaaaaaagaaaaccctgaagactcatccaaaaagctcctagattggataaataaatttggtaaagtatcaaagtacaaaatcagtgtacacacatcagtagcactgctacacaccaacaatgaccaagctgagaatcaaatcaaatttaaaaactcaaccacttttacaacagctgcaaaaacaaacaaacaaacaaaaacttaggaatatacttaaccaaggaggtgaaggccctctacaaggaaaactacaaaacactgctgaaagaaatcacagatgacacaaacaaatggaaaacacatcccatgttcatggatgggtagaatcaatattgtgaaaatgaccatactgccagacgcaatctacaaattcaacgcaattcccatcaagataccaccataattcttcacagaactagaaaaaacaatcctaaaattcatatgaaaccaaaaaagagcccacatagccaaagcaagactaaggaaaaagaacaaatctggaggctttacattatctgacttcaaactatactgttaggccacagtcaccaaaacaacatggtactggtataaaaataggcacacagatcaatggaacagaacagagaactcagaaataaagccaaatacttacagtcaactgatctttgacaaaacaaacaaaaacataaagtggggaaaggacatcctaattggcaagccacatgtagaagaatgaaactggatcctcatctctcaccttatacaaaaatcgactcaagatcgatcaaagacttaaatctaagacctgaaaccataaaaattctagaagataacatcagacaaactcttctaaacattggcttaggcaaagaattcatgactaacacccccaaagcaaatgcaacaaagacaaaaataaataaatgggacctaattaaactaaaaagcttccgtagagcaaaagaaataatcagcagagtaaacagacaacccacagagtgggagaaaatattcacaaattatgtatctgacaaaggactaatatccagaatctacaagaaactcaaacaaatcagcaagaaaaaaacaaatagtcccatcaaaaagtgggcaaaggacatggatagacaattctcaaataagatgtacaaacagccaacaaacatatgaaaaaaatgcttaacatcactaatcatcagagaaatgcaaattaaaaccataatgagataccactttactcctgcaagaatggccataattaaaaagtcaaaaaacaatagatgttggcatggctgtgttgagaagggaacactttcacaatgctggtgggaatgtaaattagtacaaccactattgaaaacaatatggagattccttaaaaaactaaaagcagggccgggcacggcggctcacacctgtaatcccagcactttgggagttcgaggagggtagattacctgaggtcaggagtttgagcccagcctggccaatatggtgaaaccctgtctctactaaaaatacaaaaattagccaggcatggtggcacacgcctgtagtcccagctactcaggaggctgaggcaggagaatggcgtgcacctgggaggcggagcttgcagtgagccgagactgcaccactgcactccagcctgggtgacagagcgagactccgtctcaaaaaaaaaaaaaaaaaaaaaaaaactaaaagcaggactaccattcgatccagcaatcccaccactagatatctaccccaaggaaaataaatcattatatgaaaaagagacatgcacacacatgtttataacagcacaattagcaactgcaaaaatatggaaccagcccaaatgcccatcaaccaactagtgcataaagaaaatgtgaatcctactcagtcataaaaaagaacaaaataatagcattcgcagcaacctggatggagttggagtccatcattctaagtgaagtaacctaggaacagaaaaccaagcattgtatgttctcatttataagtgggagctaagctatgaggatgcaaaggcataagaatgatataatagactttagggactctttggggtaaggttgtggggctgagggaataaaagactacattttgggtacagtgtacactgcttgggtgaggagtgcactaaaacctcagaaatcaccactaaatagctcatccatgtaaccaaaaaccacctgtgacccaaaaactattgaaataaaatttaaaaaatatacagactagatctagcagaataaagaatttcagaacttcagctactcaagagactaaggcaggaggatcccttgagcctcccaggaggtggaggctgcagtaagctatgatcactccactgcactccagcctgggtgacagagtgagaccctgtctcaaaacaaacaatgacaataaaatggaggaggaataaaaaaaaaaaaatgaagaaagcctaactgactttgggacagcataaactggccaaatatttgcattttgggtgttgtagagggagaagggatgggtaaaggaaaagaaaatctatttaacaacatagtagctaaaaacttctcaaatcttgcaaaagatatacacatacagatacaggaagctcaaaattctgcaaatagattgaatcccaaaaggtcttcaccaaggcacattatactcaaactatcaaaaggcaaagaaagagataaaattctaaaaacaggagaaaggcctaaagttacatagaagggaagcttcctttagactaacagtgtatctctcagcaggatcattacaggccaggagagaatgcaatgatatatttaaagtgctgaaagaaaaaaacctgtcagccaagaatattattcccagaaaagctatccttcaaaaatgaaggagaaataaagtcttctcagacaagtaaaaactgaaggaattcattactgctagaccagccctccaaaaaatgcttaaggaagttctacatctggaagcaaaaagacagtatctaccatcatgtgaaaacacataaaagtataaaactcactggtagaacagacatacaaacgagagagagagaaaaaactcaaatgttaccactacagaaaaccactaaaccacaatgataaacaatgagagaaaggaacaaaggatatataaaacaaccagaactcaactaataaaatgacaggaataagcccttacatatcaataataataaccttgaatgtaaatagattatccacttaaaagacaaataatagcttaatggataaaaaagtatggcccaactatatgctgcctacaagaacctcacttcacttgtaaaaacacatacagactaaaagtgaaaaaatggaaaaagatactccacacaaatggaaaccaaaagtgagggggagtagctatacttagatcaaagagattttaagtcaagaacagtaaaaaaggacaaaggaggccattacataatgataaagggatcaattcagaaagaggatataataattctaaatatatatgtacccaacactagagcatccagattaaagcaaatattatcaatctaaagagagagacaccaacacaatagtagtcaaggacttcaacagcccactctcaacagaaaagataaatgaaactgataaatggctagctagactaaccaagattggaaacaaaaaaaggaggcattataactgataccacagaaatataaatgatcatcagagactattaaaacagaacaactatacactaacaaactgaaaagcctaaaggaaatgaataaattcctggacatatacaacctacgttgattgaaccaggaaaaaaacaaacaaacaaacaaacaaaaaaaccagaaaatctgaatagaccaataacacataacaagattgaatcagtaataaaaaggctcccaaaagagaaaagctgcagaccagatggctttcctgctaaattctaccaaacttataaagaagaattaacatcaattcttttcaaactattccaaaaacctcaagagggaagaattgttcctaactcattctgtgagaacagtattaccctaatactaaaaccagacaaggacacaacaaaaaagaaaactacaggccaatatccctgatgaacagacacaaaaatccttaacaaaatactagcaaactgaattgaacaacacatcaaaagtcccactagatcataatacaccctgatcaagtgggatttatctcagagatatgagaatggctcaacatgtgcaaaccaatgagtgtgatacatcacatcaacagaatgaagcacaaatatcatactatcatctcaatagatgcagaaaaggcatttgataaaattcaacattctgtcatgataaaaaaaactctcaacaggccaggcgcagcagctcacgcctataatcccagcactttgggaggctgaggcaggcggatcacctgagattgggagtacgagaccagcctgaccaacatggagaaaccccatctctactaaaaatacaaaaattagccaggcgtggtggcgcatgcctgtaatcccagctactcaggagactgaggcaggagaatcacttgaatctgggaggcagaggttgcggtgagctgagattgtgccattggactccagcctgggcaataagtgcaaaactccatctcaaaaaacaaaaaacaaaaaacctctcaacaaaagaatgtacctcaacataataaaagccacatatgacaaacctgcagctaacatactgaatgaggaaaagctaaaagtctttcaagaattggaacaagacaaagatgcccactttcaccactcctattcaacatagcactggaagtcctagccagagcaatcaggcaagagaaacagaaggcttccaaactggaaatgaggaagtcaaactgtccatctttgcagatgacatgttcttacatagagaaaaacctaaagactccaccaaaaaaaaaaaaaaaaaaaaaccttagaactaatagacaaattcagtaaagttgcaggatacaaaacaaacacaaaaatcagtagtgtttctatacaccaataatgaactagctaaagaagaaatcaagaagtcaatcccatttataatagctataaaaaaaataaaatatctggaaataaatttaaccaaggaagcaaaagacctctataaggaaaactacagtacactattaaaagcaattgaagagaatatgatatagtttggctgtgtccccacccaaatctcatcttgaattgtagctcccataattcccacatattacaggagggacctggtgggagataattgaatcatgggggcggtttcctccatactgctcttgtaacagtgaataaattctcatgagatccaatggttttataagggaaaacccctttagtttggctctctgattctctcttgccaccgccatttaagaagtgccgtttgtcttctgccatgattgtgaggcctcctcaggcatgttgaactgtgagtccattaaaccactcttactttataaattacccagtgtcaggtatgtctttgtcagcagcatgaaaacagactagtacaggatacaaatagaaagacatcccttgtgcacaaatcagaagaattaacattataaaataaccataatacccaaagcaatctacgaatacaatgtaattcctaccaaaataccaataacattcctcacagaaatagagaaagcaatcctaggccaggtacagtggctcacacctgtaaccctagcactttgggaggctgaggcaggtggatcatttgaggtcaggagttcaagaccagcctacctggtgaaactcttgtttctaccaaaaaacaaaaataaataaataaataaataaaaattagctgggtgtggtagtgtgcacctgtaatcccagctacttgggaggctgaggcacaagaatcacttgaactcgggaggccaaggttgcagtgagctgagactgcaccactgcactcaagcctgagtgacagagtgagacattgtctcaaaaaaagaaaaaaagaaagaaagaaaccctaaaattagtacaaaaccacaagagtccgaatagccaaagcaatactgaaccaaaataataaagctggaaacatcatactacctcacttcaaaatatactacaaagctacagtaaccaaaataacatgatattggtatttaaaaagacatggaccagtggaacagaacagatgcatggaaatctaggtatttatagccactgattttcaacaaaagcaccaagaacacacaatggggaaaggacaccctcttcaataaatggtgctgggaaaattggatatccatatgcacaagaataaaactagactcctatctttcatcatagaaaaatcagctcaagacggattaatgacttaaacataatacccaaaactataaaactactatagggaaacataggaaaaacactctaggacatccaggcaaagattttacggctaggacctcaaaagcacagggaacaaaaacagacaaatgggattacatcaaactaaaaagtttctgcacagcaaaggaaacaatcaacagagtaatgagacacctgttgaatgggagaaactatatgcaaactattcatccaatgggggactagtatccaatatacacaagaagctcaaataactcaacagcaaagaaaaaaaaatcctgttaaaaagaaggtaaaggatctgaatagacatttctcaaaagaagacatgcaaatagccaaaagatatatgaaaagatgctcaacataactaaacatcagggaaatgcaaatcaaaatcacaatgagttatcaacttaccccagttaagatatgactactatcaaaaagataaaaaataacaaatgctggtgaggatgtgaagaaaagggaacttttagacattgttggtcagaatgtaaattagtatagctacaatggaaaacaatatggaggttcctcaaaaaaaaactaaaaatagaattaccatatgctccaccattcctgccactgggtattcatccaaaggaaacaaaatcagtatatctaggcaatatccacatccccatttttattacagcactattcacaatagcctagatacggaatcaacctaagtgtccatcaacagatgaatgaataaagaaaagtggtgtatatacacaatggaatactattccatcataaaaaagaaaatccggtcatttgcagcaacaaggatggaactggcattaggttaagtgaaataagccagggacagaaagacaaaaagaaaaaaaaaaaatctcatgttctcactcacatgtgagaactaaaaaaattgatctcatggaggtagagagtagaatgatagttaccagaggctgggaagggtatgtgcggagcggggaagggagtatggagaggatgcagagaagttagttgggggtggggcaggggtttaaaaaagaattatttgggtaaagacatacagttagatagaagaataagacccagtgcttgatagcacagtaaggtgacaatgattaaaaataatatgtcatatatttcaaaatagctagaagagaagatctgaaatgttcccagcacaaagaaacaataaatatttaaggtaatggatatcttaaatacctgttttgatcattacacattgtatatatgtatcaaaatatcacatgtaccccataaatatgtacaaatattatgtaccaatttaaaaaaaatttaaggaaagtgagaatgagagaaaatatctgcaaatcatatatctgataagggactagcgtccagaatacataaagaaccagtataactcaacaataaaaagacaaatacctccctcaaaaaacaaaggatctgaatagatacttctccaaagaagatatacagatggccaataagcacatgaaacgatgctcaacattgttagccattacagaaattcaatttaaaatcacaataagataccactttatacctactaggttgataaaagagcagacagtaacaagagttggtgagggcataaagaactggaacccctacacactgagggaggaatgtaaatggtgcaggcactttagaaaacagtctggcagttcctcaaaagctacataaagagttgccacatgactcagcagttccatttgtgggtatacatactctggagaactggaaacatatccgtacaggaacttgtacatgaatgttcacagcagcatcattcgtagtagccaaaatgagtaaaatgtcattgagtaaaatgtctgtacattctagtgttaacaagtgacaagaagaaaagtttttttaaaaagtctgtatactcatgaatatataaatatataaaatacatagtatatgtccatacaatggaatattattttgcaataaaaagaaatgaagtactgatacatactacaacataaatgaactttgaaagcattatgctaattgaaagaagctgatcacaagggaccacataccacatgattcaatttatatgaaatgtccagaatagtcaggtctatagagatagaaagtacattagtggccgcctaggaccagggaagcaagatgagagactggaaataatggctaaggagtgttgggtttcttttcagaataataaaccatttttaaaattgattatcatgatgttgcataactctgtgaataaactaaagccactgagttgtacaccttaagtgggtgaactgtatggtatatgaattatatcttgataaagccatttataaagagtgtcaaagataatgatgtaatagattcagtataatgaatgagagtaaataaaacaaatttcaaaagcctgcaatgtcagcactttgggaggccaaggcaggaggatcacttgaggccaggagttagagaccagcctaggcaatatagaaagaccccacctctaccagaaaaaaaaaacaaaacaaaactcaataccaaggatgaaagaaaaactaagggagtttactacccacagacttttaaagtatctacagaggcacttcagcaagaataaaagtgaacacagaaaaaaaggtataaaattcaagaaacaacttacaaaatttgggaattttgattcataaatgtaattaatcattgagtacaaaaaaagtagtaaccataaattggtggtttttttttgttttttttgagacggagtctcactctgtcgcccaggctggagtgcagtggcgcgatctcggctcactgacagctccgcctcccaggttcacgccattcttctgcctcagcctcccaagtagctgggactacaggcgcccaccactgcgcccggctaatttttcgtatttttagtagagacggggtttcaccatggtctcaatctcctgagctcgtgatccgcccacctcggcctcccaaagtgctgggattacaggcgtgagccactgcgcccagcccgtaaattgtgttttttaacaataaggaaaattgaggtcaggagttcaagaccagcctgaccaacatggtgaatccctgtatctacttaaaacacaaaattagctgggtgtggtggcacatgcctataatcccagctacttgggaggctgaggcaggagaatcgcttgaacccaggaggcggacagtgcagtgaaccaagatcgcgccattgcactccagcctgggcaacaagagagaaactccgtctcaaaaaaaaataataaataataataataataaataaaataaattagctgggcatggtggcttgcacctatagtcccagctacttgagaggctgaggtgggaggactgcttgagcctgggaggtcaagactgcagtgaggctgtaattgcaccactgtactacagcctgggtgacagagcgagactatgtctcaataaaataaaaattaaaattaaataaaatttataggaaacacaaatggaacagaaacacagtatacagtttccaaactgagaaagagaaaaataagaggaaaaagaaaattcactcaacacaatggaaggcaataaaaggaaaacggtaaaacaaaacaaaacaaaacaacaacaacaacaacaaaaaaaaccaacaacaacaaaaacttctatatagtatttggaaactaaaaaatagagctgaactatgaaagttctacatgtcaatgcttgtggtatgtagctaaatcaggacttagagataaatgtgtagccttaaatgaatttattaaaaaataagacaaacaaatgaattaagtgctcaattcaagaagctaaaaataacgggaacctcacaaaaacaggaggatcataataaagattagaaatcaaggaaccagaaaacaaacaaacaaaaaaattagagaaggcaacaaaactaaaagctgactctctgaaaagactaaaaaaaaaaaaacaaaaacaaaaacaacctaggctggtgcagtagctcatgcctgtaatcctagcacttttggaggccaaggcaggagaagcacttgagcccaggagttccagaccagcctgggtaacatagtgggactccatcgctacaaaaaaaaattttttaactagccaggcatggtgacacatgcctgaagtcccagctactcaggaggttgaggctggaagatcacttgagcccaagagattgaggtggcaatgagccatgatcataccactgcagttcagcctgggtggcttcagcctgcctcaaaaaaaaaaaggaacctagaacaagatgtcaagaaaaaaaggaacaatctaagttagtccccctgtaaaggaatggatagtggaatattcataaactagaatactatatacaatagctaaatgaatagagagctctgcgtgtacacaacgttgatggagaaaaaagttacaaaatgatatgatcagtatgatacaatttatataaaaacttaaatcccatacattgtttatggatatgtatctataaattaagtataaaaacatgaatagcaaggatttacacagcttgaggatcctggttatacttctgaggtaagagagggagtggaatggaatagtggaagacacaaagaaagtttcaactatatctgaacattttagttcctaaaaaggtctgaaacaagtatgacaaaatgtgattaacacttaaatatgggtggtgggaacagagatgttcattatgttgcattctttattttctatatttctttcaaatatgtgaaatatttcgaagaataaaataatcacactgccctatgtatgcagaatgaaatggaagagagcaagagtgaaacaagaagaccttctaagagagcatttgtagaaatcctggctagagtgatggtaacctagaatagagatgacaataacaaaatgaagagaagtcaacgaatgtgagattatattaagaacaatttatgggacttattgatggactgggtatgaggagcttgacagaagaaggaatcaaggttaacttcagctaaagcaacatgtaggcatagatgccacttactcaaacagggaaaggtggcaaaggaaccagttagggggcatgaaagaatcctgttttatgttcatcttttatttctcctactcagacataagctctttatggggagaatctgtctgctttatctttgtatcccccaaagttcataatgtaactaagttgaatcaatgttatacacactgcctagttttgaaaaacagacaaccctctttaaaagcgtcagttttcgctctctcctctctcctctctctcccctctccccacggtctccctctgatgccgagccgaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcactgtgttggccgggctggtctccagctcctaaccgcgagtgatctgccagcctcggcctcccgaggtgccgggattgcagacggagtctcgttcactcagtgctcaatggtgcccaggctggagtgcagtggcgtgatctcggctcgctacaacctccacctcccagcagcctgccttggcctcccaaagtgccgagattgcagcctctgcccggccgccaccccgtctgggaagtgaggagcgtctctgcctggccgcctatcgtctgggatgtgaggagcccctctgcccggctgcccagtctggaaagtgaggagcgtctctgcccagccgccatcccatctaggaagtgaggagcgcctcttcccggccgccatcccatctaggaagtgaggagcgtctctgcccggccgcccatcgtctgagatgtggggagcgcctctgcccggccacgaccccatctaggaagtgaggagcgtctctgcccggccgccccgtctgagaagtgaggagaccctccgcctggcaaccgccccatctgagaaatgaggagcccctccgcccggcaaccacaccgtctgggaagtgaggagcgtctccgcccggccagccgccccgtctgggagggaggtggggggtggggtcagcccccctcccggccagccgccccgtctcggagggaggtgggggtcagccccccgcccagccagccgccccgtccgggagggaggtgggggggtcagcccccctcccggccagccgccccatctcagagggaggtgggggggtcagccccccgcccggccagccgccccgtccgggaggtgaggggcgcctctgcccggccgcccctactgggaagtgaggagcccctctgcacggccagccgccccgtccgggagggaggtgggggggtcagccccccgcccagccagccgccccgtccgggagggaggtgggggtgtcagccccccacccggccagccaccccgtccgggagggaggtgggggggtcagccccccgcccggtcagctgccccatctgggaggtgaggggcgcctctgcctggccgcccctactgggaagtgaggagccccactgcccggccagccgccccatccgggagggaggtgggggggtcagccccccgcccagccagccgccccgtccgggagggaggtgggggggtcagccccccgcccggccagccgccccgtccgggagggaggtgggggggtcagccccccgcccgaccagccgccccgtccgggagggaggtgggggggtcagccccccgcccgaacagccacccagtccgggaggtgaggggcgcctctgcccggccgcccctactgggaagtgaggagcccctctgcccggccgccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggaaacttttcattttgttctgtactaagaaaaattcttcggccttgggatcctgttgatctgtgaccttacccccaaccctgtgctctctgaaacatgtgctgtgtccactcagggttaaatggattaagggtggtgcaagatgtgctttgttaaacagatgcttgaaggcagcgtgctcgttgagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaaaaaaaaaaggaaaaaaaaaaaagtgtcagttttcaaagacattttatatcacttaatattacaataaaggaaaaaaaactttcaagaggttcccacaaaagttttcctatgctgctgattcagacttttaaggcccatagaaatttatgctttccactttcttactaagccattttaatcagtttcatatgattctaccagttcggtagattataaggtatacaatactataatgtatactattataaatgggatgcaatttataatagggttattattatacaatatatccttataaactactagtcatgtattgttttggttatatagtttatacagccccttatgtggcttggttatactaccacctagataagtaggcaagacattctgtaatatttagtgcagagctggaattcacgcctaaagcatcaggcggcaaatccagaattcgtcattttactaataatgaaactgatgcttgaagaagtcaggtgacttggccaaagatataaagctaataactgtaggctaattttgctctccttaaggaactgatgctattctaagcttgttaacattatgaaaatgcataatgaaaaaactcaaaatttatccaaaagacagattctaattcttttgcttacttttgaagtctgaatcatatgatacagaagattcttccactaatactacataatcagaacagtgaaagtaaaatcacatttcaaagggtcattaactaagtgtgttttccctacgataaaacggtaaccaagtttctttagagggaaattaactgtatctaaaaagtaatacttgagtatatcataataccacaagtttcaattactgtttttttgttattcaaaaccaaaacaagtatatgtcaaccactgcatattggcaactacccctttttagtgaaccatgaaaactgaggagtgttaggtcctaggtcaatttttaatgtcaaacacaataagtgatgtgattttagtcaacttcagagtagctttatgcttatacttccccccctctcagtttatcccattagcttaggatatttggggaaggtggaggaacatattaaagagtagttcagaattcaacaaagtactcaaagctttaagtataaatatcccatataaataaatccgggatttaactgttttatcctaacagtttagaaatgtcattttaagtgccaaaaggaaattccaaaaggactcttagaaaaactgttataaatttttaaatgtgagaatacagtcatttgaaaatatacataatccacatttttagcaatgctagttctgctgctggatttacataaatttgtttgtgtcaagtttatttctccctgttgtatgggatacatataaatggaaacaaaactgagttcaaaggcataatgagtatacttatttcttcttaaattcaatatatttttatttgattttagaaataatgagaaaccaatgatggttactgcaccaggtgtgacactatgagagaatgctttaatagtatagctttggctgtaatgcaaagaatagatagtacaatgacagagataggagggtattagaagttagagatgggtatgtgttataatagtctgggtcaggcaagaactttataaaagctcagattccggggtaacacccctggaattctgagtcaatgggtgtaaagctagtcctcttaattctagatgaaatgctaaacatgaatgactggtaggaagttaaagcatcaaagggagaatatccttgatgctgacccttttagaagaatatcagaaacccataaaaattataagcagatgcttcatttttaccacaaatggatactgactcacctggatcagggtcatattttaggtccagtggatgtacaacagggtggtactgcttctaaacataacataaattaaaacagatttaatcacttaatgcttcatataaacatctctttcagctaatatgggagatatactatagagtcagtaccattcttttgaggaaaaaaaattaaatcctactgtctgtagggaagaggaggtgagaaggtaaaaccaaactaagtctgaattatgtcttttacagtactgccacctgctgcatatactaagaagtggcaccataaaaaagtataatcagaaaaagcaatcaagcaaattaaaagcatagaaactgaattttatgtttaaagtacagggtagtctccaattatgaagggactgtgtttcaaaagttcattcaggacaagtgtttagaactcaaaatgcatatttccatgaaaactcagttctaaaaggtggcgaggctacattaccaccacactaagcctatatatcctgcgacacactgaaattatagtagcagaattactggcacagaatctacaatgcaggcaaaaagaaagaggaaattgctcttccttattcttgcccaaagccagcagaagccaaaaaggttaaaagaaagaaaacaagaagaaaaaaaggtcttcagccagctgtggtgactcacacttgtaattgcagcactttgggaggcccaggcaggagaatgtcttttgctcaggagtctgagaccagtctgagcaacaaggagggaagaagggaggaaagacgcagggcagggcagggcaggaaaaaattttgaaaaggtctttggtatcctcaccttatctattttgcattactttttaaactaccacagcagtacctcacctaggccagccatctttcttttctgcaatattgattactagttttgggggtttaggggtagtggggcagtaacaagggcaacactgaaaaatacactttcaatgtttttcctgaaaaaaactttcaagtgggaggggtgggggaagtgatggaatgcggtatttgagaactgctataaagaaaattaaaaattctgctcatgaatactgtttttcacagaataactaaaatgttttagatacaatattaagccgggcatataatgacctgaaacaatcctgaaactgaggcaactagaagatttatatgtgaacatttatgtactaatttcaaaaactaaaggcaatagtatagcacaatctaaacacaacatgtacctcactggagggacaatgctattcccagcaaacctcccctccccaccaagggaagatttgggtccaattttcttgtggatttcctattttttatttattctagtcctaataaatctgaaaagatgagggtgtgatatggttggtcattgatatctatagtaattataagaaggaagtctacggctctgcttgtctaaaaagctcgtgctgaaggagctgaattcctggtcttgtcacccagatgttcatgatttttgcagcaaaacaaattacacccaattcataaagcaaatttcagtgttatgaacaggtactaaaacaatcttcatcatcaatttaactaaatggtcttccaaaatatacaaacatacaaatatatgccaaaaaaaaacaacaaacagaaagaaaagtgttaaaagaaaagcttctttttccatccttgtctcagaatcataaagtcattgtcagtcttccatcaccaatttcaattttaaccactcactataactttcatttttttcatttttgaaccagtgtgttcaaaacacagtatagtatgactatactatgtcatagtacaacttagaagagtaaagtcttacaagagacaaacaatactaattgaggcaggaaagaaaaagacaacaaaatgtcacttatctccacgtagagccttatattttaatgtttttattgtggtaaaatatactataacattttaaaggcaaatcatcttaccagaatttcttgttttgcttttatggttttgatgacacattccaggatctttctgggatactgcttacgttttgtggctatatctactatgatttcatcaaactgatcttcaagtactttgatgtcagaatctatttgagaaaaaaaaatgtatatataaaaagttccctaaaactcattgtttacattctgtatggaaatgtgctataaactaaatttagaaaacacaaaataatgaaggaaaacaaatatggcaagttaatgaatgcccccactttggtgattaatttatttacgcattgaacaatcaattattgagcatctataagaagccaggcctaaacaagagaaatacaaagatgagcacaacatgattcctactctctaagagttcacagtttgctgaaagaaacagacaattgcaaggcaacctgataagtgcaatagaggtatgagcaaaatgccatcaggacacagaacaatggaaaactgactgactgtgaaatataagactttaaagaagtaacatttgagcttgaaatagaagtataagtccaatggataaaaagtggtacgggaaaaaaggaatagggagaagcattttaggcagtggaaacagtatttgcaagatcctagtctttggagacctgagaaaagttctaaatggctacagaataaagtaaaggagaaatggatgataaaatatataagaaccaggctgtaaagggtatttaatatcagggatgctaagaagttttgacttattatgaactgacccaaagctatgacagtagcagtgagtggagtaactagatctgaaataggactcaactggattgatggtaggaaaaactgaaagatacagtgagtttagagtttctttcatttagctaactctactttatcatatgctttttcatgttttaaaacagtgattctcaaatgttagaagaatcacctaacgagtatgttaggagtacagattttttttttaatactttaagttctagggtacatgtacacaatgtgcaggtgtgttacatatgtatacatgtgccatgtcggtgtgctgcacccattaactcgtcatttacattagatatatctcctaatgctatccctccccactcccccgaccccacaacaggctccagtgtgtgatgttccccaacctgtttccaagtgttcccattgttcaattcccacctatgagtgagaacatgcggtgtttggttttcaggagtacagaattttgattcagtaagtctgagatggggcccagaaatgaagcaccctagatgaaaggaatgtaggtgatccatctaactttattttgaaaatcattttaaagagtaaaaatactaagtagttacaaatactaaagagctaagttcttagcttaactggtcctcatattgctctgttgtgtcaaagtctaagctagaaatggacctatttattttattgatcagaagctttattaggaagaaatctaacatctgaaacataatttttgaaacattttgagaaattgctgatatgtttcggtatatacatatcagataatcaagtatatcaggtatagtctttcattcatgtcacaaatattaattgaatcccactaaattagttcttttgagggcaccctttttttcctttttctctttctttccttccttctttctttccctttccttcccattcattctccctcccttcctttccttcttttctttcctttcctccctccttctttcctagatagatagatagagagagagacacacacagattgattttcaatagcttttggggtacaagtggtatttggttacatggatgaatagtacagtggtgaagtctgagattttagtgcactcatcacccagtagtatacattgtgaaagtacccttcttttgagggcaagaaataatagttatttcttactttgaataattatttatataagcagccctccctaaattttcatttatccattaaaaaagttaaataattagcctgaagaaaataatgtactatttcacaattagttaaaaaaaaaaaaaagaaaagtctcccaggtaaatcttttttgtagagaggaacatgctttcttagcactacctagtgataaagctacaattaaaatgtatcacaaaatttgaacagaagccaggcacaggcctgtaatcccaacactttgggaggccaaggcaggcagatcacctgagtttgagagttcgagaccagcctggccaacatggtaaaaccccatctctgttaaaaatacaaaaatgagccaggcgtggtggcaagcacctgtgattccagctacttgggaggctgaggcatgagaactgcttgaacctaggaggtggaggttgcagtgagctgagatcgcgccactgcactccagcctaggtaagagtgaaactctgtctaaaaagaaagaaaagaaaaattgaacaggaaagaattattcattaatttaacatatttcataggtgcctactatgagccaagagttgagaacaaggtcaggagcagtggctcacatatgtaataccagcactttaggagattgaggctaggagtttgagaccagcctgggcaacatgatgaaaccctgtcctctaccaaaaatacaagttagccaggcgtggtggccacatgcctgtaatcccagcaactagggaggctgaggcacaagaatcactttaacctgggagacagaggttgcagtgaactgagactgtgtcattgcactccagcttgggtgacagtgagacttcatctcaaaaaaaaaaaaaaaattgtctttttaaggaaccttctacaaagatgtaacctcatcctttacacggtacttgtataattaataataacttcacacttttaagggtacttcactattcactctagagatcacttacaaaaatacaacttgctttgtaaataattacagaaattccctgggcctcttttgtcatctggagatagctctacagtattttccaataaactattgacaaagaagactattgaagtcataatctcagttctttattactcccctagtaaacaacttcttgaaaataaatgacactaaatatggagattaaaaaacagcattcaaaacaaaattagctgcaaaaataacccagaaattaataatggaaggaaaaagtcacatacccataaaacaattatctgaagcttcctgccatgcttgcccattaatgctgatattctcttgcacagctgattcaaaagtctgcaataaattcacagtagtcaagtcactaaaaataattttaaatactaaattcaaacgttttagcaaaataatacttccagatttgtgacagaggaaataaaagtagcagaatagctaattagtatatctattcttttcaatgaagattccacttcaatcattgattctacctacattttgggtctcatagccattatgctacccaagagaaaatctgatttaaaattttggaatattcttataaacaaacaaaaaaaagtactcctagaatgaaagaaaaaataaaatctaacaaatttaggctcagttgaatctcaggggtataagtactatatatgctgctgaatgactgttgatgttaacaagagggaaaacatacatgcttaaaaataaaattatattttataaagggctgtatttttgagagatgaacacttatgtagcgatgaaatgacatgagatctaagatatgctttaaaatagcaaacgtaggccaggtgcagtggctcacgcctataatcccatcactttgggaagccaaggcaagaggattgcttgaggccagttccagaccagcctaggcaacacactgagacaaccttctctactaaaaaatttaaaaattagccaggcacagtggcacatgcctgtagtcccggctacttgaaaggctgaggctagaggattacttgagcccagtggtttgagaatacagtgagctatgattgccactgtactccagcctgggagacagagggagaagcaactgtaacaaaattttgacaactgttgagtttggtggtggatatatgggtgtccactgtactaaactaattttttgtaaggttgaaaatgttcataatacattaaaagataaagaaccaaaaaacaaaaaacaaaaacaaacaaaaaatagacaaattggacttcatcaaaattttttttaaatgatggactaaaggaattcggcagtacacatttcctattacccaacaatttcacttctagcaatgcatcctaaaggactactctcataaaaactaaagagaatgtgctagaaatgttcatttcagcactgtttgaaatttttaaaattgtgggaaaaaacctaaagtcaaaattagaagagttaaatagacaatattcataccacgcagtacctaaaaaggatgaagacaagctctacgtaacactaacaaataatagacatgtttggtttcaaaaaaggcaggtcaataacaattcatcagcatgacattattaatggagacaaacaaacataaacagagagaaagaggtaaagccacagaaagggggtatagaaagtttactctccccaagtactctccaaaatagtaccttatgtcctagaaggaagagggatggggaaggggaactcaaagaattttgctttatgctactgtttgaatttttttatgagcatatattttgtaccctttgtataattaaaaataacataaaccaaattactgataattatgagttaaagtacatattctacatttcaaagatttcataaagtaaaatccttattttattttttgtttgtttgttttttgttttttttgagatggagtttcactcttgtcaaccaggctggagtgcaatggcgcaatcttggctcactgcaacctccgcttcccaggttcaagcgattctcctgcctcagtctcccgaatagctgggattacaggcaagcgccatcacacccggctaatttttgtatttttagtatagacagggtttcaccgtgttggccaggctggtctggaactcctgacctcaggtgatccgcccgcctcagcctcccaaagtgctgggattacaggcgtaagccatcgcgcccggcctatgtatgttttaaaattattttctagaattactttcaagaattgctgagaaaacatattgtctttgtaacattcattgcagactgctaccaatactgtttttaaagaaaatctgctacttaatatgcagttttaaacagagatacaaaataaagcttctgctttatttaaaataaaacacaagtgaattcctgtggtagtctaagccctgtaaactttatcttataattcactttatcgtcccactaaataggatataataggttaagccaagttcctctttttctgtaagacacctaaatgttttaaataccttagcatttcctagaatcagacaaattctaagattatacaacaaaagtcttctcccaaaaaactactaaaaacgtcctgagatatatccctattcttgccttgcttgcaaggagggaatgacgtaagagtcactatatacaaaactacatacagagtcacaacccaggaagtgtttcttcattcttccactgaaccttttttttttgagatggagtctcgctctgtcacccaggctggagtgcagtggcgagatctgggctcactgcaagctccgcctcccgggttcacgccattctcctgcctcagcctcccgagtagctgggactacaggtgcctgccaccatggccggctaattttttgtattattattattattgttttagtagagacggggtttcaccatgttagccaggatggtctcgatctcctgacctcgtgatccgcccgcctcggcctcccaaagtgctgggattacaggcgtgagccaccgcgcccgaccccttttgcctgttttagagtgaaaacattttctttacaagactaaaataggttaaaaaaaattgtgttggttgaaaactttactaagatcatacatttgcctctataccacatttcccaagcctttcttaaatatttttgcaaagccctgaaggtggtagttttttgggaacacaagaaataaagggattgtgtgcttccttataacaggcaccaatctacttatattagcggaaaaaatttaaaagctcataataccgcacatttgtgagttatgaatgaccacagtgcaaacagtaaaaataaaggttaataggccgggcgaggtggctcacgcctgtaataccagcactttgggagcccaaggcgggcggatcacgaggtcaggagatcgagaccatgctggctaacacggtgaaaccctgtctctactaaaaacacaaaaaaattagccgggcgtggtggcaggcgcctggagtcccagctactcaggaggctgaggcaggagaatggcgtgaacccaggaggcggagcttgcagtgagccgagatcgcgccactgcactccagcctgggcgacagagcgagactctgtctcaaaaaaaaaaaataaaataaaataaataaataaataaaacatgcaaaaggaaagatcaaatgctgcttgggtgaatggctgacttccagaattaccctttccaggagaattcctcattgtctgcggctgcattgtccaacaggtgagccactagccactttgtagttactgagcgcttaaatgtaactagttcgaagatgtgccgtaaatgcagcacaccagatttgaaaagcttagtacgaacaaaagaatgtaaaatatctcattcatttgatattattacatgttaaaataccttggatttattgggttaaacaaaatgtcttatttccattaacttcacctatttcttacttttagtttaaaactacataaagattagcttgccttgtattttcactggacagcgctggtctaagtaattaataagacccagctgacattagcatctatttctttctcctctagcgtttctcgaactggttctacagtagcctggggcaccgttaattctgccaaggcctggcgtgggatctttctgaatcctaagatcctgggtgttgggtaagaggatgatgagtaaagaactggctaactggtcccgtacccactgcgcatctcgcagagcgggctcccgaatctcctccggcagagcgtccccgagcttttgcacgaagcggccgcacagttgtagcatttcggtcacagcccgcttcgaggtgcagcgcacccgaaagtcttctcggggagtggcggagaccaaggcctggctctctgtgccagccgcgagctccttgtcccatggagggtcaaggaccaccaactcaggagaccccgccatttttcgtcggaactgtgggcggggcactctggga

SEQ ID NO: 587 - DNA, 65646 bp, Homo sapiens; identical to SEQ ID NO: 586

SEQ ID NO: 588 - DNA, 22492 bp, Homo sapiens
gtagggagaaaatctccagtgctattatatatttcaaacattacttgtttgcataataaccaaacactgagacagcaggcatcagagtgccatgaagtacaacacaactcccacttccatgcttgaagagctttgtgagagctgtgcctgttgaggcaggggacgtgtactgtggactccaggaatgacacaatgttagccggcagacacctcaaagttcctctgatcccaacagactgggaagtggggtgggtgagtggaaggagctttctcaagatcacacagcgaggaggtgacagaccaaggggccagaagttgggtcccctggatctgggccacctgttctctatacttcgtctcactgacttgcacatatttcgataggcagatgggtcttaggaagccagagggttgtcatgacagcaagggtaaggcatcatgggaggtttgggagaggtcattgaggaatgtcactagcagttcattgtcttttttcacaaccaggtactatcacatatttcaaacatcacagtggctggaagcaacagggcaggaacagacaggtgtcgtcacttaacctggtctttggggaccttgacatcaagaccgacaggtcaaatctttggtctcagggagaagagtgccagctcacccagaaggcagaacagctaacagccatgcccaggagaggcagcagtgggagtcatgaaggaggacggggtcctgtcccagcgtcccagcccagctacccaagtagaaggtggggcggcatcttctatggctgagtcttgggcagtgggtgctctgtcatattgtcaggtttcttcccccagctccacaatgtgaagactgaggtggtccctccaagccccactcagcaaggaggacagggctggtggatcctccagggtcagatggggaaataaaagtgtttcattcttgaaggggaagctgcacttctccacggcacgcctggtggtgccaggggttaccacaaagaggcggcagagccatggcccaccagccacttggcaggctggttgtctggtgaagcttttcagggtttggcacagggcccagtcctcagtcccccccatgtccaccacctccactggtgcccccaggcctgggaggtgtaggaggtgccgggggggcatgtaggtgtgagtgaagaggagtgtgtagtgggtgggtgtgcttgggagcacaggggcatggaccacctgctccaggtactccaggccaggcaccaggcccccctgatgcaggcagccgaagaggagggcaccgagggcgttgaagaggaccacagtgcccttccaaggcacaggctgcgtctgtggactacaaagcaggaccagggggaccaggaggggaatcaggaaccgagcctcctggtggctaaaggcagatagcagggccagaggcatgaagtagaggagaaggagataggacctggggctggacagcaggctccgggcacccagtgccctcaggaggcccatttgtgcagaggcctggaggccgacttgcagccgttgccacgcagcctgcagggcctgggcatgcagcaccccgaagagcaggaagccgttgactgccaggtgagtgagccgcgcgtgcgtgccatgtctcgccaggttttggggattcaggttgtagtgcaagaagttgacaggtgtcaggacaaggttcctggatgtagcggggctggagaaataccagctgtccgtggccacaaacaccgctgctgtgagggctgccccagggagcagcaccagggcctcccgggtcagagacttcaaaccagggtttgtggctccacgagtgccccagaggtagagggggaccacagcaaaggccagaaaggtgggccggttgaagaagccagcagccacaatgcctccaagaagccagctgcgccaccgtggacccggcgccggctccttgcgtgtagggccccacgttacatgggaggataccagcaccagcagccacgtgaagaggagtccctcaatggtgttggagaaggtccttgtgtagaagaccagggtgacgtaggaaccagacagcagggccagggcgttccagcgatccgcccccatcggcggggccaggtggtacacggccccgtccagagcaaaggaaagggcagtgaggaggagtcgaggccccaccagcagcgcatagccgctcaccaggccaggccacggccccagctcctcccagagcctgagcagccagaaggtggaaccagagatcagcagggggaagagcaccgagcggcaggagctgctggggtaaaactcccagggccgcgcggcctgaacgcccaggatgtcctctgcagagagaggcagaggtgagccagtaccaagctcagggatgtagtgggcaaaattctaggagggcaccccacatttcccaccccttggtgtgtgtgccctgcgtaatccctgggactgtgcacgggctggatttttcctcccttccctccctctctccctccttctttcccttccttcccttccttccttcccttccttccccttccttcccttcccctcccctcccttcccttccttccctttacttcccttccttcccctcccctcccttccttcccttcccctcccctcccttcccttccttccctttacttctctttccctcccctcccttcccttccttcccttccttccttcccttcccttccttccccttccttcgcttcgttcatctctgtcacccaggctggagtgcggtggcgagatcacagctctcgctatgttactcaggctgatctcagactcctggcttcaatccattcttccagcacagcctcctaatgtgctgggattacaggtttgagccactgcacctggcccgcaggatggactgtatcctgagattaggttacttatacaggagcactgactgtaaaatagggagactatgcagtgggccggacctaatcacaacaatcttttaataacagagttttcaccagctggacgcagaagtggcagtgagattcaaagcatgagaaggatttgacatgccactgctggcttcaagacggaagaggccattggctaggaatgtgggtggcctctgaaagctaagagcaaggaagccgcaccataggttccacagctgaaatgaactagattctgctagaattagagagcttccagacaagaactcagcccagtccatacgctgatgtccaccttgtgagcagagagcccgtgctgcccttctgatggacagaactgtgaactcacagacgggtgcagtttgagctgctcgtaggattttgaggatttgtcaggagcagcagaagcaagtgcaggggagctcagagtgcagagggcaggaggggcttccccgggagatgaggtggcagtgtgtcctgggaagagtgtgtgggaggcgggcaggtgggggaggcctaacctcttctcagggttccaagatctcaaaagccaaggacaagcacccttgtccttacacctgtcaagcttgacagagccgcatctctgataatgattgttatcaggagatggggggagagaagaggggtaggtgatgagccatcagggttatgtcagaggtgatttatgttagttttgtttacaatacttaaatttttttttttttagacagagtctcactctgtcacgcatgctagagtccagtggcgctatcttggctcactgcaacctctgcctctggggttcaagtgattctcctgcctcagcctccaagtagctgggactacaggcgcccgccactgtgcctggctgatttttgtattttcagtagagatggggtttcgccatgttggccaggatggtcttgaacccctgacctcaggtgatccacccgcctcagcctcctgaagtgctgggattacaggcgtgagccactgcaccctgcctatgatacttaaattttttgtaagaagaatatatccaagtagtacttacataatttaagaaatacttgctgcctgttctgtaaccctgtgccccaacgtcccagagctctgaggggtgggggcgcgggagcagctccactccaagcctcattgttcacagcgtctcttgcttgatcacctgctggctgtttcgagctgatcatacagcctgcggatcattcgggctctttgattctgctacttatttctccagactttcagctgttttatctatctatgttagatgttgaaagggaagcaaaatccaggatcaaatctatctggctgcttttctggttaaaaaacgacgtgagggaaagaagatgagccttttaacttaaaaaacaaattcacctgttgagccctgtggcaaagaaagctgatgcctccaaaatatctattccctcctccttcattagacttttttttttctttttttgagatggagtctcgctctgttgcccaggctgaagtgcagtggcacaatcttggctcactacaacctccacctcctgggttcaagcaattctcctgcctcagcctcccaagtagctgggattacaggcgcctgccaccatgccaggctaatgttttgtatttttaatagagatggggtttcatcattttggccagactggtctcaaactcctgacctcaggtgatccacctgcctcagcctcccagagtgctgggattacaggcgtgagccactgcatctgactcctttgactctttttctgggcacttggtcagatataaagactataatttttagcttcctttgcagctaggtgtggcctcatgatacattctgcccagtgtgatagaaatgagcaaaaagcatgcgcccttcaaaatatgaccttaaagagagaagtaatgcccttctcctttgttggctggaaagactgcctgtaggcttgatggctggagctcaagcagccgtcttgaactatgaggatgaccccacatgcccatcacatctgaaaggcctcaaggcctttgggcgagacggtatgggccaggcaaccagcctcatgatgtgtcccacaccgcctaacagatgagtgagtgtcccaggtctgggttcccttacccctctcttgaatctacagaagagaagtttcatgatctcagatcacagccctatggaagctcttgccaaacactggggaagcctaactctaataaaagtgttcccatgggaagtccaacacagctctcattctgaatgacctgtattgttggtccaagcagggatacatcaaagagactggtggtttattagcattacccagaaggtcagtgtcaccactcgggaaggagatatgaagtccccacttccaagttcttaccccagagagagaggctgctgctctgcttgtggatttactactcatctacccagacatgctactccctccccacaaagtctcccgtcagcttctcaagcagactctgctgcagcttgtctcagccacacatgcggagttttacctgccatcacctcaggggactggaagaactcatctgggtgcacatagcccgtctgcggaaggagacaccacagcactcggagcaggctgagaccaccccaaagcaccctgactgccatcttcagatccagttgttgccaacacaccgggcccaaaacctggaatgatgtcccagctgctacagatgctacgctggatccacagatctgcatctgttgaggataacagttgttggttatcacgatgtaaattataatatattcaactgtctgaacaaactgaaaatggatctgtcatttaataaaaatgacaataataataatagctacttcatactctatgcccactaactgccaggcacgtgacatgcatatttcatttaatcctttccacagtctggagcagtgggtcttaggatccctgttgtacagatggggaaacggaggcctctgctgagtaacttggttacttgctgatcatatttgctaaggagtctgatggttcattttatgtgtccacttgactggcctaagagatacccagatagctggtagaacattatttctggcagtgtctataagggtatttcagggagagattagcctttgttgtggtttttttgtttgtttgttttttgagacgaagtcttgctctgtcacccaggctggagtgcggtggcatgatctgggctcaccgcaacctccacctcccaggttcaagtgattctcctgcctcagcctcctgagaagctgggattacaggcacacgccactacgcccggctaatttttgtatttttagtagagacggggtttcatcatgttggtgaggctggtcttgaactcctgacctcatgatccgcccactttggcctcccaaactcctgggattacaggcgtgagccaccgtgcccagctaagattagcctttgaattggtagactaagaagatcagctgcaccagtgtgggtgggcatgatccaacccattgagggtctgaataaaacagaaaggtggaggaagggtgaatttgcactctcttcagctgggatagccatcttctcctgcctcagacatcggtgctcctggttcttgggtcttcagactctatgtctcacaccagtgtgccccaacccacctccctgaatcaagctctcaggccgtcggactaggactgggagttacactgtaggctcctctgtttctaaggctcccgactcagactgaattcaaccaccagctttcctggttctccagcttgcaggtgtcagattgtgggacttcaccagcccccataattgcatgagctaattttcatagtaaatgataaagccagttccctattgtttctgtttctctggagaatcctgacttatacagggtctaaatatgacatttgctcaatgtgacatttgcaaggaagatcagggtacccaacaaatctgggtcttgcagcccatcctgatcaccagctcctatccacaggccagtatggcaggctgcttcttgcatttctgaaaacttgggaaagtcaacggatgccacccatttccctgcaaaaattacactcaaccccattgtttccagtcactccctccaactttcacacaccctggaacctgccttttggaaggtgatgggaacatttgtaactctatatgatgagaatcctaactccctcaactcaaatatagtattaactgcatctcagaagttttctatgtaactcaaagagcagtgacaatctgagcccatggcatgctggatctgtaagtccacagcatcactgctgaacaggaaagcaagcttgacaacctgcttgtccctcctccagaaatagtgatgttgccctgacttcttgatattttaaattctgaccttaaatagttcttgctctcaggtgtaatgtcaggtggctcacacctataatcccagaactttgggaggctgagatgaaaggatcgcttgaaaccaggaggtcagaccagcctgggcagcaaagtgagatccccatttctacgaaaaaatagctggacacagtggtgtgtgctggtaatcccagctattcaggaggctgagacaagaggatcacttgaacccaggaatttgaggctgcagagagctatgatcacactactgcacttctgcctaggtgacagagcaagaccctgtcaaaaaaaaaaagccaggtgcggtggctcacacctggaatcccagccctttgggaggctgaggcaggcagattgctttaagtcaggagtttgagaccagcctggccaacatggcaaaaacctgtctttaccaaaaaaatacaaaatttagccaggtgtggtggtgtgcacctgtaatcccagctactcgggtggctaaggcatgagaattgcttggacccaggaggtggaggttgtggtgagctgagatcacaccacagcaccctagcctggaggacagagcaagactctgtctcaatcaatcaataaaaagttttttttaaaaagaaaacgttgttaactatagttaccctactctgctatcaaacattagaaattaaatcttctaactgtagtttgtactgtagcttatattctaaactgatttttattcctaatattggtttacttgtgcattcttttttctttctttataatcgtcaccagaattgtgttgattttgcgaatttcttcaaaacatcaacttttgcccttgtttttaatttctttgctcatctttattttttctttccttttactcttttgggtgattatttcattgttttatttcagattttttgctatgagcacagctcgttaatttggagccttattttctatgagaagtgttgaaggccacacagttttctctaaattagtattaactgtacactgcaagttttgctatgtaataatttcatcaacttttggttctaaatatttctaattgccattgtaatttcttcctccacaaatgccttatggttgaaggatttaatttttaatggtcatttttgtagatattccatggatgcttgagaacaccatacattctatacttactggatatggagttctataagttgtcattagatcaagcttattagttgtgttgttgaaatctttttttttttttgagatagggtctcactgcgttgcccagtctggagtgcagtggcacgatcatggcttactgtagcctcgacctcctgggatcaagcgatcctctgacctcagcctcctgagtagctaggaagacgggtatgtgccaccatccttggttaatttttaaattttttgtagagacaaagtcttgctatgttgcccaggctggtcttgacctcctgcgttcaagcaatcctcccaccttggcctcccaaagtgctcggattacatgcatgagccaccttgcctggcccaaatcttttatattcttaatttattgattttttactgcttattttatcaatcacagaaatgtgtgttgaactagctcatgaaatagttgacttgtctaattttccttgtaattctgtcaattttagttcatttttgaagctatattattatatttgtagaagtttataattgttatgccttattggaaaattgaatatcttatcattatatagtaatcttttaatctctagttctgttttgtcctaaaatatattttttctgatattactgttgctatacacactttttggaaacttagtatttacctggtacatcattttccagccttttcttttcttttctttctttcttttttttttttttttttttgagatagtctcgctctgctgcccaggctggagtgcagtggcatgatcttggctcactgcaacctctgcccctcctgggttcaagcgattctcctgcctcagcctcccgagtagctgggactataggtgcgcaccaccacggctgcctaatttttgtatttttagtagagacggggttttgccgtgttggccatgctggtctcgaactcctgacctcaggtgatctgcccacctcagcctcccaagatgctgggattacagatgtcagccactgcgcccggccaatttagggttattattgatacatttatttataccatcttattttgtgttttcttgtcttgttttttcaattttttttgtcctttcttgccttcttttgaattagttttttttctcttttctctaacagtttggaagttacatatactcagtttccaatatgctataaaataccatatattatttaatattttaatatttagtatactatgttatgtgtcttcactatgattattctgggtgcacatttctttttatttattatagtcgaaagttttttggcttctcgaacctgtggattaggaccctttgtcatttatagaaagtaatccttcattagactatatgctgctgataaagacatacccgaaactgggtaatttataaaggaaaagaggtttaatggactcacagttccacatggctggggaggcctcacaatcatggtggaaggcaaaggcacgtcttacatggcagcaggcaaaaagcgaatgagaagcaaacgaatgagaagcaagcgaatgagacgcaagcaaagggggtttccccttataaaaccatcagatctcgtgagacctattcactaccacaagaacagtatgagggaaaccacccccataattcaattatctcccaccaggtccctcccacagcatgtgggaattatgggagctataattcaagatgagatttgagtgaagacacagccaaaccatatcacagaccttctcagtctatcttccatgtctctttaagttctatttcatattttccatatctttagctctcttggctatatgtcgggtaagttctgttctatcttccatgtctctaatcatcctttcagctgtatctagatgttaaacctgtctatggagttttaaatttcagttgttatatttttcatttctacaagttgtttgatttttttccacatctgcttgctcttttgtgatattttcaagactctcttttatttattaaatgatatcaaacatacttgttggatatactaggtttgataactccagcatctaaagtctggatctgaatctgctgtcttgtttctgctggatctcactcatagtgccctgtttatttgtatagttagtgaattattttatttagtgaattatctcattttctttggaatattactgtgggaattctttgaggtcagggatgaggcaaatttcttagttcctcttgaagggatttacacttgcttctctcaggtaactgtgggcattacaagcctaggaccatttctaatcaaatttttggctccaggttttgtgtgtgtgtgtgtgtgtgtgtgtgtgtgtatgtgtttatcttttaggaagggggatagtgcctggtcatgtaaattcatgagggcaggctcatgattacaaattctgaagggagatagcccacccccagctcaatttgattagcatcaggatccaacaagggcagttttcctttcagtcctgtagggatggaataatttttttcttcctttttttttttttctttccgagacagagtcttgctctgtcacctaggctggagtgcagtggcatgatctcggctcactgcagcctctgcctcccaggttcaagcaattctcctgcctcagcctcttgagtagctgggattacaggcgcatgccaccacacccagctaattttgtatttttagtagagacggggtttcatcatgttggccaggctggtctcgaactcctgacctcgtgatccgccggcctcagcctcccaaagtgctgggattacaggcgtgagccactgtgcccggccaaatttatttcttaggccacctttatattagaacgtggccctccagagtcacagttttgcggggagtctcctgttaggcttccctccgggtgggcagtaagctttatcttctgtcctgctagtcccgagaagctaccaagtcctgaaaacctaatttgcataacccaactttgagggtatctacaaaaaatagctttttgtttcctagtctttacagtacaataagacaccctagaaggagatagaaatagtggaaggggtccctgctgtcaaatggcatgcaatatagaggcctgaagtggccagtggtttggataatgaggaagccaaggaggctctcaaattcacagttttgtatgtatcctcaactccaaacctggctcctggctttgcatacctctctaagtccctgtcttcatgcccaagtattacttacattttcttcggcttacatactattttatccagcattttagttattttcagcactttattccttttataattcaaggacaactttccacttgtgtcctgtttaacaacctttattttttttttctattcataaacataatacaaaattgttgtagaaaaagtaaaaagtgcaataagccaaaaagggaaaatggaaattacatgcagttcctgtcactcaaaaaaacactgttaggccgggcatggtggctcacgcctgtaaccccagaactttgggaggctgaggccggcggatcacctgaggtcaggagttcaagaccagcctggccaacatggtgaaaccccgtctctcctaaaaatacaaaaattagcagggcgtggtggcgggcgcctgtcatcccagctactggggaagctgaggcaggagaatcgcttgaacctgggaggcggagtttgcagttggccaagatcgcgccactgcactccagcctgggggacaagagcgagacttcgtcaaaaacaaaaaacaacaaaaaacaaacaaacaaaaaacactgttaacattttgatatatgattttcttggaaaatataggattatatttgtttattcttatatatctacactttggcataatgttggcatgagaaatagtcatgttgagagttaagacagggattgagaaaagctaaattagtttaagccgtgtcaaattattctcaaggaagtcatatatttaagggacagccttggtcagcggatccttctggtcatgatttgggggaggggggcaggaaacatgaggggattgtgttgctatcacaggatgtgtctcaaaactactatgcgggaacttgtatatctccacaactgctgaaggcatctgctgagggtgagtgggaacggaggatgctatacctaggtctctgagctgggctccagaagaacggatggcaggctgttcctcagcgtatgggaaggtgggcaagttggcatcatgacttccgctatggagcaagccagtctcatgggcatgtggccttcgatagcatggctctgctgtcctctatctcaccctcgcccactcttattttgccctccagttactacacacccctgcccaagcctgtgccattgcctggggctgctccatctcagtagtgtagctttgcaacattgaaattgagttttgtctctataagggatgtctgaccattcagtgagtattttcaatgtatctattatatatttgtaaatggaaggggatcatacaatgtttgctttaaaatttgttttgtcacataggaaagtatgaccatctttccatatatcatgagcatcccctcccaccagctgcaagttctccttccatcatgcatctactccttccctctgttctctttggttgacaccttcctttccattaataaacacgttcatctctctaccattcttagaaaaacaaccaaccaaaactcccttgaaactgtatgtcccctccttctactactacctttctctcctcctcctcccttcacagggatcctcaaaccatctgcattcactgaattcactcctcgctttttaatttcaattttttttagagagggggctctcgcctccttggcttccgcgttgtcaaaaccattggccacttcaggccccccacactgcctgccatttgacagcagggatccttccactattcctagctccttctagggtgtcttactgtactgtgaggggtaggaaacaaaaagctacattttgtggacactcttgaagttgggttatgcaaattaggttttcagaatctagaaagcagatgtgagacaggccatattttttgcagttttctttgttttctcctgggaaacaagatcattgaagacatgggatgttcgtgcatcagctttccactatccagtccccactttgtgggaatggaggacacagttgcagttatggtggccacagtactgtgttacaaaacccagctaagttctacaggtggctttacagtagcctgactgttacaggagtggtcgctcctttatggagttacttctgggtgttcagagagattttcctggaggcccaaatagaggtcatttttcagtgtaccgaatgatttttactacctatttgcctgtatcaaattccttttctgctggcttctatttcttgtactgaaccttcaccatttggtatcagaagtggctgtagccaataggcccttaaggatgacaatattcatttgctaaaagaaaataacggctgggagcggtggctcacacttttaatcccagcattttgggaggccgaggcgggtggatcacctgaggtcaagagtttgagaccagcctggccaacatggtgaaaccctgtctctactaaaatgacaaaaattagctgggcgtggtggtgtgcacctgtaatcccagctactcaggaggctgaggcagaattgcttgaacctgggagacagaggttgcagtgagccgagattgcatgactgcactccatcctgggcgatagagcaagaacctgtctcaaaaaaaaagaaaaaagatgaaagaaagaaagaagaaaggaaggaaggaaagaaagaaaagaaagaaagagaaagaaagaaagaaagaaagaaagaaaagaaaacaactacctgcctatcctttatgcccagaaagaaaaaaatctttcaagaacaaggacaaaataaagatattttcaagaaaaccaaaactgaaagttcttcacaagcagatattcagaaaattataaagaatatatatcaggcagaaggaaaaatggttccagatagaagttctgagacggaagtaggaataaagagcaaaataagttggtcattaaatgagagacatgtggaaggtggaagtcaaataaataccatcttcctgctgctttgactgtttccttctagcgagtaaggtataggagatggatacagtttctgaagtagtattccatgctcattcaccggcttcgttgggtgctgctgacaggcggctgtggtggttgggcaatggctttctaaccctgagtcataattaaagtgctgtgttcttgaatgcaatagttccagtgctggtctcctgagtcctcactttcctgatacgggacagaagtagtagctccattggtcagttttgcagtgttctaggagtcattcctggggattcagcctagagcttgatcacccaacccttccaaaggttttgtaagcagctaattccctatattaactcctttttgcataaaacatttagttgtttgcaaacaacaacagcaaaaacaatgcaagctgcttcaacaattcatcatgttgccaggtgtggtggtgcacccctgtagtcccagctccttgggaggcagaggcaggaggattgcttgaccccaggagttcaaggtcagcctggcaacacagcgagacccccatctcttaaaagaaaaagcaggaaacaattgatcatgtcacataaaaaaacaaccagacttggtactgccagggtcccttgccgcttctcaggtcagccttgatgctgcctttctctttgtgtggacataatcctcagttccagccatctcgtccagacatgacaaactgagaagtgtctgtatttttgaggctatctctttttaaaacaggtttattgaaatataattaatataccgtataattttaaagtgtacaattcaatggtttttggtatattcgtagacaggtgcaaccatcaccacagtcagttttacaaattttcatcactcaagaagaaccccatatcatttagttatcacctcccatccttgtccaccaccccagactctggaaaccactaatcttctttctgtctctatagaattccctatcctgaacttccatatgaatgaaatcgtaaggtctgtatggggaaaagaaagagagatcagactgttactgtgtctatgtagaaaaaggaagacataagaaactccattttgatctgtactaagaaaaattcttctgctttgaaatgctattaatctgtaaccctagccccaaccctgtgctcacagaaacatgcgctgtattgactcaaggttaatggatttagggctgtgcaggatgtgctttgttaacaatgtgtttgaaggcagtatgcttggtaaaggtcatcgccattctccagtcttgagtacccagggacacaatgcactgtggaaagccatggggacctctgcccaagaaagcctgggtgttgtccaggcttccccacactgagacagcctgagatgtggcctcgttggaagggaaagaccttacattatagtcccccagccggacacccataaaaggtctgtgctgaggaggattactgaaagaggaaggcctctttgcagttaagaggaaagcatctgtctcatgatcccctgggaatggaatgtcttggtgtaaaacctgatcgtacattctatttactgagataggagaaaaccgccctatggctggaggtgagacatgctggtggcaatactgatctttactgcacggcaatactgatctttactgcactgagatgtttatgtaaagttaaacataaatctagcctacgtgcacattcaggcatagcacctttccttaaacttatttatgacacagagtcttttgttcacatgttttcctgttgaccctctctccaccattaccctatagtcctgccacatccccctcactgagatagtagagataatgatcaataaatactgagggaattcagaaaccagtgccggtgcaggtcctcacttgctgagtgccggtcccctgggcccacttttcttcctctatgctttacctctgtgtcttatttcttttctcagtctctcgtctccaccttgcgagaaatacccacaggtgtggaggggcaggcccccttcagtctctggaggcctttgtggctggcttctttcacttagcagaatgttttcgtggttcgtccgtgttgtagcaggtatcactacgtccttactttttatggccaagtgatatcccattgtgtggatataccatattttgtgtgcccattcatccattgatgaacctctgagttgtttccatgttttggctattgtaaacagtgctactataaacttttgtgtacaagtttattcgtggacatatgtcttcatttctcttggtatatacgtaaagtccctgcatcctatggtaactttatgtttaatcatttggggaaacttccaggttgttttccaaagtggctgtatcattttacattcccaccagaaatgtatgacggttctaaccaacacttgttatctgacttttgggttccatccatctcagtgggtgtgaagtggtatctcattgtggttttgatttgcacctgcatttctctttaagatcaaggaaatcttttccagaagttcaccagcagactttctatcaagtgctgttgaacagaactgcatcaaatacaccttcccaaaccagtcactggcaagggaaatgagattactgatgaagactcacctcctgggttggagctggcactgtgggagcttaccctaacaacaggttctgttaggaaggaggaaggaggcagaggatcagctagctgtgtggctgctacacgtggcttccacgggctctcacagctttcctcctcctcaggccatttgttcttaggcttctcttcctctgtccaccccttaaatgtcaatgttcctggtcttcaatgtcctccatatacactcttttggatcatctcatttattctcatggtttccatttctacttgatgccttctgaaattgcttcttttctgagcttcggatttactgataataataaggaatagtataacaataataatagcactacctttttttatttgtttgcttttatttttatttttatttatttatttatttattttgagacggagtctcactctgtcgcccaggctggagtgcagtggtgcaatctcagctcactgcaagctccacctcccgggttcacgccattctcctacctcagcctcccaagtagctgggactacaggcgactgccaccaggccggctaattttttgcatttttagtagagacgaggtttcaccatgttagccaggatggtctcgatctcctgacctcgtgatccgcccacctcggcctcccaaagtgctgggattacaggcatgagccaccgtgcccggcctagcactaccatttttttttaatttttttgagatggagtcttgcttgtcgcctaggctaggtgcagtggcacgatcttggctcactgcaacctttgtctcccaggttcaagcgattcttctgcctcagcctcctaagtagctgggactacaggcacgcatcaccacgcctggctaatttttgtatttttagtagagatggggtttcaccatcttggccaggctggtctcaaactcctacctcatgacccacctgcctcggcctcccaaagtgctgggattacaggcgtgtgccaccgtgcccagtctagcactgccatttattagatacatattaccttccaggctttgtaccttatcttatttaattatgggaagtctataaccctatccttttttttgttttttaagacagggtctcactctgtcacccaggctggagcgcagtggcatgatctcagctcattgcaacctctgcctcccaggctctagcaatcctcccacctcagcctctatgaacctattcttatccctgtcttacacacaaatgaacaggctttttgcaaaaggtaacggaactactaagttggtggagctggaagatggacccggtctgtttgactccactgccctgctccactgcccgttaggcttctgtacctgcttcaaacacagggcagcccaaaagaactcatcaccttccctggaatgagccctgtccccatgctccctacagcaatgaggaaactaccatgtattagtgtcccacactcctggtaccaatttactgtgttaatctattctcacactgctataaagaactgcccaagactgggcaatttctaaataaaagaggtttcattgactcacagttctacattgctggggaagtttcaggaaacttacagtcatagcggaaggggaagcaggcacctcttcacaaggtggcaagagagagtgtgagtggaggaaatgacggacgcttatggaaccatcagatctcatgagaactccctaactatccgaagaacagcgtgggggaaaccaccccatgatccgatcctctcccaccgggtctttccctcaacacttggggattacaattcaagatgagattggggcggggacacaaaagcctaaccatgtcataccatttgcccaatttagtccagaatcccacgggctatctccctcctcctttgtccctgcactacgtaatgccaacgttgcttgctaattattccttgaacccagctcttgttcctcattctccactgtcattgtctgagtccaggtatgctgtgactggtgtgcatgtacctgggatttcttagccttaggggtggctggctgtgcagaatctttggatggctggaggccctgggttggttgtttctgtttgcaaacagccccctcctttgttaaccagtgtgtcatataacagcaatcattttctgtggatgaataatgagggagatggtaagaagcatgacctggagtagactgcaccgccatccgcctctccactttccctctctcactgcatccttccttctgactgcggcagagacaggccgaatcactcccctgtgagaaacctctggatggggggccatcccctcaccaccctgaggaccaggtccacattccttactgtggctgacaaggccctccatagcttccagtgtccccttcccgcctccactcctgtgttcgtgagtagaattcggtgctccagaaacatcacgcctttctgcagccctctcctctattccgtgctgtttctcaccccagcttcttggctcacacggtttcacttacccaatacgctaataacatggaggttaagaccagcggtggcatcaggtaacccggttcaagtcgttgctctctgtcacttgttcatggtgaaagcactcaatctctctgaaccccaatttatacctcagctttaaaacaagtacctatctcagggctgttgtgaagatgaaatgaagaaaatatgcagacataagtggttgctttctttatccatcttgcttaactgccctaacccccaagaagtcttccctaaccctccttctgaaggaccctgtgcaaaactctgcaggcgccatgcgctgactgttgtctgattatttctctgccctgcttggctgaggtctcccaggcatggagtccctttgagattcatctccagcctgggtgggcccactggggcccatctgtcaaggacagagcaggaggtcctccggagaaggtgacaacgtagtggggcatcgaccataacaaatgcgggagctccagggaacgacccccgcccgctggcgtctctccagtctgagaccccactggaggagctgtccatgtggctgcctctcgccttttatcccaggggacagagccaacgccaagcatggcaaccacccaccttaacctaatcaggatgcagcctgctcattaattcattcattcattcagagggatctgtccgggtgcgggtccagcacgggtccaaatcctgcatctccagtagcctcctgggggtcggtcgtcgggagggctcgtgagcggaaggctttaggatgaagcgacagggcccagagtcgtggagattggactggggggcaggggagcaggcattgacaaccacgccgacaggggcatcccgcgcgcctgtgtgggagaatgtgtagggcaagcagcagggagagaccatctcagagacaggggaacagccaagcagaaaccactgtgctgggcgcggggggaggccgggaaagacagcacatctgcggggcgggaggaggggagggaagggagtagaaacactgctcccgccagccgcgggtgatggggacacgtgtccagctcgctgagtccgagggcctgggcccgctttgggtgccctgtttctccggcgcccaggtgtgtgcgcagaaccgtgtctgctccagggacagccgtgaacgagcgccgtccggagtggcagggccatcaggtgtggctcattccaagaaaggtccgtaccttcacatgtaaacttcctggcaaagctgctgggttgccgcttatgggagaaggcggcgggcccaaggttcggcccctttgtctgaatctggcatttggagcaggctttaagacttcgggaaaagccgggcccctgtgcaaccaccaaaggctgcttctcccgccctcaggactaagatcttgttccagtcctccagtcctcggggtctactccaggggtacaaggtgagagtggctctccagagtccatttgccttttggtgccgcactgcatcctcactttgaccctgagcgctgcagtaagccctgcagggtgctccaccttgaagcacgggaagatctgatgctggccgccttcttccttcggttgcctgaaagggcccgtgtttatccttcgcttcacagagaacgcaacacacaacattaaacacacatagagagtgaaagagaacaaggcatcttcatcaaggagggcgcaccatttaaccacccgcgaccttgcagtgcgcctctgcaaagtggggactccgctctgtagcaggagatgggggtgttgacgattttgaaagtagttctcagttttccgaggcaaaggtgtctggggctgacgaatgacttttgagaagaaggaatgatgagaaatgtcctcattacagaactttcccggccacactgtgagtcccacgcaaagaccccatgaccaccaaccggagcgctgggtgctccctggcagggtcacctttgctttttgcgcgcccccatgccacccctggggcaggaggccatcctcttatcctgggagtgcaggcctggcccgaagtgcagcccccgaggccgggagccgagattcttctcggcttcgtgctcagagctttgcagcgtggcatggtttcctcctcttgccctgttgctgtttcataccagggggaactgagacccagtcgggttatgggcctccctgagaacactggcctctagcagaagcagattcaaccccaggcctcaacctgcgcccagacccgtgccctggagtggagtttacccactgccgcccttcctgggcaaatgtcaccgctgcctccgtccccctaggtccggggcgggtcagtgcttcgagccagcggaccccggcctagggacaggtgcctgcgagaatgcggggggcggcccccagctcccctgccctcctccctagaggctgggcctgctggtctcccggctgcgcgcaaggtgggaacgcggccgacttggtccgctcgccctccccgcacccgctcctctggagccgctggggctgcgcaccgactcacccgcgcggcctccgggctgcgccttcagcgctggcggcgtcctgcccggcgagggccagggtcccaggaggccccggaggcggcgggaccgcagggcggaggggaggccgtgggagcggccgggcgcgcctcagcagcgcggagact

SEQ ID NO: 589 - DNA, 70438 bp, Homo sapiens
attaaggtagttcatctaaaacttcagtgtcactgcccactgctgtcgtggctgcttgctcagatgaggttttttggggccaactgattcctaacaaatttgagagcttctgtagcagtgtatctattagtgcagcttctttctgagtattgaagacaaaaagagaaaagtgagaaaattgaaattactgctaatagtggagtaaaaaaagtaccaaagatttttaaaaaattagtaaatgtaaagatactatttctttaataatttgcagtcaggcattggagtgtttccactaatggttgcgagccaactatttataggacaatggctatagaatattatgtagtcttataaattgggtttcctaggaagatagctggcagagcttttgaaactaataaagggaatatgatactgtgcattataaattatgtcagcccgtcatcttaggggcagttacagtggagctttcccagtgatataacagcatgctagtttatcttttagttacctaccttaagcgactttctttcttttccaaaggccatgagaatggccgaaacgaaaagattaattaccacaagtaccatcaagatgacactggtgaggatcagaaaggtgcccaggactgggtctaaagcgaaaacctgggaaaacaataagaacacttgcagtgactgacaatttagtttatactttacaaacataagctatatgctagtgtttgggatcttatcagaagaaaagcttatccgaaggaaacttagggagagagtcaaaagataataagaaggaaaatacttttaaatggacagaagagcaggaatgactcattttaaggaggttaagataattgtgactgcagggctttcacaagaaaacaggtgagttgcagtggaattggaaatgattcaaatgtcacatgagttttggcaaaaaatacatctaatcatggaagctaaaagtgggaggggggtaagcaaacactgaaagattaaatgcataccagaaatgagaatgcacactgtctctgccatatcaagaaactacaaccctaaacacaggagcattccaataaaagttaacaggttggccacagaaaactggctttttagtatttttttttttccattgtcatttttaaaggtacaagcattgagttctgccattctttacttttctgcatacataaatatcaagttctgggcttattggaatggttcccataacaaaaactgttgtttaaaatttagatgttctttttcaacaaatggtatttattttcccttggtattggcccattcattgttgccactagggcactgtttaaaaatatcccaacagaggggttgattacagtcaatgccaccctgatggaaatctatatggcaaaatattttcaagcaccaaactgttttacctacttaaaaatgattattataacaatttcaggtcaaccagataatgtgggcaatctctgagtttgtgatacaagacttatttccaataagtttatttttatgtacaattttactgtttattttttgtttgctctatttgttttttaatgttttttactttatgtttactgtatttttatgtacaattacatccaaagcagaaaagttccttttttatccccaaaaggaggtgtcagcaaaaatttgttactctgattacttccttcacagctttaggatacgaagtgctgcagtggcaaaggctcatcccctagttattggagctagaaccacaacagaacacagcctagtcagccaaaacagcagttacagttgtcccttagtatctgagagagattggcgccagggcccccacaggtaccaaaatctgaggatgcttaagtcccttatttttattttttaattgcaagcttccctaaaggttaagaaagtgtcttctcccccactttttttttttttttttttttttgaaatggtcttgctctcaccccggctggagtgcagtggcgtgatcttggctcactgcaacctccacctcccaggttcaagcgattctcctcagtcagtctcctgagtggctgggattacaggttcccaccaccatgcctggctaatttttgtattttagtagagacgggattttaccatgttggccaggctggtcttgaactcctgacctcaagtgatcagccccaccttggccttctagagtgctgggattacaggcgtgagctactgtgcccggctcaaagtccctttttaaaaatggcacagtatttgcataaaccctatatacatctctcttatacttgaaataaactttagattacctctagtactttatagtggaactgctacgtaaaatagttgttacaccggtttgtggttttttgtgggagacagtctcgctcagagggcagtgggatgatcatagctcattgcatcctcactcctgagctcaagcaatcttttcactttggcctcctaagtaacaggaactacaggtacatgctaccatgcctgactcttctactgtattttaaaatgtgtgttatattttattgttacctttcaaatattttcattctgggattggttgaatctgtggatgcagaccctgcagatacaacattagaaactgaacctacccattttaattagtaattttggaattctagatcattagaatgatcaaccatgatcaaaatcttgccagtttcactgcttaaatggcaggtttttccttgcttggtcatatctaccctttacataccagggtttggagcccagtgcctcatttgggtttcctactttatatgttgaggaggaaggcagggatttctgttggtagttcctgggaggaaataataggctctctgaagtgagtagttattaactcaacagaaataacgcagtttctcttagaactgtaccttcctaattctttgtcacttccattatgtcacttttttttttgagacagtttcactgtcttgcccaggctggagtgcagtggcacaatctcagctcactgcaacctccgcctgccaggttaaggcaattctcctgcatcaacctcctgaggagctgggattacaggtgtgcaccaccacgcctggctaggctaatttttgtgtttttattagagatggggtttcaccatgttggccaggctggtcttgaactcctgacctcaaaagtgatccgctggcttcggcttcccaaagtattaggattataggcatgagccaccgcacctggcctttttttttttttttttttttttttaatttaaatagacatagggtctggagtgtagtggcatgatcatggcttattgcagcttccaactcctgggctcacaggattctctctcctcagcctccagcctcctgagtggctaggactacaggtgcatgccaccacacctggctaatttttattttttatttttagtagagacaaagtctctatgttgcccaggctggtctcaaattcttggcctcaagcagtcctccccttcttggcctctcatggcttgaaccaacttaccctaccctgttaatgcactttcaaggggccattgagaagcagagaatcttgttaatctggccaagcacaagagcacaagcttcggctcagtgtcctttgccaataagattaaggacacaagaagtgaggaaggagggactgagtgcttaggaaagggcaggtttctgaaagcaacagccatgtaaatgctgtatgcataggcagtaccataaagcagtagagcaaaggactgaaattttcccccttttccagtgtgcagtgtacagtagggggctgttttcataaggacccccccaattttccttgttcaatatattgaattctgtgaggaaacaaattattatttttacctcctcttggtgagaaattcccatcaggagaccaacaacagtcactgctgagctgaaaaatgtccggtagtcagagatgctgcatccaaacagcaggttaaactgaacagaaggagaaaggccagttagtgcaagccgagcgcacatctttctatcctgaggtgcttggggatgtggccaacatagaagcaatggaacagaaattccttgtggccaaattatgcccaaagaatacataaacttcctttgtaataacatagtgttttcatagaagtttatttgacctttatattaccgtgtgagctaagttttatccccattttagagaaaaatatgtgggtttaagtcataccagttaagtgtggaactagatctaaacccggctttcctactgtaccacctcgggtttctgtgttgtgaccatttctatgggaagcgatgcgattccaagaccacagcacacggagaaggagagacagcaacgtgggggcttacggcaatggcatagcctgtcagcaggattaggatgatcagcagaaagcccaccacctcgtcccaggctcggctcagtgtcctgctgatgacccgcagcctggggctatgacgcagcaggttccataactgaacagttgccaggagaaccgggaagcccacaaggtgagtcgcagcagagttcacttttactgcctcatagaagctgatgaatctgcaccaaggaaagctgacagttactcagcaagaagtatgtgcctatactgcagtttccccagcgcccctgctgctgatcgtggcagccctgagtcctgtgaggtcaaatgcttgttgatgtgagaactgctttctattgtggcctcctgtgagttgtggatatgggagtaacagaaggccacatactattcaagtgatctacctgctgcagattgcactgggagctgtgccgaagaagccttaaaatgtgacctctagctgatttctttattccaaattcatcctgggaagcaaaaccagcctcctgcactgctctgagccaaatctctcctctcaaaaggagattaactcagcccagagagaggagccatgctgctggtctgttttctgtggcacactaatcctgtgttctctggcagtacaggattgctgtaataggtgcaatcaagcttagaacaaaatgatgggtggtagactagaggcgaggggtgttgcttagcaattaggttttgttttgagagagagacattcataattttaggttgcagcaaccaggttacttggaaggagccccacagacactagcaagtggcactctgcacagatccgctgtcactgcataaactgctctccataaggcctacttgaaacaatgcctcaggaaaagttacacagatcaccacccaggctgttggccactgatgcaaaggttagcaaagcaccacttggcaacacttggcatgggaaacatagatgttcctctccatgggaaaaaccagagaaggtgcccaaagaggcaccaaaaatctcttagtatggatgagtgaatagatgaacatccctacccagaaagcagctccctttgcatttaaaggatgggactatgtgttgtggttttatttaaaggattatttgtcgtgcgttaggctttatgccttcgccagagggcaaaataatgaccaattccaggcccttctgaaatttaaatgcattatccttaagcacatacctaagcactaatgaaggcagaagagctcttcaatgtgactagcagttaaatggcttctagttcactgtcttctctgctgtggacatgagtccaagttctcttttaactctaatgttatgcaaatacagatctggtaggggagtttgaagaatacttgtgtataaacaggaaactttagacatgaggtaggaatatgctgtgcccctcaggcttcctctcacctgtcctggtcatcgcggtatcgtgccatgtttttcttatgtagagaaatactcttcatgtcaagccccaggaggatgaagctaatgaggattatacttgtgtccagaatgtttcttttcccagtgaagaacctccacttctgctgtttcagctgacaaccctaaacatagacagcacagtcactgttgcttgtctgagagattagctaggtctctccctgctcaagtgtgatgaacgcagctgatgtctgtgggcaaagcacactgccaggcatttatcagatctcacttggacaaatgggttatggtcttagttcaggtctgtagtcttcagaaatgctgcttacaaaaaagttatcttcaaacaacttccattggatacatttattctttttcttggagatcataaactgtcacttaaaaatcaataatacaaaagtttctttctttgagacagggtcgcgctctgttgcccaggctggagtgcagtggtgcgatcatagctcactgcagcctcaacctcccaggctcaggctcaagcagtcctcctacctcagcctcccaagtagcagggaccacgagcacatgccaccatgcccggctaagttttgtattttttgtagagacagggttttgacattttgcccaggctagtcttgaactcctggcttcaagtgatctgcctacctcagcctcccaaggtgctgggattacaggcgtgagccaccatgcccagcaaaaatttctaaattagttatcaagcctgagaatgaaaaaaaaaatactatgtttggcttaagatataaatatattttcttctgagtgtaatcatctgtatttttttttcttttctttttttttttttgagacagagtttcactcttgtcacccaggctggagtgtagtggtgccatcttggctcactgcaacctctgcctcccaggttcaagcaattctgccccagtctcccgagtagctgggactataggagcccgccaccatgcccagctgatttttgtatttttagtagagacagggtttcgccatgttggccaggctggtcttgaactcctgacctcaggtgatcaacccatcttggcctcccaaaatgttgggattacaggcgtgagccactgtgcctggccaatcacttttttttttctttttttttttttttttgagatgcagtttcactcttgttgcccaagctgaagtgcaagggcgcgatctcggctcactgcaacctccgcctcccgagcagctgggattacaggcatatgccaccacgcccggctaaatttgtatttttagtagagacggcatttctctatgttggccaggctggtctcgaactccctcaggtaatccgcctgcctcggcctcctaaagtgcttgaactacaggcatgagccaatcatttgtatttttgagtgcttgctctttgttcatcatacttgcttggtattacttcatatagggctaataaaactacaaaagtactatttctatagacttaattctttagctcctgaaaaattgaaagagccaatctatttggtggaaaaccagtcagcctttaactgaattcaggtttctgaaaaggaccaaaattatagccataattctagtaacatgtcattgtagagcttcccaaataaaatgtggcaacctttatttctcacatctaacaccatcatcatcatcatcattatttttgagacagggtcttgctctgtcgcccaggctgaagtgcagtggcgtgatcttagctcactgcaacctctgcctcccaggctcaagcaattctcacatctcagcctcccgagtagctgggaccacaggtgcatgccaccacacctgggtaatttttgtagtctggtaaagatgaggttttgccatgttgcccaggctgacatctaacattattgactcacctgtatgaaggcatagtaacagaccagtagataatagatgacttgtgagatgatagaccagacacagcccttctttgacatctgaagggaagtgaagctttccagtctcaaagaggtgaagaaagcacctgagaataacaaagaacacctggagtcaagagtctaaaacttttgccctcttcttgttaaactttgtctttgaataaccccaactcttcctgtatcatcaaatgtttctgagtctcagtgctccacttagtatttcctttagagctgtcatgaacattaaaggagatcatgtatgcaaagctattggagaaatactggttttacaaaagtcagtagtgggaaaggatatgctgttgaccctaccttgaagggaggtgtcggtggcttaacagttattatagatgttaccctatccatgtcagagtggctgcagagagaggtctaaagcactgataccccacgagtactaacggtatcccatggatactcagtcatttacataaggatggactaaaaggcttcagcctccacctggaaggacattgaaaatgttgacgtttataaaatcatgaaaggtcttgtgaatacaaacctttcacaaagcttcaaaatattagtgatggcagcagcaccctgtctggagtggctgctgccatgacatcggctgcagtgggaggcatggccggggctttgtgcgctgttgagctgcgggagccagtaacaggtgggagccctgcccccttctgagttggagggttgggagccccacactcctgggcagagctgcagctgcccagccacagctgcagacctgggcatccctgcactcgggggctcaggaaacccccctgcccctgcaggttcagaagtgcctgctcccactgcatggcctctccccactcccagcacctgctctgattttggagcaaagttttggccaagcctgggtgtgtgtgcgcttggggcagtgctgacaagcagccccctactgcctcggccttctccgaactttggacacggacaagcatgtgaggcagggagggtaagggggggctgagggtggcttgccatgggcccgcaggtgccccttggcacaaacagcctgggcaccatgggtgacatggatggcagcaggaggcagacaggctcctgggcagaaaggggcaggtccccagtaaagccccacctttaaagccagggatcatttgaagcctgggggctgggctgccagttctggaacctgccagtttcactaactcaattgagaacttatggcgcttcttctgggcccacccatggctgcccatggaccaataagcacacacttactcccctctgaagcccataaaaacaccagactcagccagacttgggcagatggcaggatgacctgcctgcagataggagctacccactccagatctctctgctgagggctacacaaacaatgggacgacctgcctgtggataggagctaccaactccaggtttcctgaaaactgtcttgtcactcaatgaagctcctctccacctctctcaccctccagttgtcagtgtacctcattcttcctggatgcaggacaagaactcgggacccgctgagtggtgggactgaaagagctgtaacacaaacagggctgaaacacacccccttgcttgccacactgcaagcaatgagaaggacagaatagctgtggccctttgggggagcccagacctacaggctccctgagccagggctgtgacaccctctttggggctctgtgcttctggcatctcgaagattctaggcaccatggcattcctcagatgcagttacccacagcagaaaccacatgcagtacatctggtccagcttcagtctttcagggagccggcacctgtgccagcacatagagctgcccaactcactgcagcagccagcgtgcctggctgtgtgcaatggctggaccccgtgcttgctcatccatacatacctcactgctctgtacctggctgtctcttggcaggtgtgggatccaggccagtagcaggagctgagtacaggctaccaggccaattcggcagaacgagcacagtggctgcaagcaatactcaggcagaaggtgctgccggccacagaggtttctggctggcaaagcaacaccctaaggatgctgtgacattagaactaagatgtaccccttgtaggtaaaaaagacatttaagaacaaaaggaatttctatttcacctagctagctctcaagactggaacttttcccatgtttattttaatccctgtctatattttgttagtaactaaaaaccccatgaagacccttaggaagcctttgtgcttcattagaaacaagcataagagaagtggtctactctctgcaggtctgagagaagaattcttgattaggagaaagatgtgatggaaaatggaaggatacttgtgagccaattctgggagaagaaagagaagttggattaggatagatgtcctgtgaaaggtgggggaactgaatggaccagtttaactccaatcccttacaaaatgccactataatgaaagtgacaggataaagtaaaaacttcaatagatgaagaaaaggagggcagatgagagcaacaaactgctggaagctgaaaagtagaggaatcacattgacttagcaagttcaagaaagctgaaatctaaggcagctgtacaggaaacccggaagcaagctaattctaaccaagaaaccttggaaagcctcagaaattgcaggcatcaggtacttctgaaggtagaagttcaggtggaactgaaaatagcatcaactgaaagtcaatatatatataaacaacaactagattccaaatttcctccctcaccattcacaaccaggtatttgctacctatcttgccttctaccaccccatgactaaaggtttgtttcccagtgatgctgtatgagagaatctggacttgggggcaccagctacctctgagagtaatggtttactggaaaaggggattaagggaaagtttacgtgctgcatggtgagacacttcccagatcccttccctcaacttgctctgataagtataataggctcatatactcaagattggagtttgtagggtctctaaaaactgactgcccaaaaagagagacttagatacccagttgataagctctatgcatgggcacagagctttgttttttattttttttttatttttttgagatggagtctcactctgtcccccaggctggagtgcagtggcacgatctcagctcactgcaacctccgcctcctgggttcaagcaattctcctgtctcagcctcctgagtagctgggattacaggcatgtgccaccatgcctggctaatttttgtatttttagtagatatggggttttgccaagttagccaggctagtctcaaactcctgacttcaggtcatctgcctgcctcggcctcccaaagtgctgggattacaggtgtgagctaccatgcccagccaggcacagagcttataattagcatttatttgctttttattgccttttttttttcttgatacagggtctggctctcacccaggctggagtgcactggtatgatctcagctcactacaacctttgattcccaggatcaaaccattctgccacctcagcctcccaagtagctgagacaacatgtgcacaccaccatgccaggctaatttttgtatttttggtagagacgaggtttcacaccatgttgcccaggctggtctcgaactcctgggctcaagtgatcttcctgccttggcctcccaaagtgctgggattataggcttgagacaccgcacccagcctgcctttctttaaaaggacagccaggcacttgaacctctaatgctgaaaactgtagatcaaaacaaacaacaaatcaaaaaactagagacagtaaaggatcagaaggaaaaaaaccaccataatatcctcagagttaagaggatattgcatccgtaaaagaacaataagagactatgaaaaaaacaatttggaaattaaatattatagaaagaaaaaatagtttagaagataaaaattaaatactgcagatattagatgaaaaagatggaaaacagaagcaaaaatataagaaaatcagaactccaggagttacaatgtcaaaatgctagaaaatcagaaaaagtgaacagaaaaaatggagaagaaattaaccaaaaaaatgcaagaaaattcctcagaacttaaggtcacgtttccagatgatagaacattctatgacattctttttttttttttttttttttgagatggagtctcgctctgtcacccaggctggagagcagtggcaccgtctcagctcactgcaacctccacctcctgggttcaagcgattcttctgcttcagcctcccgaatagttgggactgcaggcgcgagccaccatgcctgggtaatttttgtatttttagtagagacggggtgtcaccatattggccaggctggtctcgaactcctagaccttgtgatccacctgcctcggcctcccaaagtgctgggattacaggcatgagccaccgtgcccgacctctatgacattctttcataactcagaggacaaagaaaaaaacctaaaaacttttggggttggggactgggaatcagcatgccagcataatactttttaacactaacatgaaaagctagaaagcaatggagctacacttttcaaaattctggctgggcacggtggctcatacctgtaatcccagcactttcggaggccaaggtggtcagttcacttgaggtcaggagttcaagaccagcctggcaaacatggcgaaaccccataaaatatgtaaatacataaattgtaaaaataaaaaaatcagccaggcatggtggcgggcacctgtaatcccagttacttgggaggctcaggcagggagaactgcttgaacccaggaggcagagggtacagagagccaagatggtgccactgcactccagcctgggcgacagagcaagactccgtctcaaacaaacgaaccaaaatcctgcaagaaagaaattatatacagataaattagaatctaatgtgatgggagaataaaaacacttttggagatgtaagtctccaacaaatttacctctcttgtactcttccaggaagttaccttcaatgaaaccacattcctggttttgcacttattgaacagccttctttgctacgtgtggttgaattccaggggtcactccagttacctctcatgatgtaactgaatccattctcattcttgcttgtcagcctttcgtgaagctcatcagtgggaatcagcaccatgggcctgggtgaacagatgtaactgaacctccttagatgaagtccagggaataggctcttgggacgcccacaggtatggccgttatcacaaaacgccagctgaccttcgtccactttctcataggtcttggtacggggtatttggaaaattaattgtaccccacatttgcaatgactgggctccaggactgcattcttacctctgtaatccccatacaggctaggaagaaggatatgattggcccaggggtagaaatcctgaagaagtttgatttccgagaactggtgcgaaaatgtcttccagatagcttggtggaggtaaaatctattggagttctttgcagagtagattgcagtcatcaacagggtaaggaagaggatttgtacttgtttagaagaggaaaaaaatgtcatagttgagtggttaacttagaaatcctctatgtctttttcatttttcctaagtctatagacttatgcaggtcaaaaccagtcaaaaactggctgtttcatatggttcaatctaataattataaatacatacatacacatttccttcccagaattattctgccactaatgatacattttacttaaaataagatacaatggctgtggctgggcacagtggctcacacctgtaatcctagcactttgggaagctgagacgggcagatcacctgaggtcaggagttcgagaccagcctgaccaacatagtaaaacccccccatctactagaaatacaaaaattagctgggcgtggtggtctgtgcctgtaatcccagctaaccaggaggccgaggtaggagaatcgctagaacccaggaggcacaggatgcagtgagctgacattgcaccactgcactccagcctgggcaacaaagtgagactccgtctcaaaaaaaaaaaaaaaaaaaaacataaaatcccgcacaagaaatatggtgtttagctctaaggactaagcatgcactctgtctctcatgtgattgtgtttacaagaagtgaagtcatgataaaagcagaatttgtcttatttggactagggaatccaataatgaactagatgtgttgaagccagtcaactggcacctacagaagagccatctgccaaagcattttcattttccctccatagatcaagtgttattacattttgcaggtggagaaagtgacttactcaagcacacaataaaacctctagactccaaggtcagggatctgtccagttaccatcccacctgctttactggaatcccaaatctcacagggtgaagattttaaaagacagctttttaacccttctttattttccattttattctctctcttcctttcccttctggaaaaggtgctgtgttatcagtatgttgccatttcctctccatacccaaaatatctccagtcagcttgaagagtttcttctttttcaaggttctttctgggtgcttagttggactatttatagctggggctacatagacggggttgttcttatctcttgaacctggtactgacgaagaacattttgctgtcaaaaattcaaatatagaccaaagaaatgttatatttcattaagcagtcactcaccattcattgagcatctactgtgagcacctccttttaaatgttaaacaaggaataaaactacctatgcagtgcttcttaaactctctattataaaggacctgttttttaaaaaattccaatcaattggggactgatacttttgtacaatacagtaaaaatgagttactaggctgaacacagcggctcatgcctgtaattccaattctagcactttgggaggccaaggcagcaggatcacttgaggccaggagttgaccagcctggtcaacatagtgagacgttgtctctacaaaaaaataaaaaattagccaggcatagtggctcatgcctgtggtcccggctactagggagactgaggtgagaggactgattaagcccaggagtttgatgttgtactgagactagcagatagtttgagctcaggagtttgagaccagcctgggcaacatagcaagaccatatctgttttttgtttgttttttttttttgagacggagtctcacttcgttgtcgaggctggagtgcaatgcatgatcttggctcactgcagtctccacctcccagattcaagcgattctcttgcctcaacctcctgagtagctgggattacaggcacatgccaccacacctggctaatttttgtattttcagtagagacagggttttgccatgttgcccaggctgatctcgaactcctacctcaggcgatcaacccgagaccctgtctcttaaaaaaaaattaaaacatatattaaaaaaagaaaaaaataaagcagaagcatgcaaaatacaagccctgtttttgataattagatttagtacatataaagttaatctgccaaattgttaaagtttttaaatgctcattcctgattcctgtacttagactagaaacaaactgttctagtcagtggatcacactttgggagcactgttctatagtggtattctcagattttaatgtgcataggaatcatctgggaattttattaaaatatggattctggagtgaggcctaagattctgaatttcttaactatatatatatatatatatatatatatatatatatatatacacacacacacacacatatatacacacacacacacatatatttatatatgtatttatatacacacacgcacacacacatatatatatatatatttatttatttatttatttatttatttatatatgtattgggaggccaaggaggactgatcacctgagctgaggagttcaagaccagcctggccaatatgggaaaaacttgtctctactaaaaataaaaagttatccaggcgtggtggagtgcacctgtaatcacagctactcgggaggctgacacaggagaactgcttgaatctgggaggcagaggttgcagtgagccgagattgtgccactgcactccaacctgggcgacagagcaagactccatctcataaataaataaataaaaataaaaataactagaggagggcatgaaacttgccagcatgtgtgttccaagcaccatgggatcagtgaagagtgagcaaataaatctctccaagaaagtcagagaaggcgccacagaggaagtgacatttgacatttgttttgaaggatgaatcagagctctccagatgaacaagggtgatgataaggggaaaaaagtctcttttaggcagagaaaccaacagttcagaatgcacagagaaacaaaataagtgcaaggaaggcaatttattattatttttgagacgaagttccgctcttgtcacccaggctggagtacgatggcacgatcttggctcactgcaacctccgcctcccaggttcaagcgattctcctgcctcagcctcccacgtagctgggattacaggcatgcaccaccacacccagctaattttgtatttttagtagagacagggtttcaccatgttggccaggctggtcacaaatggaaggcagtttaaagtcagattaagttttttcatctcacaaggaatggagtgcctactgcttagcagtagatcaccacttaagaataagtgactgccaacataaagtgtgctgtgtacccctctgtgatggcattccttctttccctcacaggtagtcctttcctgaattctggagtttatcattcccatgcatttctttatactttatctataaatgcatagaggagatacatatataacctcttgtcaagacatgcatcgtttttacatgattaagatattgtgccaatttttctgcaacctcttgttttgcccaagattgtgtttgtgaggttcatccaggtgataagttagccctagtcagttagagggtaggccagttagccttagccagttagagggtaggcactctccagcatggtgactaaatgtggaaactaacagaggaatttaggattatgtactccgactttttcagagaatgctgatgctcttgactgaaatgagaaaatatagtaaagaagtggatttgtggggcaggcaaacaattcagtttaatttgacatacttggaggcatctagctccagatagggagcagtggagaacagcacctggggctcatgagagagggggaggaggagggagaaggggatgagggagagaaggagagagggagagagagagggagagagagagggagagagagagggagagagggagggggagagagagagagagaaagggagagagagagggagagagagatgaaaaagatctaaaatgtaggggagtccgggggcggtggctcacgcctgtaatcccagcacttgggaggccgaggagagtggatcacctgaggtcaggagttcaagaccagcctggccaacatggcaaaaccctgtctctactaatactacaaaaaaattagccaggcatggtggcagaggcctgtaatcccagctactcggaggctgagacaggagaatcgcttgaacccaggaggtggaggttgtagtgagctgagaacacatcattgcactccagccttgacaacaagagtgaaactccgtctcaaaaaaataaaattaaataaaatgcaggggagagatgaagcactgggagagaggatgtgatgactgaggtgaagatcctcatctggaagggcattagtcttgggcagaaaaggagaaataaccagttggttagagacaagtcctttgaatgggttaatttatcgagtcagcaaggtggccagatctaatttgctttttgcaaaattaggtagttgttagaactacttgagttacccaagagtgccaagatcctctttgttgttcattctctttgttaagccgtggcatcctgctcatcatcagtgagtataagaatgtgaagaagaccacctgggcaggagaatcacagaacatcgtgagcagacattacagacccaggaagataataccgtatgtaaaggaagaggtgggcactcatgaaaaacttcaattatttggctcttcattttaatgaaaaactaatttcacattaatttttgcacaatgatgggtaccaggagaaggaccatcagactctaaataatgctaatattcatattttttgcttatagttcttaatctggttggctgggggagcttacactgtcaaacgatttgtgttgtctattcaataacatctctcagtatctttggaaaacctctgataaagatccagactcttttttttttttttgagacggagtctcgctctgtcacccaggctggaatgcagtggcgcaatctcggctcactgcaacctccgcttcctgggttcaagcgattctcttccttcagcctcccgagtagctgggactacaggtgcataccacacccagtttattttattattattttttttgagacagagtcttgttctgttgcccaggctggagtacaacggcacgatcttggctcagtgcaacctctgcctcccgggttcaagtgattctccctgcctcagcctcctgagtagctgggattacaggcactcaccactatacctggctaatttttatatttttagtagagacacggtttcgccatgttggccaggctggtctcaaactcctgacctcaggtaatccgcctgcctcggcctcccaaagtgctgggtttacaggcgtgagcccccacagctggcctgggatttttgtattcttaatagagacagggtttcactgtgttgaccaggttggtcttgaactcccaacctcaagtgatctgcccaccttggcctcccaaagtgctaggattacaggcatgagccactgcgcccagccactatggattttcttgagatggatccttagatgtgaaacctctctagcaaaaggtgcagaagttgcaggttgtcactacatattgccagattttccttaacgagcactggctgttcatttccttggcattactgtgtattattatttttctttgccattattaaaacaaaaatgcaatattatcattttattggactagtgaaactgaatttcttacatgtgttttggccactgcaattacaggttttgctttaaaaaatttatatcttaacttacatatagtaaaaaaaaaaaaaaaaaaaaaagtcactttttggtgtgtaattccatgagtgttgtttaatacttagagttgtatatccaccactacagtcaagataccaagtagtttcatcacccccaaaattccctcaggctgtccctttgtatttatatttattttccatatctaaaagatacagaacagtctgtatcttttagaaatataaagtctgaagtacatgaaatggataaaatgatatgaagtctgatattgttccccccaaataatagatgaaacaaattggccatgagttggttattgttgaagctgggtggtacgactttagaatgcattgtactagtctctacacttttgtgtgggtttgacatttttcttaattaaaaacattttaagttttttgttgtttatttttttcaaagtgctttgggttgttgatttgttactgtcctcttcactcctcaatccttttctgccatacttcttagttttttctgtcatgaattacacttatccctaacaaatgtcagttaaatgtcagtttgcttttttttttttttttttagttttgagacagggtctcactctgtcacctaggctggagtacagtggcgcaatcacggcttactgcagcctcgacctcctgggccaagcaatcctcccaccttagactcctaagtagctggaactataggagcacaccaccatgcctggctaattttttctaatttttgtagacatggagtttcatcatgttgcccaggctggtctcgaacacctggactcaagcaatctgcctgccttggcctcccaaattgctgggattacatgtgtgagccactacacccagcctggtttgcctatttgttttttgttgtttatgttacattgtcaaaaccactaggcaccttggattgacacccagggacctcagttcccctaacttctgcaactccaatggttcttcccatccctcacatacctttactggctggctgatgaagatgttctgaagcactgataaaataattgaaatcatccagctggtggcttggtctttgctcaattccaagctataaagtgctgtaaaaaaggctgaagccaggctagtgaaacctaagaggagccagcagactgaagtcaaccatttggacaggccatttgagatgggcttttttccttcttctgagctcaggatggcaaaactggtgacttccctgaagcacaaaagttgagggaataatcttgtatgcatcggctgagatagaggatgaggaagattacaggggataaagaaggcttggtgtggtgcattacctggatggctcttgctccgtgggaagaatatgtgtttccaagagttcctggagtttttgaagttggctggctgcatctaggaagtcacaggactggtgaccctgggtgagacccagcgtgcctaagtgagatttcagcctctgcagaactctatgcaggtaacagcagaaatgatggtggttttcaggaacaactgaaaatatatttcaagttgacactttcacaagtggatttcaataagaagcaattagtggtagagattaacaattcattgatggatgatgaggctatattttcccactactagcagagattggaccgtaccccacatttgcagtactaccatcttctctaaggatgctggtgaatttttaacaattgtaaaattctaagctttgatctaaagacttttaaaaccttattgagttcttcaccagaatggcagtacatgtgacctatactagtaagtgcccaggagactcaaacagtatttgagaatccataaattccataatctcatcatctcataaaagaaaaaggatgacaagtttcaacagcctttgacaaagcagaaaggatatgtgggtataatacagaaaacttttttttgtatttctctcttttttttttttttgagatggagtcttggtctgtcgtccaggctgagtgtagtggcacgatcttggctcactgaaacctctgcctcccgggttcaagtgatcctcctgcctcagcctctctagtagctaagattacaggcatctgccaccatgaccagctaatttttttttttttttgtatttttagtagagacagggttttgtcacattggccaggctggttttgaacttctgacctcaggtgatctgcatgccttggcctcccaaaatgctgggattacaggcgtgagccaccctgcccgacctgtgtttttttcttttttcaagacagagcctatgttgcccaagctggagtgtagtggcgcgatctcagctcactgcaacctctgcctcctgagttcaagcaattctcctgcctcagcctcccccgtagctgggattacaggcgcccgccactacacctggctaatttttgtatttttagtagagacagggtttcgccatgttggctaggctggccctgatctcctgacctcaggtaatctgcccacctcggcctctcaaagtgccgggattacaggcgtgacccacatctggcttgtgtttttttcttaatcctgtactttgtttcaccagatagagaaagattgtctacaagtcatcaaggagaacaaagctatcaactctatactagaagcttaaggaaattaaaacaaccagaaggttgtatcaggcctgtcggttatgaatgagtaagaaagtaagacatatgcaagggagtgggaggcagatggaagattcgttactgaaatctactgaagtttaccacgtgcccagtggcgctctccctgctgatgacagccttgaccctccaagtgagatgatacgaggctggataaaagtttcaccagcttagtaatgtcccaagaactccatggcggctgctcacacttggagagtaggtatgtatttctcctgagcaggaatctcacagtttcctttaattcctgaatgtaggaccagatgagaaaaatcagcctgtttttcattaacccaggatttgtaccaattacaggtggtaaggccgttccctttcgtcagaaggggatatgcttagcacaaagaacctcaatttttcatgttcctctaatttttcagaaagcagtcacctcacagctcatggtagctgcaataccagttttatgagacaatacagaatgaaaaaagagacaatttgatcaaacatcaaagactaaagcaaggccagagtggtaccatgcactcccatttagttctcagaatacttaatcatcaagagtaaaagctaagcatgtggttgatcacggctcagggcacaggaattgggaaaaatatattacaggtaacaggaccctgacagcctcccatgagattcttcccactgctctcttccactgcgtggggaaagggagcatgtcattttttttttttttttttttttttttttttgagacggagtcttgctctgtctctgttgccaggctggagtgcaggggcgcaatcttggctcactgcaacctccgcctcctgggttcaagtgattctcctggctcagcttcctgagtagctgggactacagatgcatgccatcacgcctggctaattattatttttttgtctttttagtagagacggggtttcaccatgttagccaggatggtctcgatctcctgacctcgtgatccgcctgcctcggcctcccaaagtgctgagattacaggcgtgagccaccgtgcccagctgggagcacgtaatttatctgtaaaatttgatactggctgggcacggtggcttacgcctgaaatcccagcactttgggaggccaaggtgggaggatggcttgagcccaagggtttgagaccagcctgggtaacatggtgaaaccctgtctctacaaaaaaatacaaaaattagccagacatggtgtcacatgcctgtagtcccagctacttgggaggctgaggtgggaggaccacttgagccgggagtttgaggctgccacagtgagccgaggttgcaccactacactccagtctgtgcaacagagccagaccctatgtcaaaacaaacaagcaggcaataaaataagataaaataaaatttgataccaatcttacctcaactaccattgtggcagagagaggctcaacagaagcatctgagaggcaggaggcctggatgggaggaaagaggggcagagtctcctgtggctcaatcaacgggaagagccgccctatgacaagattgattgggaagaggatgacagcagtatggatgctgaccagcagttcagaccaggccacagcaaatggacgcactgaaagaaaagcatgacatcaactttcatcttcaacaattaaaataatcgcaaagtcattcctctcctaggtttaactatttactgaggaagttaactacgtttatctagagataaaattatcctggcagtaaagaccatgttgtgttcctaatactgcttcatttgttaatgaatgagaacactgagaaaatttgttagagtattctaacgttagggcagtggaagaaaaatgaaggcacaatgtattagtctgttttcacactgctataaagaactatctgagactgggtaatttataaagaaaagttcttcatggctggggaggcctcaggaaactcactgtcatggcaggaggtgaagaggaagcaagaaaccttacatggcattacaaagcattacaaagcactacaaagcaccttacctggcattaacactttacatgccttacaaagcaaagcatcttacatggtggcagaagagtgacaggggaactgccacacacttttttttaatccccgagacggggttttgctgtcacccaggctggagtgcagtggtgcaatctcggctcactgcaacctccgcctcctgggtttaagcaattcaaccatcagatctcatgagaactcactatcatgggaaaagcatgggagaaactgcccccatgatccagtcacctcccagcaagtcctccccccgccccaacacagggggattacagttggacgtgagatttgggtggggacacagagccaaaccatatcacaccacatgattctgtttctttctaatcctgaaagtaagggtagtggagtttagttaaagtattgcatagtaggctgggcatggtgactcgtgcctgtaatcctagcacttcaggaggctgaggcaggaggatcacttgaggccaggagttctagaccagcctgggtaacagagcaagaccctgtctcaaaaaaaaaaaaggattgcttactacaaacaacacacatcagggctcatccatactttgctcatctctcttggcagtggtgctgtttatcttccagaacataacattgatgaccatgttgcagagtagcagtgtcatgcagcaagacagccgttggacccttgtaaactggttccagggatgccgagttgcaattgaaagccacagataatcctgggtgaacttttccacaatcatggaggaaaacagatgtctgaaaagagaaatcagaagaggaaatacatgagattttattctgaaagtgcaccagtttaagatgtgatttgcccagcaacaagcgacatagcaactcccaagcctctattcaacacctctgtgaataagctttcagatattttaattctttttttattttaaattcttttaccatcacccgaatgtgtccatgtaagattcttttgttgttttaggataaaaggttgttgaggataatttatatgctatgcgagtttaaaattaaaaatggttgttttagctttataagagttttgatgaattttttactcttcaaaagtttacattaaacttctgctcaaaatagtttggtaaattcatactctgagcactttctctactccaaatatggaggaactataaataatatataaaaagaaagaaccaaaaagactttgctgggcttaaacacaaaataaaccttttctgaggaagagaagcagaatgagaaaacaaggtggtcagagtgaggtagaagccacaggattactgagctccagacctggaggaaggtagtacaaaagtgggagtttgacttttgtacagtaactgaaactaaaaatgattcactgggtgcagaaaagggagggacaaagccaacttcattgctagaagccagtgttgagcctggagctcatgaaaggatacttgagaacaaaaaaacctctgtagggctacacatttatagtaaggaggtgagaaaaaaaggacagcttcatgaccaggaactaagtcaagagatccaaggctcatgacaagatctgcaatactcctagttccattaatttcattgaaaaataggagctccaaggtcccatataataaggcccagttctagactggagatgtgaagggttggaatgaaaacagtagcaaaaccagtcacgggtggtgtttgtggtggaaggggtggaagggatggtatgtgtgtgtgtgtggaggtgcagtggcagggagaggagtgggagggagagggaaagtaataatccagcccaaaagaaattaatttaatgggacccaggaggcagaggttgcagtgagctgagatcgcaccactgcactccagcctgggctacagagagactccatctaaaaaacaaacaaaaaaaggggtgtatataaacacacacacataacagaatatcatttagttttttgtttttgagacagggtcttgctgcgtcacccaggttggagtggagtgcagtggtgagatctcagctcattgcaacctccatccccctggctcaagtgatcctcccacctcagtggtgtgcaggtgcacaccactacacctaatagggcttagctgtatccccacccaaatctcatcttgaattgtagtttccacaatcctctcctctgtcatgggaggaaccaggtggagataactgaatcatggggtcagtttcccccatcctgttcttgtgatcgtgagcgagttctcacaagacctgatggttttataaggtgctccccacttcactgggcactcattctccttgctgccatgtgaagaaggatgtgtttgcttccccttctgccatgattgtaagtctcctgaggcctcccaagccatgcttaactgtgagtcaattaaacgtctttcctttacaaattacccagtcttaggtacgtctccatagcagcatgagaatagactaaatataacacctggctaaattttgtattttttgtagagatggagttttaccatgttgcccaggctggtctcgaactcctgagctcaagtgatccacttgtctcagcctcccaaagcgctgggattccaggtgtgagccactgcacctggcccatcatttagctttaaaaaggaaggaattttttttttttttttttttttttgtgagatggagtttcactcttgtcacctaggatggagtgcaatggcctgatcttggctcactgcaaccttcacctcccaagttcaagcaatccttctgtgtcagcctcccaagtagctgggattacaggcaaccacagccatgcctggctaatttttgtatttttagtagagatggagtttcaccatgttggccaagctatctcaaactccggacctctggtgatccacccgacccggcctcccaaagtgctgagattacaggtgtgagccaccgcacccggcccaaaaaggaaggaaattcttgcacatgctacagcatgaatgaaccttgaggacattgtgataaatgaaataagccagtcaccgacagacaaatactgtatggttctgcttacatgaggaatgtgaagtaatgaaatttatagaaatagaaagaatagttgccaagggttggaagggggagggaacaggaagttgttcaatgggtgtagagtttcagttttgcaaagtgaaaaagctctggagctctgttgcacagcagtatcaatatatatactactactgcactacacacttaaaaatggtgaagatggtaaatgttatgtgtttttaccgtaattttaaaagttgtaaaaacagtgtaaacatacacataaataaatatatagattgcaactcttctgccttaaaaaataactacatgcagcagtgattaagaatctatatgatggacacacaatgcatgaagatgtaatttgtatgacaacaatagcacaaaagagtgggaaaggaactgagctacaggagtgaagtttttgtatactattgaaattaagttgatagtaatccagctaggttttcataaattagaattttaattataatccccaggggaggcataaagaaaataatttaaaaatatatagtaaaagatacgacaaaagaatacggtagactagaaaatatccatttaacacagagaaggcagtgatgtcctctgggagattctatgccagtaggtgtgggtaactgttgaaccccatttgtgatggtgattaaaaaaaaggcagtgataaagaaacagaggaacaaaaaagatacaatacgtatagaaaacaaatagcaaaatggcagatataaaccttaccttattagtaattatatcaaatgtaaataggttaaactcacaaattaaaagatagagattggcagaatggaccaaaaaaatgcctaatccaactgtattctgtctacaagagacataatttagatatgaagacacaaatgaattgaaattaaaaggatgggccagtagtggtagctcacacctgtaatcccagcactttgggaggagaaggtgggaggatcatttgaggtcaggagttcgagaccagcctggccaacatggtgaaaccccatctctaaaaaaatacaaaaattagcaaggcatggtggcacatgcctgtatttctagctactcgggaggctaaggcaggacaattgcttgaacccaggaggttgcagtgagccaagatcaagccactggactaaaaagatggaagaaggtattccatgtaaacagcaatcaaaaaagggctggagtggctatactcatataggacaaaatatacttcaagacaagaattattactagagccaaagacattttattaaagggtcaattaagaagataaattcatctgtgctgtcttcttacaagccaagtggaagtgttgctagccagccatatagctgtcacaatgtttctgcttaggaactgctccacaggcagaagacaatgtattaaaatcttcaaagtgttaagggaaaaataacaaaaaatttctatccacttaaatagctaactatgagtcaagagtaaagatggacacacacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggcttgaacccgggaggcggagcttgcagtgagccgagatcccgccactgcactccagcctgggcgacagagcgagactccgtctcaaaaaaaaaaaaaaaagatggacacacacacacttctcattagaactattaaaagagctacttcaacaaggagaaaaaagcccagagtaatgataagaaatacagaaaactggctggacgtggtagctcatgcctgtaatcccagcattttgggaggccgaggtgagtggatcaccctgaggtcaggagtttgagaccagcctggccaacatggtgaaaccccatctctactaaaaatagaaaaattagccaggcgtggtggtgggcgcctgtaatcccagctactcaggaggctgaggcaggagaatcacttgaatccaggaggcggaggttgcagtgagccgagatcatgtcactgcactccagcctaggcgatagagcaagactctatctcaaaaaaaaaaaaaaaaaaaaaaaaagtcgggcacggtggctcacacctgtaatcttagcactttgggagggtgaggcaggtggactgcttgagcgcaggagtttgagaccagcctgggcaacagagtgaaacgccgtctctaataaaatacaaaaaattagccaggcatggcagcgtgtgcctgtaatcccagctactccggaggctgagaaagaattgcttgaacgtgggaggcagaggttatagtaagctgagattgcaccactgcactccagcctggatgacagagcaagactcccgtctcaaaaaaaaaaaaaaaaaaaagacactaaaagaatacagaaaactaggctgggcacggtggccctcacctgtaatctcagcactttgggaggccaaggtgggtggatcacctgaggtcaggagtttgagaccagcccgaccaacatggagaaacctgtctctactaaaaatacaaaattagtcgggcatggtggcgcatgtctgtaatcccagctgctcaggaggctgaggcaggagaatcacttgaacctgggaggtggaggttgtggtgagctgagatcgtgccattgtactccagcctgggcaacaagagcaaaaatccgtctcaaaaaccaaccaactaaacaaacaaacaaaaaacaaagaatacagaaaactagaataaacagagaaattgatattaattatttaattaactgtgaaatatgaaaggaaaaaccttttttgtgcatctaaaaacaaaatggtaaaaccataacactagagagtaatttaaaacatgggaattgggagagaggttactcaagaacggttaaagcattgctaattctttgtcatgttcaggcagaagaaacgttattcttagaaaattaatatggagaaaaagtgtgttaaaaattaaaagtaaccaataaaaagaattagaagaggaagaagaggaacagaagcaggaagtggaaaaacaagaggagaaagaggaaaaaatacaatgtatagtttctaaaccagcaaagattaaaaatacaagaagtggtcaggcatggtggctcacacctgtaatcctagcactttgggagaccaagacatgcagatcacttgaacccaggagttcaagaactagcttgggcaacatggtgagaccctgtttctacaaaaatagttttaaaattagccaggcatggtggcacacacctgtagtcccagctactcaggaagctgaggtgggaggatcacctgaggctggcgaggttgaggctacagtgagctgtgatccatgtcacagcactccagctggggtgacagagcaagaccccatctgaaagaaacaaccaaccaaccaacaaaccaagaggcagagaaccttaaaaaaaaaaaaccaaaaaaaactacaaaacctgtcaatttgacaatgtggaaagtagataaaggaaagagaatggattataacaaataatgcaaaataatatggtaaattaagtccaaatggattggtaatcatggttaatgtaaacatattaaactcatgtattaaaagagattattagatctggttttttaaacatccagttatatgttgcttgcaagacataactctaagcaaaaccataaaaagggctgaaagtaaaaagataagaacaaacaatagaaataatatcagtatgtcaactttctttagttaatataaaatggaatttaagatacaaagtgtcaacaggatcaaagggagacctatataataaaaaaaaaagtatccagaagaaataacatacacttaaatgctcctaataaacatccaatagacatataaaatatgtctatacggtaaaaacttacataactgaaggagaattaaactcacagtctttcctctattggaaacacagagattaaacagataaaaaatcacatttctgcaacaaaaatgagtatgtttgaataaatatgtctatatatgttttaaaaatactagaactttggatgcaatggtatatgcctgtaatcctagctactcgggaagctgaggtgggaggactgcttgagcctaggtgtttgggaccagcttggcaaacacagtgagaccctatctcaaaaatcaaaacaaaacaaacctagaactgtatcaggtctagggaggggaaatagtattcgctaccccttaagttttggtgaaggagagaaaatttctaccagtttattcctatacacaagcaacacacaatttaaaacatatatttttggtttgttttttagagacaggatctcattttttttttcccacttcttgctgagagtccatgatttttagtttcaagacttatttgttttctctgttttgttttgagatggagtcttcactccttcgcacaggctggagtgcagtggcgtgatctcagctcactgcagccttgacctcccgggttcaacttccctgcctcagcctccccagtagctgggactacaggcgtgcaccactgcgcatggctaacttttgtatttttggtagagaaggggttttaccatgttggccaggctggtctcgaactcctgacttcaggtgatctgcccacctcagcctcccaaaatgttgggattacaggagtgagacaccgtaccttggcccttctccttgaatctgattttcaaagttaggacataaaaggctaaagcccctacttagttctgttgaactgcccattctggagggagacagccacccctgtgaaaaatgccactctcttgaggttgccacgcagaagccatacataggtgctttgttgacagccacagatgagctctcagttgacagccagcgccccctgctgaccttgtgagcgaatcatttttggaaatctaacacagaggagcttacagatgagtaacagacccagccaggatgaaagatcccaagggaaaactccccagccatggcctcactgaatttctgacccacaaaaccaggagaaaagtaacatggttgttttaatccactcagttttgggagtaatttcttatatgccgcaattgtaattggagcagatcttaacaaagaaatacacatttcttgtttgttctgggagtcaagtaccagaagaaacagttccatgtttttttgcctttaggcattttaatgtaaggacgtggtgtttggttgatagagccactgaggctggagcacagtggctgtatctcggctcactgcaacttccgcttcctgggttcaagccactcttctgattcagccttccaagtagctgggactacagtctcatgctaccaagtctggctaatttttgtactttggtagagatggggttttgctatgttggccaggctggtctcaaactcctggcctcaagtgatttgtccacctcggcctcccaaagtgctgggattacaggtgtgagccaccatgcccggctaggacatggtgtgtgggcctcttgcaatcatcttgttcccatgaggaaaaagccgagagccgtaatattgaaccagaaagctgaaggtaagaaggaggtcagatagcagaggtatattctcctaggaatattctcatctttagcattcaggagacatagaaagatacatggatacctagaaagatacagaagttgatacgtatattataccgttctcctggtctgtgaattcaccagtacattgctttaattattttggtttactaacatctttgcattttttgagatggagtttcgctccgttgcccaggctggagtgcagtggcaatcttggctcactgcaacctctgcctcccaggttcaagcagttctcctaccttagcctcccgagtagctgggatcacaggtgtgcaccaccacgcctggctaatttttgtatttttagtaggtcttgctatgttggctaggctggtcttgaactcctgacctcaagtgatctgcctgcctcagcctcccaaagtgcagggattgcaaacatgagtcacggtgcctggccagtttactagtgtctttgaaagtcagttgaaggctacagccctctaatactttcctttatttttatattttgttctcataaatatttgtatcatcgaagtagtggtatcctttttatattccattgatctgagtgattcttttattcctagatatcttagtaaatttataaatgattctctaggtaaacagtttcagaaaataagggcaatatttataatttttatacttcgaatctctttttgtcttccttctgatttttaaggtaatggttacaccagttacaaccacaacagtaatgcttatgtatgtttgaaataatacattaataaaatgttaatttgcattaaaaacaattcaatcgtgaacaattcaattaatagtgaacatcaatattcactgttaatagtaattttccaacagtacctaaaggaaaagagctctctctttgaaactgggatgaagacccggtcaagctcacagtctccgaggtccacagccagccagcaattgcacaggaaatgccacttcctcttaactgccatgtcacagacaattacctggctgacatacctatagtaaaatgaagataaccacattagggagatgggcttgaatcagttgtctgtagtaagacgtaatctcagaccattagtaaactgtccaagtaaatgaactgtttcattgcaaggcaagaactaaggaaaggaaagaaagttgaggccagacatggtgatgcacacctacaatcccagcactgcgtgaggctgaggcaggtggattgcttgagctcaggcatttgagcacagcttgggcaacgtcgcaaaatcccaactctacaaaatatataaaaattagctgggcgtggtggtgtgcacctgtagtcctgagctacttgaaaggctgaggtggaaggattgtttgagcccgggaggtcaaggctgcagtgagttgaaattgcaccactgcattctagcttgggtgacagaatgagactctgtcaaaaaaaacaaaaagaaaagagagtagatcttatctttcccttcccaacttctaagggagttcatgtaccagacaccagactgcaaacctttctcacctatgaatagataagtatgtatctacacattttataacctttctctgtcccatatgtgacagtggcttgccaccttttcaaatatcccatctgcctttcatcatcagggggcataaatgggttgtagtctttatcatttacattaatgacttctcactctacttagtctcatctccgcttcacaggcctcatctccacttcacagagccataggccctgagagctcatccttttcccaaccagtgttttatcactaatttctctgctaacttcagccgttcacacccctgtcctctgggacacctgattattcaacctgtttgatttcacctcacaactattcggcaaacctcctcctttactgtaatgatgctattttccccaagggtctgtgtttgtcatgaaaccacttaaatttctctcgtcaaaatctttttttttttttttttttttttttttttttttttttttttttttttgagacagagtttcactctcttgcacaggctggagtgcagtggtgtgatcttggctcactgcaacctccacctcccaggttcaagcaattctcctgcctcagcctcccaagtagctgggactacaggaaggagccaccacgcccggctagtttttgtatttttagtagagatggggtttcactgtgttatagccaggatggtctcgatctcctgacctcgtgatctgcccgccctggcctcccaaagtgctgggatcacaggcatgagacaccatgcctggccaattcaatgtattttgacaaacgtttatacaccagcaccatcaaaatatcacccccaaaagctccctatccctccttccagtcacctcctgccccctcattcctggccttaggagaacaatgatctgctgtcctctgtctttatagaatagttagccttttatggaattttatgtgtgtggaatcatatgctctctctctatatatatgtatttttttttttttttgaggcaggatcttgctctgttgcccaggctggagtgcagcggtgcgatcttggctcactgcaacctccacctcttgggctcaagtgattctcccgcctcagccccccaagtagctgggagtacaggcatgagccatcacgcccagctaatttttgtatttttttgtagagacagaatttcaccatgttgcccaggctggtctcaaactcctgacctcaagtgatctaaccaccttggccccccaaagtgctgagattagaggtgtgagccactgtgtctggcctatacattctttatgtacagcttctttcactaagcataatttaaaaaaattcatccacgtagtcatatgtaacaatcgtttccttttcgttgagtagtattacattgaatcaatacactaacatttgtttattcattcaatagacatttgtgatgttttctgttttgggctactaataaagctgctatgaatatatgtgtacaggtcttgcagtggacacatgtttttgtttatcttgggtaaatacctatgagtgtgatttctgggtcacatggtcagtgtatgtttaacttcacaagaaactggcaagctgttctctgaagtggccataccattttacactctcactaggggcgtgtgagtgtttcagttgctccccatcctcccctaaacttggttttgtgagaattttttttttttttttttggagatggtctcactctgttgccaagttggactgcggtggcaccatctctgctcaacgcaatctctgcctcccaggttcaagcaattctcctgcctcggtctctcgagcagctggggtgacaggcatttaccaccatgcccggctaatttttgtatttttagtagagacagggtttcaccatgttggccaggctggtctcaaactcctgacctcaagtgatctgccaacctcggcctcccaaagtgctgggattacaggcgtgagccactgtgcctggccttttgtgagagtttttaatttaagccattctgatggatggctagtgctgtcattttcatttactgatgactaaccaggttgaacatcttttcaagtgcttactatacattattcacttttttaaataaaactggaaggatggtttacaagctgatttgtgcatactggaacagaatggaagcagcaaggaagttattaggctctaccagcccagtggctggtatgtctagctagggggaaaaatgtattttgctaacaaatttagggagaccatatgctctttgtgggtgggcaacatgtggcaacagattgagtgcctgagccttaagacttctacttcatttttctcttttttcctaactccaaggaaccagtaatcctcattcttaattaattgtatcatctactttctctagcacctctcctaattctgggtgctgctcaaggaagatactgaatcattcaaacctaacacgttaggttcaaggactttatcatcgtctagttatttctctaactccttaggcacatctcatacagtaattctttctccttccttaagatcttgacttttttttttttttccttccctccgagacagggtcttgctgttgcccaggctggtgtgcagtggtgcagacatgctcactgcagcttcaacctccgaggctcaagttatcctcccacttcagtctcctgagtagctgggattataggtgcacacaaccatgcctggcgattttttttgaaattttttttgtagaggtggggtcttcctatgtagctcaggctgttctcaaactcctggcctcaagtgatcttcctgccttggcctcccaaagtactgggattacaggcgtgagctgctgcgccctgcccttaagctcttaaatttgactcaaagtttgactgtcagtagacagttgtttactaaagttagtctttaaggatattttttcatatttagaaatacttttaatttgtggcactttcaggcaatatttcattggtgttatttgctgttcacaatcatgacatttaatgaaaatgagattagagaaaacaaaacatctattattctactatccaaaaaaaatcacattgttaatctctcacacttctttccagggcttattctgtgtagacagctttgaaactgaaatctaatagtcatttgttactatttggctcaaagctttactgtgatttattgtggtgatcttctttcttctctcttggatccacaaagcagcagcaacagccaacaggatataagtactcaccaggagggactgacgccagaattgtcatgccagagccgaaggctgtgcaggttccctagagaggtccaagtggtgagaaggaagacatccaggccccctcgttcaaagactgtcttctgggggtcacagaggtgatggggctcactccgtccctctgatccatagagggtgatgacaacctacaatgagacagggaaagataaaatataaggaattttaacacaattctttgggtttatccctaaggagaaagacgaagacatagaaaactatttagatcaagtctttcggatcttagacaagcatagataattcttcatatatgcagtatagatatattttttctgacatgaagtcttgctctgtcacccaggctggagtgcagtggtgtgatcttggcttagtgcaacctctgcctcccaagttgaagcaattttcgtgcctcaacctcctgagtagctgtgattatagtcatgggccatcacgctcagctaatttctgcatttttagtagagaagggttttcaccttgttggccaggctggtctcaaactcctgaccttaggtgacctccccaccttggcctcccaaagtattgggattacaggcgtgaacccccatgtgcggcccacatgtacagtttagaactagaaaataccaatctctagtctcttttaaagtgctattggttgccaggatatcaccaactcagagtgtgtctcatgtggcagaagacacaaggcaatgtgaaaaacatttatttcattaaccttagctgttgtagcagcgcttcttcgatatccggtgtagacctgaataaggtagtgaaattgagcgctggggtcattatcagccaggacagtgaccttcacctgcaagaaaagcagaaccatgcaacttactaggcctccacttggtatagttcctgcctcctccagctgaggagcaggaggatgaactccggcaggtgtctggcagccctgcagaaagcagggctgaggtgtgggcagcagacagacacatgagcagacctaagtcactaaagtggggatgaggcctgaacctccagggcctgtgcctctcaagtgaaacagtcatagaatcacccgatcaggtcttgggcctctaaatccttccacctccttcccacttaggtacagtcaccagataacagagaatacccagctaaatctgcatttcagataaactatgaataatttggggcacacttacactaacgatgcactgttcatttaaaatgcaaatttaactaggtagcctgtatttttgtttactaatgctgacaaccctacacccagggcaacaagaagtgaacacttggcgtattctagaatttccaagtgcaagaaaacataggaagaacaaacacatggaaagaagaggctgtcaaaagatttttgttttaaaaaacatgccatataaatttcttgtatattatagttatattcttattttttgagacggagtcttgctatgttgcccaggctggagtgcagtggttcattcttggctcactgcaacctctgcctcccaggttcaagtgatcctcccacctcagcctcctgagtagttgggactacagacatgcaccaccacagccggctaatttttgtatttttagtagagacagggtttcaccatgttggccaggctggtcttgaactcttgacctcaagcgatccacctgcctcggcctcccagtgtgctgggattataggcgtgagccacttcacccagccagttacattaagttacaatttgatttacatataacttttttttttttgagacagaatctcactctgtcggccaggctggagtgcagtggggcaatctcgatctcagctcaccgcaacctctgtctcccgggctcaagcaattctcctgcctcagcctcccgagcagctgggattacaggcacatgccaccatgcctggctaatttttgtatttttagtagagatggagtttcatcatgttggccaggctggtctcaaactcctgacctcaggtgatccacctgcctcggcctcccaaagtgctgggattacaggcgtgagccactgcacccagccaagttacatgtaactttcatatccaatgtataaagtaagataaacttgcatttaactttagttaagctctctaggtcttttcttttctttttctttttggagactgggtctctgttgcccaggctggagtaaaatggcacaatagctcactgcagcttcaaggctcctgggctcaagcgatcttcccacctcagctgcccaagtagctgggactacaagcatgcaccaccatgccaggctcttttttttttttttttttttagtagagacaaggtcttgttatggtggccaggctggccttgaactcttgagctcaagtgatcctcctgccctggcctccccaagtgttggaattataggcatgagccactacacctggctagtgttttcttttggctcattcctgtcctaaaaggagtcctgcaaggtccaatcttggaaccaaaggaaaaaaaaatagagagaaaaagttctcaggtcttgagtcagcagacacgaagataaatttaagaaaagtttcacttgaatttctatgcctcccagtaccaggcttcctgctgcttttgacgaaggtgttttttccttcatcttatttaattactcaaaacatcatggcaaatctgttgaaatcaaagtctcattaccttctgcatatctgcttgatcctttttccgagcccacacaactgtgatcacataaaatcctaaaaggctggccagcagtgacaccccaacaggattgttggtcacgcgaaggaacagtttgatcgtgtcttcaacattcacggtcctgggcacgacaaagaagtcgctggcaaagaaggtcaggtggttacagagacactgtgtcctcagaattgtgctctgtggcccaacctggaattagaatcaagacgttgattctagtcagacagagtgctaaggaggggacagacataaaacaaacaccagcaatttagagatggaaagaggtatctggttctctcattcacagctggtgatggcgtaaattggtataaccaatgtggaaagtaatttagcaacatctagtacagctgaagcagaacaaactctttgaatcctgcaattccagttctgagtgtatacatgttctaggggaactgtgcacatgtgtatgaagatatatgaaaaggaatgttttgtcacctttgtctataattatcaaaaataggaaacaacttacatgttcaatagcagaacatacaaatgaacaagtacataagtaagcagaggcaaactgattgaattctatacagcagttaaaaatgaatgaatcagcgggtgtggtggctcatatctgtaatcctagcactttgggaggctgaggcaggtggatcacctgaggctaggagtttgagaccagcctggacaacatggtgaaaccccatctctactaaaaatataaaaattagccaggcttggaggcgcatgcctgtagtcccagctacttgggaggctgaggcaggagaattgcttgaacctgagagacagaggttgcagtgagcccagatcacaccactgcattccaccctgggtgacagagcaagactctgtctccaaaataaataaataatacataaatataaaaattttaaaaaatggatgaattagaggtagatgtatcaacatggataaatgctaagtgaatacaacaagagatatgtacagtataatgccatttgcccaaagcctaagaagcatgcaaaacacttatttatctattcattgtcagtttccctctccagaatgtcagttcatgaggcgattgtcttgttcactgctgtgtctctagttcctagacttgggcatggcacgtagaagacactcaataaatattcggtgaaagaatgaattcccccctcaaattcaggccagtagttaccctttggtggaagggaaggaaggagagagactagagagggatactcagagggcttcaattattcatgagtgttttattatttaagaaaatatgaagcagagcaaaatactaactttgataaagctgaatgtgcattcaatgttttttattattctttatggctttccatatgttggaacatttctgcataatatttaaaaatatgtcagtaggtgattacatggaagctaccaattctgtgtttggtttcgtgggtgaaaagcctccagtactgtcattatgactacttctttccatggcacagaattaagtcctggaggcccaatctagtctgcctttggaagaactcttgcgctgtatttggggcagctcaattcctttcatggagtccaagcacttcagcgtgcttcaaggaggtgggaaatatccgatgccttctgcaatcaactggtctgtgctgtgagaggagaaaagctctcaagcttctctactcaaagtatggtttccctaacaagcagcactgggatcagctggaagcttgttagaaaggcctgaccagagctactgcttcagaatctacattttaacaaactgattatagatttgcttgatagccattgtccagctatgactgcctgaggctatgaatggtgcagatgccttcctaagaatcctctctctgtcatgcctgtaattccagcactttgagaggccaaggcgggcagatcacctgaggtcgggagtttgagaccagcctgaccaacatggagaaaccccatctctactaaaaatacagtaattaggccgggcacggtggctcacacctgtaatcccagcactttgggaggccgaggcaggcggatcacgaggacaggagatcgagaccatcctggctaacacggtgaaaccctgtctctaataaacatacacaaaattagccgggcgcagtggtgggtgcctgtagtcctagctacttgggaggctgaggcaggagaatggcatgaacctgggaggcagagtttgcagtgagccaagatcgcgccactgcaccccagcctggccgatagagcaagactggtctcaaaaaaacacacaaaaaaacaaaaaaaaacaataattagctgggtgtggtggtgcatgcctgtaatcccagctactggggaggccgaggcaggagaatcgcttgagcccagcggggcagaggttgcggtgagccgagatcatgccattgcactccagcctgggcaacaagagggaaactccctctataagtaatcatcatcatcctcctcctcctccttctggcctcccaaagtgcaggagggaggattgcttgagctcagaagttcaagaccagcataggcaccatggcgagaccctgtctgttcaaaaatctaaaacattagccaggcatggtggcacatgcctgtggtcctcattacttgaaagtttgaggcaggcggatcttttgagcccaggaggttgaggctgcagtaagccgtgatcatgccactgcactccagcctgagggacagaatgagatcccacctcaaaaaaaaaagaaaattatctttccttctctttccaatctagatggcactttctcagctctttttagaacagcttgctgatttgcaagaccttacaccacattctttgagcaaccaaaccaggactttcatcaggcaggatctcacagaatcacgagtgtgcaaatataatagtgctggtttaaagcagttggacaccaggaacaaggtgataattacaaaagtgacaacctgtcctcacctggcctggaacgtaaaagaatctgagaatgtatttcttgagctatgaaagttctccttcgtttagcaagaggtttcattttacccacccacaacatatttaatacttgtagaattttatggcttccacacgctattttatccacacttgtcagatccaccctggactgtgtttgagaaagaaatcacaaagataaagcacaaagctgctcctgcttcgaagaggcacacttgccctgcccaccacacacaaccctcctccctccttttgcccaggcagagttatttcaaaccacctgattatttttctttctgggctgccccaaatgagataacggatgcattgggcttaacagtagctatggcagaagagaggcccaagaagcggctcagtttcttacttggcatccggcgctgctccatgtctggttgtggatctcccagtagtaacactgagtgacggcggtgatgaccgagaccaagctgggtgtctgctgagcaccctcctgcctctcactcagcacagctgttatatagtaggtgccaatcccgtgctgcagatgctctggattcagcacccacgtgtactcctcatcttagaacaaagaagagtgcttacttgtatatcaaatggaacaaaaacaccaatgaacctctcttctaaaggatctattattaatattttacaaatgagaccatgatgaaactagagtcacaaatgatttgaaagaaaatgaccagtgatacaaccctgggctctggattactactgttccagtaaagaactacagtcttttggccaggtgtggtgactcacgcctataatctcagcactttgggaagctgatgcgggcggatcacttgaggtcaggagttcgagaccagcctggtgaacatggtgaaaccccatctctactaaaaatacaaaaattagtggggtgtggtgatgtgagcctgtaatcccagctactcaggaggctgaggcaggaaaattgcttgaacttgggaggtggaagttgcagtgagccgaaatcgcaccactatactctagcctgggcaacagagtgagattttgtctcaaaaaaaaaaaaaaatatatatattcttctggtatgtgaacatgtgaacatttaggtctaatgatttagaatgtattacgaggtttagaaaaatgaaatgagcacatatctaagttagcagatagaagactaaggtaacaaaccccagggtgaagcaaacatagagatagggcagcttcaggaacaaagcccaggactgcacgctagggaccggaggtcgggcctggctctgtcaccagctggctggtaggggctaaggtgagtcatccagtctctctgggcctcagctttctcatctttcaaatagtcctgtctctcaaaaaaaggttcctgaaggccccttccggctctgaatgacatatcattgccaagatcaccaagaaaaactgagtccatggccaggcgcagtggctcaggcctataatccaagcactttgggaggttaaggcaggaggattatttgagcccaggagtttgagacctagcttggcgaacatggcaaaaccctgtctctactaaaaacacaaaaaattagccaggcatggtggcatatgcgcctgcagtcccagctgcttgggaggctgaggcatgagaatcgcttgagcccaggaggcggaggctacagtgagtggagatcgcaccactgcgctccaccctgggcgacacagtgagcctgtctcaaaacagaaacagaaacaaaactgagtacacctttggaattgggaaagggcccgttggtaatttccacagattctgtagtgggcagcctggtagtgagcattgctgcctcggggactttgcctaaaagcaagaacttagaagtgattgttcctgtgtgagtggtgcccatgcgagagccagagaaagttctttccagtatggaaggtggtcatgacgggagactgtagcatgctttctccattcagatttttcccaacgtaaaaataaatacagaagtgtagctcttattaagacttttcagtactatatttaaagttgatacccacagagcatggttttgatcaagtatatctgggcactatttatatatatcaggaatttttattttttagagacagtgtcttgctctgtcacccaggctggagtgcagtggtatcatcgaaactcattgtggctttgaactccttggctcaagcaatcctcttgcctcagcctcccaagtagttaggactacaggtgcacgccaccacgctcggctaattttttttttttttttgtggagacagagtctcgctctgttgcccaggctagtctcaaattcctgggcttaagtgatcctcctgccttggcctctcaaagtgctggcgttacaggggtgagccactacaccaggccagacatttttaactgtaatgttatgtctcagaaattcttaacttttctaaactacaatacattcattctgattttataccaaggcatactgagatatcatcaggcctttcttcctcaaatctaagattagaaataaagttgaaatacataggacatatttcatatatagtcatctacaatatataaatgtgaagtatatttaactcatggtgctgtgagccttacttctgctgtgggtctcaacatgttattatgaaaatcttcaaccatacaaagaattttacagggaataaccatataaccattaactagattctacaattaacatcctactaagtctgcttccttacatacatatccttatccatcctataatccatctttaaaaaaaaatgattttatggtcacgtgtctacacatgtggtaaaatcacacaggactcaatacacacacatacagaaatgtgcttgtaaacctggtgaaatcggaataaaatcagtgattgtattaatgttattttctggttgtgatatactctagttatgcaagatactaccattcagagaaactggatgagaggtatacaagctgtttctgttcttttttttttttttgaggcagggtctgtcacccaggctggacagcagtggcacaatctcagctcactgcaacctctgcctcctgggttcaagtgattctcatgcctcagtctcccgagtagctgggattacatgtgtgcaccaccatgaccagctaatttttatacttttaggagagatggggtttcaccgtgtgggccagcgtagtcttaaactcctgacctaagttgatccacctgcctctgcctcccaaagtgctaggattacagtgggatttcaggcatgagccactgagtgcccagcctgtcttttttttttttttttaagacagtcttgctctgtagcctggagcgcaatggtgcgatcttggctcacggcaacctctgcctcccaggcttaagcaattcttctgcctcagcctcccaagtagctgggattacaggtgcccgccaccacacccatctaattttttgtatttttagcagagatggggtttcatcatgttgaccaggctggtctccaactcctgacctcaggtgatccacccgcctcagcctcccaaagtgctggggttacaggtatgagccactctgcctggcctgtctctgttatttcttataactgcatgtgaatctacaattatctcaaaatgaaaatttttttaaaaaagaaaaaaaagtggccacatgaagtagctcatgtctgtaatcccagcacttcaggaggctgagacaggaagattgcttgaagctgggagttcaagaccagcctgggcaacatggcaagaccctgtctccactttttgagacggagtctgtctctgtctcccaggctggagtgcagtggcacggtgtcagctcactgcaagctccgtctcccaggttcaggacattttcctgcctcagcctcccaaatagctgggactacaggcacctgccaccacacctggctaatttttttgcatttttagtagagacagggtttcactgtgttagccaggatggtctcgatctcctgaccttgtgatctgcccgcctcggcctcccaaagtgctgggattataggcgcaagccaccgcgcccggcccacaaaattttttttaagaaattagccagatgtggtggtgcgcacttgtagtcccagctacttaagaggctaaggcaggaggatcccctgagcctgacagtttgaggctgcagtcaacaatgatggtgccactgcactacatcctaggcaaaaagaaatcaaagtaagtttctgacagctgattgggttttacctttttgccacaccttatcctttggaagggtgatgttcaggtggaagtgagtgcagttaggctgatactggaaccccaggtagagtgtcattaaaaggggactgtcaggatctatgctcactatcaaggatttctccaaggaagtgacgttcactgtgattgtaagctgatgtgtgctcatgttgaggctggtgggatgggtttccaagctaacatttctccagagcatgatctagaataagagacagttaatcattataatggtccatccattgatgtctttcaaaatcctttatattgataaggtaaggaaacgtcctagctcttttttttttttttttttttgagatggggtcttgctatgttggccacgttggtcttgaactcctggtctcaagcaatcctcccgcttcagtctctcaaaatgctaggattatatgcatgagccactgtgcccagccaggtcttcctcattggatgttagtagctaatactgctggggttaaggataagtacatagtcccagacctataacacttcttattcttcttatttttgagaccaagcattactctgtcacccaggctggtgtgcagcagtgcgatctcagctcactgcaaactccacctcctggattcaagctattctcctgcctcagcctccagagtagctgggataacagccacccactgccatgccagttaatttttgtatttttagtagagatggggtttcactatgttggccaggctggtctcgaactcctgacctcaagtgatctgcctgcctcagcctcccaaagtgctgggattacaggcatgagccactgcgcccagccctttaaaacactttttctaaggataaggtgtatctctttgtaaaagttcctaagatgttaataacaaaacaatggcactgccatcaatctaacataattccctttaagttgttgcatccttccatcctgttgcagaatatcccattctcttctattttattccctaagaatcagttcctacctcaatgtcctccattaaatcatggacttggagcaatttacgattagcgcttagtaacacacttccaatgcttccaacaatgtttctgttgtccaaatccttgaagggattgaaagctagtcctgttatctaaagacaaagagaagcccagttttatccattgctgaaatatttttaagtgaccccactagaaagatatatcatatatacatatgtatatatgtgtgtgtgtgtgtgtgtgtatatatatatatatatatatatatacatacatacatacatacatactttttttttttttttgagaaagagtcacactctgtcaatcaggatggagtgcagtggcacaacctcagctcactgcaatctccacctcccaggttcaagcgattctcctgcctcagcctcccaagtagctgggactacaggtgcacaccaccatgcctggctaatttttgtatttttagtagagacagggtttcgctatgttggccacgctggtctcgaactcctggcttcaagtaatccacctgcctcagcctcccaaagtgttgagattacaggcttgagctatcatgcccagccggatatcatatattaaatattgggatgtgccccctactaataccgcaaatgaaataacattccccatttataacctctatgagaaacagtaaattaaagatgaattatcgttgggatccccagaattattatttttaatctttatatctagaggattctattttactaggaagtaactgttctgctcttcaggataaggcaacaatgctacttgtatttgtcaggtaactgctgaaaggaatacaatatattgatatgactgggttggtatactgagtcaataattatttagatagtctcagctttttgtaaatagtgcagaggctgggcatggtggctcacacctgtaatcccagcactacgggaggctcaggtgggtgaatcacttgaggtccgtagtttgagaccagtctggccaaaatggcgaaaccccgcctctactaaaaatacaaaaattagccaggcatggtggcccatgcctgtaatcccagctacttgggaggctgaggcaggggaatcgcttgaacctgggaggcagaggttgcagtgagccgagatcacgccactgcactccagcctgggtgacagattgagactccatctcaacaaaacaaaacaaaacaaaacaagacaaaacaaaacaaaacaaaacaagaaaacaaaaaacacaacaacaaaaaacaaactgcagagttgaaatcaattcaaattacaacacaaatttagttaaatccagaaatctgtttaatgttcccaacttctacagtggatcatttttaagaggcctctatccctgccagtgtaaaataaaaatgaatgctacataaactctctcatctgatctggtctgttcagtttacatttcatgatacattactttcacccaaatgcctacatggccatcagatcccattttcattctgatcacaatcaatttcacactcacttggacattaactcctggatgtttattcaagagctccttcaaagctaaagccgacggaaagcctagcctcacaggggctgggtgacccagagtgtaagagctcagcggtaaagttgatatgttttgtctaatgagaaaagttaaaatggaagtcaatttttgtgtgtcctctgaaagtgaaaaacacagtgaaactctccccgttccttcttcccattaacctgctcagcagcagagtagcattggcagaggtcaaagtcactgaagactcgggagactggttctgctctagaaatgcttccccgatattcccaaactccaccaaggacatttccaggatgtcttctacctgcatggaaaggaaaacagtgtgtgacttgtaaaacctcagtgtcttatgttagtaaaataatgttttggagaagattggaaggggaattttcacagtgttgtaatgaagggtagtattccttagagaggaccttggaatctcacagaaagtacttgcaacctggctaaagacttagcatcctttgaaccaaactaagagggctggccaaggaaatatgcctttgccccatcatataattgccctagacctgctcacgatagagtttttaaatgacagctttattgaggtaactttcacatatacagttcatccactcagagtatataatttaacgttttttagtatattcacaggattgtgcaaccatcaccacaatctaattttaggattcatcctccctaaaataaacatggtggccgggtgtggtggctcatacctgtaatcccaacactttgggaggctgaggcaggtgggtcacttgaggtcaaaagtttgagacctacctggccgacattgtgaaaccctgtctctactaaaagtaccaaaaattaggcaggcatggtggtgtgcacctgtagtctcagctacttgggaggctgaggtggaagaattgcttaaacccgggaggtggaggttgcagagcacccagatcacactactgcactccagcctgggcaacagagcgagactctgtctcataaaataaaataaacctggtacccattagcagtcactctccattccctcatccctagtccctctagctctaggcaacaacgaatctactttatgtgtctacagatttgcctctttgggacatttcatataagtgaatcacaacatacagtcttttgtgataggcttctttcacctggcataatgttttcaaagctcatgttggagcatgtaccaggacttcattcctttttgttgctgaataatattccattgtatgaatagaccagattctacttagccatccattagatcatagatgtgtgggttatctccactttttggctatttagctattaaaccatgctgctacaaacttgagtgtacaagtttctgtatggacatgttttcaactctcttgggtagacactaggagtagaattgctaggttacatggcgattctattttttacattttaagcaactgataaattgttttccaaagtggctgcatcattttacaatcgaacaatggatagggtggcaagttctctgcatccttgccagtacttgttattttctgtctttttgggtgtgaagtggtatctcattttagttttgatttgcatttccctaatgaccaatgatgtcgagcatcttttcatgtgaatagcaaacataacctgttgagtgtttgctttatgccaacactttcctaaattctttttttttttttttttttttttttttatggaatctcgctctgttgtctgggctgtgtgcagtggcatgatctcgattcactgcaacctctgcctcccaggttcaagcgattctcctgcctcagcctcctgagtagctgggattacaggcatgtaccacaatgcctggctcatttttgtatttttagtagagatgcagtttcgccatgtgggccaggctggtctcgaactcctgacctcaggtgatctgcctgccttggcctcccaaagtgctgggattacaggtgtgagccaccgggtccagcccctaagtccttttcacttgattacagcactagggagtcttggctcactggtggggtggggagggagaccttggagaaggcatggcagaggagtttcttctgcagcagaaacttcagcaagattatctttaaaggtctggggagaggctgtgatacctggacctgtcaagattaaaatgcttctaagcagatctggccacctgcatatctggcacctaccggctcagtatgacgcttggattccagccaacttccttctccagctttggtgacattgttgagggaatgaaaggggcagacagttggaggaactttgaagcccagactgttgttgttctgaaatgggatcctgagtaactcctcactcaggtaaataagggaattgatgagattaacctgggaggattagaaagcaaacatacacccttgaattgtttgctttttttttttttttttttttttggtgacagagtttcactcttgttgcccaggctagagtgcaatggcgtgatatcgactcactgcaacctctgcctcccgggttcaagcaattctcctgcctcagcctcctgagtagctaggactacaggcatgagccaccatgctcaactaattttgtatttttagcagagatggagtttctccatgttggtcaggctggtctccaactcctgacctcaggtgatcttcctaccctggcctcccaaagtgctgggattacaggtgtgagccaccacgcccagcctatgattgctttttaaaattttacttttaagagatggggtcttgctctgttgccccgtctggagtgcagtggtacaatcatgcctcactgcagcctcgaacttctggactcaagcaatcctccttcctcagcctccccagtagctaggacacaggtgggtaccaccacacctaatttttaaaaattttttgtagaggcaggggctcactgtattgcccaggctggtctcaaacacctggccccaagagatcctcctgtcttggcctcccaaagtgtttagattacagacatgagccacacacctagcacatgattattttcaatttgcatacttcttattagcagcttaatattcgttatacatttcaaatgcattttataaaaaaaaagttacaatttgacagggaaggagaatatattatttcatataacctataagggaggattcatatttcatgttattctgacaaactgacaattctttttgagtggtgagtagaccaaatatccaattaataccatcagactaaaaaaaggaatgaagaaaagaccaatgctgagttttttgtctttttaatttcagacagagtgtggctctgtcacccaggctggagtgcagtggcagagtcttggctcactgcaacctccaccttccgggctcaaaccatcctcccatctcagcctcccaagtagctgcaactacaggtgagcaccaccacacccagttaagttttgtatttttgatagagacagggtttcaccatgttgcccaggctggtctcgaactcctgggctcaagctatccgcctgattcagcctcccaaagtgctgggactacaggtgggagccaatgtgttccactgaatgccgacagacttctaacaaatgcatcagcaaggcagtaccagctgattaatcaacaaatgaacataaacacagtatatccaacaatgtcactactgatcaatttaattcataactttccagatttaaaggtaaaaaaatatgcttgctaaaatttaaatacagtctttataatgctaagcttggcataaggcacaatctccagattctctttcttttttttttttttttttttttggagacacagtctctcagccacccaggctggagtggagtggcgggatcttggctcattgcctctgcctcctgggttcaagtgattattgtgcctcagccttccaagtagctgagattacaggtgcccgccaccgagcccagctaatttttgttttttcagtagagacgggttttgccatgttgcccagtcaggtcttgaactcctggcctcatgtgatccgcccgcctcggccttctaaagtgctgggattacaggcgtgagccaccgcacccagcctcagattctctttttctgttttccgcttttccctctctcctaccttcttccctcccagtcaccctccacttacctgagctggcttagaaaatcttggggttaaggctgttagtttctggaggaactcacaagcttcctgtagtttgttaagagcttgcaaaccatgaactgctctgctgaagttccctgctatctcatctatgacctattgggaacaaagaagttgtcaaaattactcatacaaaattactgtactgtagtagtcagggagattattttcatccaagttgaccttgggtaactttataaaccctatgaaccacagctctctaaaacagtgattactttcagaagcttttctgcgagtggacagaatttatttctacttcttccatacgatagagaaaatgaataacgagattatataatgattgctccaagggcaaatgagtctggaaataagatttatagcagtaactttaagtgttaaggccatgaagatgagggaaacttggaaattaaaaagccaaaaccaaacttttctattcagaagtatgttttcctctcaggcttccctgtgtgtgtgtttccctccattcaagtattcgtatttaaggctgggcgtgatggctcacgcctgtcatcccagcacttgggaggctaaggcaggcagatcacttgaggtcaggagttcaagagcaacctggcctacatagcaaaaccctgtctctactaaaaatacaaaaattaaccaggcttggtggtgtacacctgtagtcccagctactcgggaggctgaggcaggagaatctcttgaacccgggaggcagaggttgcagtgagccgagattgcgccactgcactccagcctgggcgacagatcgagaatctgtctcaaaaaaagagtccatattcaagaggtaatgacttaaaatgactcatagcaagaggtgggaagcagaaaacctccctgccctaagaaacagactgagcaaatggccgcggtcccaaagcttaagtggctactgcacttgaactcaaagtccaaccctgagacaatcaccattaatgccaactacatggtccatttctggagaatacctcactcacagcctaattcaaccacatattcaagaaatcttgattaaatgctgacattgctaaatcctcttaatatttctaataatttattatagatccttttagatattctgtacttcaggatttccaagaaaaacaaaaacaaaaacaaaaatctttgtttaaactcctgtaggtcagtttctcccccaaatagaacactgaatttccattaccattgcaagcagatccagagtgaacaggattgttttagcagggaaatgttcaactgcatataaacagggctcgtttgagtttagggaaaaaaaagcatgagggaagcaggattattttcttcagtcaatactgtcaaagggactttgcctttttttgagagagagttttgttctgttgcccagcctacagtatacagtggcacaatcatggctcactgcagtctggacctcccaggctcaagcaaccctcccacctcagcccctgccccgccacccccaagtagctgggactacaggcacatgccaccacacctggctaatttttttttgaagtttaatagagaaaaggtctcataaagttgcctaagctggtctcaaactcgggcttacgtgatcctccacctcggcctcccaaagtgctggaattacaggcgtgagccactgtgcctggctaatttttttgaactttagtagagaaaggtcttgctacgttgcccagtctggtctaaaactcctgggctcaagtgatcctctcaccttggcctcccaaatgctgggattataggcgtgactcagtgagcctggctgccttgtccatgtttttgggaggaaggaaacaaggcggagagaggggacagtgagtaggaggaattgtctagaggtttgctgctgctgaaaaagcagggtaggtgaacagaacttcttccccatctgaagcattaaatagaatagcattaaatagtgtcattaatgaaacgttgggctgtatatgtgctgtcaaattggctgtttccatggacttgtttagtttttgttttggattggcatatacgctggtctgtcaggcattcttaggtgtagttctgcagggaggcaaatgggtgaaccaagtactttttgggggtcacaaagctacctgtgacttgaatttcccatgtttacctgaccagatgccttctgcaatgacacttgtagataagaggtgaaggtattcggatgaccttcttcctttgggcttgaagttgtttctgccagagattgcccagcatgcgtgacagacacgggcatggtgagctgtgttatcacagggagaggctggctgctgggttcagatgcggctgatgttacctgtgatgtgatacttgatagtactgaaggaaactggctgatgggatgacacagggtcttggactaaaagataaaaatatgtaaaggaaaagactgaatctgattttaccattttataattaaggcagcatttccccaaatactctgaaactctgtcctatgagatactaataggcatttctgttaaaaaaaattctgtgctcaaacagaattttgaaatttcaagaaatctgcatattacttgagattcatgatttatattagtgtatttattgtcaatcgttcaataaattcttaaacatttataagttgctaagaatgttctagagaactgaatatggcaatgagcaaaaggagccaagttcctgcgcttgtcgagcccctgtgttagtggtagaggcagagaaacaaattatgtcacatattaaatacgtgctatgaagaaaacaataatgctaagcagagagaaagtggatgtcatggaggatgttcagtggtaaggagaggattttttttttttttttttttttttttttgagacagagtctcactctgtctcccaggctggagtgcagtggcacgatctcggctcactgcagcctccgcctcctgggttcaagtgattctcctgcctcagcctcctcagtagctgggattacaggcgtgcaccaccatgcccggctaatttttgtatttttagtagagatggggtttcaccatgttggccaggatggtctcgatctcctgaccttgtgatccacccaccttggcctcccaaagtgctaggattacaggcgtgagccactgcacccggctgaggagaggatttcttgagactggttgtcactctgtcacccgggctggagtacagtggcacaatcatggctccttgcagccttgacctcctgggttcaggtaatcctcctgcctcagcctcccaagcagctgggactacaggcacacaccaccatgcctggctacttttgagatggagtcttgctctgttacccaggctggagtgcagtggcgccacctcagctcactgcagcctcctcttcccggttcaagcaattctcctggctcagcctcctgagtggctgggactacaggaccacatcaccacacccggctaatttttgtatttttagtagagacagggtttcaccaccatgttgcccaggctggtctcaaactcctgacctcaagtgatccgccacctcggcctcccaaagtgctgggattacaggtgtgagccactgcacccggccttttttcacttttttagacaggatttcactacgttgcccaggctggtcttgaactcctagcttaagcgatcctcctgcctcggagtcccagagtgctgagattacaggcatgaggcactgtgtctgatggagggacatttttgctgagttgaatacagggagagagagagctctgcccataggttagtgacggtatgtgaggagtgcaaaggcccccaagcccacagccagctagctctgaggaagaccaaggaagctagaggagtgatggtggcaggagggggattcaataagatcccagggccaggggagtgtcatatatcaggcagttgaagggaatgcagatgttatttttaatgaggcaggaagacaaagggctttgcagaacagtggcatgatttcacttgttttcacggatccttctgtgttttaaatgatcaaccattctgttgagaagggtcagaaaagggggcaacagtagaagcagatcagtaggaggcaaatgtaaaagttcatttgtaaattttttttttgttttgaaatcgtgtctccttctgtcacccaggctggagttcagcggtgcgatcttggctcaccgcaacctccacctcccaggttcaaggaattcttctgcctcaccctccccagtagctgggattacgggcacctgccatcacacccggctaattttcatatttttagtagagatggggtttcgccatgttggcctggctggcctcgaaatcctggcctcaagtgatccacccaccttggcctcccaaagtatggggactgcaggcataagccaccgcaccaagccagcaaacgtgaaagttcagatgggagatggtgacttggaccatgtggtgatcgtggtgaccatggtgagaaggggttagatttgggacctgtgaaagactgcaaagtcctatagtcaaaagcctttgttgtcttctcttccagcaacatattataggggtggcaaaactccacctccattctcttagggctccagctgggcctgagaattaaactaacataagataaacgggagaaaagcacacacatttattgagtccaagttttatgtggcacaggagccctcataaaaaaaatgaagacctgaagcagcagttagagtccatctctcctatgctgaattggacaaatagttgtgaagaagtgaaattatgtggggaggcttaaaagataagcgttatcttaacaagtcctgtgcagaattctccaggtcttgacttctcctggaggacaacaatgttgcatatttcacaagagaattttaccttgtttttaagaaacggtaccaaggtcagagtgctgtttttgcacctgccatttttcaaatgcctttaactgaaatcatcaatatagcagagtggcatatttttatctctttcaatttcaagggctagtggttgttgctctgcagaaaacagcgtgggaaatactgagggtttttttgttttgttttgtttttgagatgcagtctccctctgtcgcccaagctggagtgcaatggcacaatcttggcccactgcaaactccgcctcctgggttcaagtgattctcctgcctcagcctcccaagtagctgggattacaggcgctccaccaagcctggctaatttttatacttttagtagagacgaggtttcaccatgttggccaggctggtctcgaactcccgacctcaggtgatccgcccgcctcggcctcccaaagggctgggattacgggcgtgagccaccgtgcccagcctctgttcttttatactgttagaaacacttatttttgcagcgagcattgagtcaaacaaatgcatatctgtgtttaggcatcaactaaagggtttctacataggacacaagggcaagaatgctgagagatttcttgaaggtgaaattttatagattatgtggacagtttctacctttatttcctttccctttctgttagatgtttacgttttattgcattgtatttttgtaagatgccacaagtcctttctggaatgaagcagggaataaatacccaaccaacaaacacttgataattacatcagcatgaaagccagaaagagaggctttaaaaattccaagtttggaggtggtggctcacacgtgtaatcccagcagtttgggaggctgaggcaggtgaattgcttgaggtcaggagtttgagaccagcctggccaacatagcaaaactccatctctactaaaaatacaaaaattagctgggtgtggtggcgcaggcctgtaatcccagctacttgggaggctgaggcaggagaatcacttgaacccgggaggtagaggttgcagtgagccaagatggatggcaccattgcactccagcctgggtgacaaagtgagaccctgtctctcccaccaaaaaaaaaaaaaaaaaaaatccttgaatgaagtacctattaaatccaatttttttcttgcacgtaagtactttattttccttattagaaaactatattcagaacactctacaagatagagctctaaccagatctactaggtatgacaaagagatcaacatttcacaatgtatgttgtcaagggaagcacttacaagatgagcaggaagaggatagtgacatgtggttggaagatgaccaggtcctatagaaaaaagaaagcagactaagttcaagtaaaagcctaagacagaaatattcgttttacttgaggacttcttattcatggctaaaaataatgcaaattgttttacatagaaaaccaaggccggacatggtagctcatgtctgtaatcccagcactttgggaggctgaggcaggcagatcacttgaggtcaggagtttgagaccagcctggccagtgtggtgaaacccctatctctactaaaaacataataattagccgggcgtggtggcggatgcatataatcccagctactcgggaggctgaggcaggacaattgtttgaacctgggaggcagaggttgcagtgagccgagattgtgccactgcactctagcctgggcaacagagctagattccacccccaccccctgccaaaaaaaaataaaggtaaggaaggaaaagacaaaagggaacctatgatgatcactcgaggacctgggaatggaatccagaggactccaaggaaagcacagccctgaaaattatcaacaacaaaatccagaaaaaaagttcagaaagctgttaatacatccttaataagaacatccttaatagaacgaaaaaggttatttccccaaataaaaggtctcacctatttattactgcatcagcttatgagtgaagaacacagaaacaaagagaaaaaccattttcccagtaaaaaatgcctgaacatatgggacattttcagcttgaaaaggtaagatgacagtgattgatacagggacgaccttgattgatacagcataagtatatgtgccatcttaacgtgcagttccttacagacccagcatgcctgttctccagtgtctcctcttggagttgtacctgattttatcaccggtttcatccgaatccactggggaataaaatgattttgcttttatttcttggccaggaatcacatgatcctgaaagtcttgtgagaagacatggcaagaaaccgagtcaaccacacccaccatgatgatggagaaaggtagaggtaaccaaacaaaatcctaaggataaccacttgaagctaacatgcaccagaatgaggtacattaaaagaaaaataaacgatatcaaaggatttcaagatgacaaaaaaaatactgtagaaaaattaaaatccacatgggagggaatactgagcagatgtggaaaaattagtccctgatatggaagataaatgtaaggtgctctcctaacaacaaaaagggtgataaatacgaaaccattctttttcatttaaagagtacaggaaagacacagagggtaggaagcagcaatatggcacgtagatatctggtatttcctaaggacaaaaccacaacaaatgaaatagaagtgatacatacgtaggatattcttgattcaaaaaagatgtgtatatgtagcatcatgttctaagcacaattagtgaaaagtaacctagatacacactgagaaaatttctgaattacaaaaaacttttacaagcaatctgatagagattttaaaaggatgcctggagtgcggtatggctctaacagcctctaactcctggatttaaactatcctccttcctcagcctcctgagtagctgagactataggcatggaccaccacatctaatttttttaatttttatttttaaaagttttttgtagagacagagacccagtatgttgcccaggttggactggaactcctggcctcaagcagtccttccaactcagcctcccacggtgctgggattacaggtgtgagccaccgtattacacccaagccacacctaggattacaggtgtgagcaaatgtctgctgaggggagatccagcccgcaaactttttaaaggaccctacgtacataaatattaggcatattgcttgttaggtaaattgccccacaataaggcagtctacatttttcccaatgaggagattttaaaaagtattcctggggcaagcttgacaatataaacttaaaggatataggtgaaatagtcaaatgtctatttaattcagtaatttagttttactatgacacttaaagccacatgttacgtaaggtaataatggaagcattgctctcactaaactcacattgcgggacacagcttaaacatttcaaatgtgtctttaacatcattgcattaattatcatcagaacaacttttggatttaacagttttccaaaatatgtcatctttacttccacctaatgctatcactaaacattttcctacaactcacaagtcccaatttacaaaggattgagaaaagctggattttacatttgttctttaaatatatattcatgtctctaaataaaaccttctatattgctaagtgatatttaaagggtttgttgatcaggacatctaacatttgcagctgtgaggtcataccccgaagagtgatcacgagatccactttaaatcgatctgtttcacttctttctttcagttgatctctataaccacccatccaccgatattgattgccgtcatttcaggctaatgcatccttcccaaatagtacttgtttttcaaaattaaataaacaagtgataacaccataatttgaaagactttgcaagaactttaagacgactactttgttgatgaaaaattttgtgggaataaaaccttgtcttttatttgggaatatatgaaaagacggcggccaagggcatatcaagaaaacacatacataaaatgaaggcaaagactgccatattaagatcagacagaatagaatgcaacgaatattgggcacatgttataacacatttcagcattaattcagtcttgtgcattcttttagcagaaattgattccacggatttttaaggttactagaggagtaacgcattacctgggggcattttgtctcttgctattgcaactcctctttttgtcttcttgtgtctctggtacaaatgggaattatttccatttctttcataatgggcatctccgtccaaaaagtcacctatttgaaagccaacacacaagttaatttataggttatagctatggctacaagtctataaaaccatcattacatgcacgtatgtgataatcaggaaaacacaaattaaaaattcctatccagttttttaaggacactaagaattctgcagtagcccttttgctctgctcacattatggtgtcccacatttcaaattaagttcactagttgggtcaacactgagaagttcattaacccatttatgcctagtgttccattattggaacactaggcatgtggagttatttacatcctactgcttaaggtcatcgccagggtctgatttttcaccaaaaaagtttgcaacctccagcataaatggaaaattccatactaagcgtaatattctcctttgagttctgtaactctcattggtagagataaaagagttcagaaggtggatgataacattcttttttttgagacaatttttgctctgttgcccaggctggaatgcaatggcacgatctgggctcactgcaatctgcaccttctgggttcaagtgattctcctgcctcagcctcccgagtagctgggattacaggcacgtgccaccacgcctaattttttatttttagtagaaacgaggtttcaccatgttggccaggctggtcttgaactcctgacctcaggtaatgtgcccgccttggcctcccaaagtgctaggattacaggtgtgagccaccacgcccgtctggcaataacattcttgaacatgcctccttgcatacacgagcaagagtttctcacacacacaattggacatggctagagaaaatcatataaccatgatgactatggctcagcttaaattcgctatcgtgaagctcgagcagcctgccttcatactgcctggcagtcatactgtttccactctcccaggtgactcccacttccctctctctactcaacctccaacacctgggagcctccctcagtctcattcttaggtcaggtgataaccttgctttctaactcaaggggaatatcaaagcaatttagagtccttccatgactctgaccatcaaatctagctgtctaccagcacctgtacctgtagcgagacaatgccttctctcatgctgctacaaatcttcctactcctacccaaagtgaatccctctagttgtttggtagctcagattaagtacatcattcctgcatgctatttcttctgccttaaaaaaaacccagcaacttatattggcctcatgaactattgccccagctgtttcctgctcttgagcaaaattaccttaaaaattgtccaaacttatcagctccaattcttctcctcccctctttttccctacatttagggattgctttttacaatgttaacaggctgggtgtggtggctcatgcctgtaatccccgcacttagggaggccgaggagactgtatcacctgaggtcaggagttcgagaccagcctggccaggatggtgaaaccgccgtctctactaaaaatacaaaaattagccgagtgcctataatcccagctacttgggaggctgaggcaggagaatcacttgaacccaggaggtggaggttgcagtgagccaagatcacgccattacactccagcctgggcaacaagagtaaaactccatctcaagaaaaaaaaacagttgacttaaatttgttttataattgctttagtctgttttgcactgctataacagactaccacaaacagggtaatttataaagaacagaaatctaatgctcacagttctggaggctggacgtccaagaagaaggcactggcacttggagttgggggaaggctgcaacctcgtaaggtgaaaaggcaagagaagccctccctctgccaagtccttttataagggcccctaatcccattcacaagggaggagccctgtaggccaacccacctcttaaagccccacgtcttaatgcgatcacattggcaacacctgttttggaaggggcacattcaaaccatagcaataattatggaaaacatttaaagagttccaatgccaaactataaaaccaggtacatttcgaaaggtctcatttccatcttcatcctttctgccctattttctctctccctcataggtaaccattttcattagtttttgtttctccttctgttatatttatacgtacgtgtatgtatacaggcaaatatatatgttctgtacctttattttccactaaaaaaatacatcatagagataaccccactgcagtacatggagattgttgttatttgctttttacaaccagttccctcttgatgggcatgtggattattcctacttttttctatcacagagagctacaatgaatagccttacgtgtgcatctttttgtacttttgctggtttgactttgggatagattcctagcagtggacactgggtcaagggtagatgtatatgtaattttgctagatattgctgaattcccctttatttataaatatatacagattatatcttactgcattctcactagcaacttatgagagtacctattttcttatggccttgccaacggaaagtgttgttaagtttgtggatttatgccaatctgataggtgggaaagggtatctcagtttatttttaatttgcattacgctattttttttggcaaaaatactgtgtaagtgatgtgtatacttacatcagtgcatttttcttttttttaaaaaatgtaacttattattttgagataattgtatattcacatgccgatgtaagagaaaatgcagagagatgcctttatccagtttccaagggtaacatcttgcaagggtaacaacaggatatggacgctgatacagtcatgtcaaaattttttttcaattgctataagaatccctcacattgacccacctcccccgcctttttttttttttttttttttttttctgagacggagtcttgctctgtcaccaggctagagtgcagtggcgcaatcttggctgactgcaacctccgcctcccggttcaagcgattctcctgcctcagcctcctgagtacctgggactacaggtgcacaccaccacgcctggctaatttttgtatttttagtagagactggggtttcaccatgttggccaggatggtctcaatctctttacctcgtgatccacccgccttggcctcccaaagtgctgggattacaggcatgagccactgtgcctggcccacattgtccttttatagcgacgcctacttccttcctgcccccatgcccttcttagaccccgacaaccactaatctgttctccatttctatcatgttatcatttcaagaatgctcaataaatggcaccatagagtacgtaacattttgagattggctttgttcacttggcacaattctctggagattgctgtgtgtatcaatagtttgtttctttttattactgaattggactccatggaatccaattcaacaaccagagggattcactttgggtaggagtatgaaggtttgtagcagcatgagagaaggcattatctctctacaggtacaggtgctggtaggtgggtagatttggtggtccgagccttggacggactccaaattgctttgattttttttttttttttttttctccttgagttagaaagcgaggttatcacctgacctaagaatgagactgagggaggctcccagttgttggaggttaagtagagagaggaaagtgggaaagagtcacccgggagagtggaaacagtatgactgctatggctagaccacagtggtttaatcattcacctgttgacagacatctgaattgtttccagttttgttctgttatgaataaagctgctataagcatccatatacatagttttacgtgagcacaggttttctcattctgcgataaatgcccagcaattgctcagttgtatggtagttgttttttttttaagaaatcaccaaggccgggcacggtggctcattcctgtaatcctagcactttgagaggccgaggtgggaggattgcttgagtccaggagttcgagaccagcctggacaacataacaagacccccccccccacaaccactccccactccaccgtctccacataaaaaaataaataggctgggcgcagtggctcatgcctgtaatcccaacactttgggaggccaaggcaggcggatcatctgaggttgggagttcgagactggcctgaccaacatggagaaaccccatctctactaaaaatacaaaattagccgggcatggtggcacatgcctgtaatcccagctactagggaggctgaggcaggagaatcactggaacccgggaggcggagcttgtggtgagccgagattgtgccattgcactccagcctgggcaacaagagcaaaactcagtcttggaaaaataaataaataaataaataaataaataaataaatacaacaactacacacacacaaatgcatacgtacatacatacatagcttaatcctgatctacttctgcagaggcgaacctcggataacagccctctcaccgttcgacttctcatcttcctctgccttattctcttctcctccttctctttcccatccttccctctgaagcccaaatgctgactgaattatgagtgtgcatgtggaaaatggtgtcaccaatacaatttctcccacactctgcccaagtcaaaacacgaggaggacatcaaggcacaactcttccaactcccagtggggatggatccaaggaagtcactccagataattttctcatgctaatcagcatcatgaaaatcaaaagccctgtatcatcccatggtctaacactcacagactatttaaccaatattctcacatgcactccttatttagaatcagtttctaaaatttgggtctttggcagcatgtagctttatcacttaccagtctggcaaatgaaatagtatttcagtaagcacttgtcccctttggatgagatccgaatgaagtttctggacaggtaggtgcagctgaggggctttgggggcccgttggctgcaacgtctgctgaggggagatcagacgcagatgagcctcatactcgaaagccaggcttttaggtttattttttattattgtttttgagacagtcccactcagtcacccaagctggagtgcagtggtgtgatcttcactcactgcaatctctgcctcctgggttccagtaattctcctgcctcagcctcccaagtagctgggattacaggcacccgccaccacgcccagctaatttttgtatttttagtagagatggggtttcaccatgttggccaggctggtctcgaactcctgatctcaggtgatccatccacctccaccttccaaagtgctaggattacaggcgtgagccaccacacccaccctgccaggcattttttaaaagtaaatatgaaagccaaatttgactgacttccaatagataaaaatgtagaatttcctcccatacattatagtttattttttcatatgtgttccttaccacaaggcttagtattactttatctacacgttaatgaagatgatgagaatgatataataatggcttggatttgtctctaaaacttcaagattatggtgcataactttgaaaacactttgtaagggccgggcgcggtggctcacgcctgtaatcccagcacttttggaggccgaggcgggcggatcacgaggtcaggagatcaagaccatcctggctaacacagtgaaaccccgtctctactaaaaatacaaaaaattagtcgggcgtggtggcggccacctgtagtcccagctactcgggaggttgaggcaggagaatggcgtgaacccgggaggcggagcttgcagtgagccaagatggcaccactgcactccagcctgggcgacagagcgagactccatctcaaaaaaaaaaaaaaagaaaaagaaaacactttgtaagaaagacaataggtagatactcttcctcttagttttgtgttaggaaacttagagatcagaataatgaagagatgtttattaggaaaaaaatgaccatcaaagtttctgtctttggaacgtagcataattcttttagtgaaaggtcaggtaagttaactttagatgggttccaggaaaaattgcatcatttttgctaacagacaaatcaaaggctgtcgcacaaaatggaaatatttcagaggaaagatggtaatgaagtaaagtgactggtttttctgtctacaaaagcagaaagattaagattttcttttttttttctgtcccagaataaaatataaggaagtttccttcataaacactgaaccccagggtcttacctgggtatttgttgtcttgatgctttttcaatggcattacattttgcccaatccaccacttctttccttcttccagatagtcccggatgagatcttgaacttccttgttccaaatatgagctaggaatcctctctgcacatgacagtaatgctgtgcttcctcaaagctgcattgaaatctgttaagctggtaacaattattttgcccatgtggtgctgggctgtttagctcacttcctagaataatacttgttctgatgtataaccaaagccagcttcctcctttgaagaacat

SEQ ID NO: 590 - DNA, 17187 bp, Homo sapiens
cgcaagctgggcggaaccggaagatggtgtgagccacgggctgccgggggcctggggctcggcgtcggtccccgggggatgtggagagctggcagcatgtcggccgagctgggagtcgggtgcgcattgcgggcggtgaacgagcgcgtgcagcaggctgtggcgcggcggccgcgggtgaggaaggaggctgcgtggggacggtgggcggccgccttgagaagagggacacctgcgtgggaatgggtcgtcacggtgacgcagaggggtctcccagagaggcgggactggtcggccgcctagggccaccgaaaggctagcgaagggtttccccagcctccttaccttgagtctgttaggttttctggagattggcttcgttggagcagagggtaccgctacctcgggaaaatgacttagtgcctaggtgtcgtggccacttgcgcaccgcgtcgtttcggggtcgatagccttggcggatgcgaggggggccaggcctgtgcccacggatggtaaggggagacgggggtacaagagcaccccgcggaggccagagacgcccgagatcgcgtgtgtggcagcgtctcacctgctaagtgcccaagaaatgccagtgccgcccggaggccgaggtgagggtggactggccggacttcgctggcatcagagcggcacttgtttatggggcaggagggagaagtccaatcccaagccggttaaggggagctttcgtcttttgtgtatatatatattacatcctcttggactttgattagaccaagaatcaaaatctgcccacctcagtgcaagtttaagctgaatggtgtggaatgagacggaccttaacagagaggtcacaggtttctctgatcgagcatttatgctggctgaagacaagacctgtattatagtctttctttgactattccttagacgttaccttgaacaagtcaggtaactattccggccctcagctctgaaagctctgagatctcttctgatgttaatattctgtgattctcggtgattctccaagaaaaatctagggcttcccctaataaacatcaccttggaggttctctcagggaaactctcaggcagatgggctgcctgttcgggtaactctctggaaagcgtcaatcatcagcatactcccagtagtcacgacttggactcaaacgaggctggttacgcatcgctgtggaaggaaggaagaggagacatttttctaattgatctgactccgtcacgtccttgagaacactgtgattctgtgaaaacttcaggggatgatggatacaagaagactaaatcgtgcaaggataaacgaatctcttctcttactgtttctatgtggattgggtggcagcagaacgcatagaacccccgctctttgtatagtggtcgtgagaggatgtcacataggtctgatcctgaatccagaattttttgtgtcgcagccttagttctgccactggttcttttctttctttttttttttttttttgttgtgttgttttgttttgttttgttttgtttgagacagagtctcgttctgtcgcccaggctggagtgcagtggcacgatcttggctcaccgcaacctccacctcccgggttcacgcaattctcctgcctcagcctcctgagtagctgggattacaggcacacaccaccacacctggctaattttttgtgtatttttagtagagacagggtttcattatgttggccagactgttgttttttgttttattttgagacggagtctcactctgtcacccaggctggagtgcaatggcacagcctcagctcactgcaacctccacctcccggattcaagcaattctcctgccttagcttcccaagtagctcggattacagatgcccaccaccacacctggctaagttttagtattttaatagagatggggtttcaccttttggccaggctggtctcgaactcgtaacttcaggtgatccacccacctcggcctcccacagtgcagggattacaggcgtgtggctcacctggccatgccactggttcttaattcacagattgaacaatcaattacttagttacctaagtgggccacttttagagtaaatggggcagtgttattatggtgtaatgatacaccaggactagaatgagtcgccaaactgctaacgtttgggtttcagaagccagaagtgacctctcttttacttagagtgcagccttctattaatgaagtgattcttaagcctccaacattagtatgtcttagagtcatctggagagattgttaaaaaggaaattctccgctgggcacagtggctcatgcctgtaatcccagcactttgggaggccgaagtgggcagatcacctgaggtcgggagttcaaggccagcctgaccaacatggggaaaccctgtctctactaaaaatacagaattagtcaggcatggtgatgcatgcctgtaatcccagctactcaggaggctgaggcaggagaattgcttgatcacttgaacccaggaggcagaggttgcggtgagccgagatggcaccattgcactccagcctgggcaacaagagtgaaactctgtctcaaaaaaaaaggaaattctcacccaggtgatgccgatgcagttggtcaaagaccacacttacaggaaatactgctttaacttgcccggctctcctgagagagacatttcttctgctgaatattgacatcgctaacattgatgcatagattgagatgccatgcgcctaaaaaacatttgatcatgatcaccactatttgatattgatctgcctacagtgttgaaaaaatggatcttacctaatgccaagttgagatcaatgcctgtctatcctacaggatctatcctatgggattcattggggtactgttcccaaacattcactcatatggctctttccctcttggcaggatctcccagccatccagccccggctagtggcggtcagcaaaaccaaacctgcagacatggtgatcgaggcctatggacatgggcagcgcacttttggcgagaactacgtaagagccctttcctgaagccctttggaagcatcatgattgccaggcttctgacttgttctgttttgaccttttaggttcaggaactgctagaaaaagcatcaaatcccaaagtaagtagatagctgaattctttaatttgtatctaaatcttggctctttagttgaaaattagacccatcctggtggttgagttgtacagcagttttagggtggttgactttagattgggccagggatagaaatgtcagcttcctccttgagccccaagtaattctcagctagatttttctctttgttcagactgtcgttttctcattggtggctgtttggaaatggtggtttcaggagcttgctgtaatcttggatcttttcaagatttgaaagcttaaatcagttcatcctagatgggcaatatctgaaagatggagggaattgatgggaacaaggaaggaaaacagaacagaagccttagatttttctctatccttttacctcattaggaggccgggtgaagattgtgatagtttattacatttaaggaacagagagtggatgtgaaaggtgacagggagtgcacgaggcgtttgagccagcaaggcctctataaaatctgaattacacatggttacctttttcccctcagattctgtctttgtgtcctgagatcaaatggcacttcattggccacctacagaaacaaaatgtcaacaaattgatgggtaagataaaattaaatatgaaaacaaaattgttctgtcattgtattgcttctactaccctttgtggaagagagagcaacttttagaatagccccaattcaccatttgtttttggaatttctttaggaaagtctgagttcttaataaaaagagaaaacatcatgccaagaacagaatgaattcaccattttctgggttatatatacttggaaacctacccaacctcatgtttattattatttggtggtctttcagaaaaattataaagaattgtagcccataaatttttttaactagcaaaagagacatttctgttctttttcctttaaataaaaggctacagtaaataaaatacaatacagtaaagtaagtatagtaaagtaaaattaagaattatagtaaagtaggccaggcgcggtggctgacacctataatcccagcaccatgggaggccgaggcaggcggatcacctgaggtcaggagttcaagaccagcctggccaacatggtgaaaccccaactctattaaaaatgcaaaaaaatagctgagcgtggtggtgcatgcctgtcaagtcccagctacacaggaggctgacgcaggagaatcgcatgaacccgggaggcagaggttgcagtgatccaagatcacgccactgcactccagactaggtaacagagcaagacttcatcccaaaaaaaaaaaaaaaaaaaaaaacaagaatcatagtaaaataaaattaagaaagacatggagatcttgagtaactgaacttatttcccttaaggtataaaaatttaaataacctgtatatattttgtaacagctttattagggaggtaagtgacttacaatacattgcacatatttaaagtatagaattcgacgagttttgatgtatgtttgcacctgtgaaaccatcacaacaaacagtgagcatatctatcacccctaaaagtttcctcctgtcccttggtaatccctctcttacctgtcccacttctcttcctcaagaaccacttacctgcttttgtcactgttaatgtacgtgagtttacattttttagagttttatccaaagggaatcatgaagtatgtactcttttttgtctgacttctttcattcagtgtagtgattcatcatgttcatacctgtatcaaaggttcaattctttttatcattcagtagtattccattgtataagtatattacaatttgtttatccattcacctgttgatgaatgttgggttgcttctgatttttgactgttgcaaataagttgctatgaatatttgtgtacgagcctttgtatggatatatttccctttttcttggaataaatatataggaatagaatggctgaatcacaagttaagtgttatgtttaactttttataactgcaataaaacaaacataaaatttactgtcttgatcttttatttacttttttttttttttttttttttttgagatggagtctcgctctgtcgcccaagctggagtgcagtggcgtgatcccggctcactgcaacctccaccgcccgagttcaagcgattctcctgcctcagccttccgagtagctaggattacaggcacatgccaccacacctggctaattttttacgtttttagtagagacaaggtttcatcatattggccaggctggtctcgaactcctgaccttgtgatccacccgcctcagcctccgaaagtgctaggattgcaggcatgagccaccatgcccggcctattgattttcaaatgttaaaccaaccctgcactcctaggataaatcctacttgaaggctgggtctctattaatcttattatatgtcatataaacaaaataactgtgttatgggatttataactatgtaaaagcaaaatgcatgacaacaataacagaaggggataaacagaagtacactattgtaaagttcttaaactgtgtgaagtagtgtaacacaccttgaaggtggactgttgtaagttaaaccccaaagcaaccaataaaataacacaataaagagttatagcttataagtcaacaaaggagatatattggactcaaaaaatgtgaaatggtatctccttacagttttgattttctttttttttttttttttttttttttgagacggattctcactctgttgcccgggctggagtgcagtggtgcgatctcagctttctgcaacctccgcttcccaggttcaagcaattcttctgcctcagcctcccgagtagctgggactacaggcgcccaccaccacgcccagctaatgtttttgtatttttagtagagatgcggtttcaccatcttggctaggctggtctcaaactccagacctcatgatccgcctgccttggcctcccaaagtgctgggattacaggcgtgagccaccacgcccggcggttttgattttcattaataacgaatgatgttgagcatctcttcatgggcttattggccatttttatgtcttctttggaaaaatgtctagtcagtcctctgcatgttttttaaattgagttgtcttttcattattgagttgtaaattccagctagattaaataatctaacttgaaaataaaagctataaaagtattagaataaaatgcaggaaaatatttttattttcttgggcttttctaagcaagacataaaatctggaaaccataaaaaaaacaactaggccaggcacagtggctcacacctgtaaatctagcactttgggaggccaaggcaggtggatcacttgagcccaagagtttaagaccagcctgggtaacatggcaaaaccctgtctccactaaaaatacaaaaaattagctgggcgtagtggtgtgtgtctgtggtcccagctacctgggaggctgaggtaggacgatcacctgagtccaaaaggttaagcctgcagtgagctgtgattgtgccactgcactccagcctggatgacagaggagaccctatctaataataataataatattaataataataaattttaaaagaacaactagcagatttgatcacacaaaaattaaagctttctgcatgtcaaagcaaaagggaggcacagagtggaagaaaaataatatttttgaagagggaagagattcatatccagaatacataaagagctacaaatctttttgtttatagggaaaaaaaataggcaaaaactggggcaatttataaggggtaaaaatacaaaaggccagtaatcaaatgaaaaatattcatcctcagagaaatacaaaatcactaatcagatttgtaaaaaatcaaaaagactgctaagatccagtgttttgagggagtgagtaaatgagtactccttcgtcttaccaggagattctaaaaccgtagagtcttggaaaaacataaagattccaccaaaaaactattataactgaaaaacaacttcagtaacattgcaggatacaaaataaatatacaaaaatcagtagcatttctatatgccaacagtgaatgatctggaaaagaaatcaggaaagtaatcccatttacaatagctacaaatgaaatacctaagaataaacttcaccaaagaagtgaaagatttctgcaatgaaaactgtaaaacactgatgcaagaatttgaagaggacatgaaaaaatggaaagatattccatgctcatgaattggaaaaatcagtattgtcaaaatgtccttattgcccaaagcaatctacagatccagtgcagtccctatcagaatactagtgacattcttcacagaaatagaaaaacacagtcctgaaatttatatggaaccacaaaagacccataatagccaaagccatcctgagcaaaaaacaaagctggaggaatcacattacctgacttcaaattatactgtagagctatagtaaccaaaactagcataaaaacagacacatagaccaatggaacagaatagagaactcagaaataaatttgtacatctacagagaatttatttttaacagaggtgccaagaacatacattgggaaaaggacaatctcttcaataagtgctgctgggaaaactagatatccatatgcagaagaataaaactagactcctatctctcaccatgtacaaaaatcaaatcaaaatagattaaagacttaaatctaaatccaagacctgaaactactaaaagaaaacattggggaaactctccaagacattagtctggacaaattttgtttgtttgtttgtttgttttgagacagggtctcactctgcacccagactggaatgcagtggcatgatctcggctcactgcaacctccatctcctgggttcaagcgattctcctgcctcagcctcccaagtagctgggattacaggcacgccccaccatgctggctaatttttgtatttttggtaaagacggggtttcaccatgttggccaggctggtctccaattcctgacctcaggtgatccgcccacctcagcctcccaaggtgctgggatcgcaggtgtgagccactgcacctagccatgttagaaatatgtaaaggtgatgggaggagggagcggggaaggagccagcaggcatagaaggggcaggaaaacctaacagaactgttgttttagtgccattttcccttctggatgatccgttatactcattcaacctcacagctcaattcatttccataaaggcttcttgaggccagatgcagtgactcacaccagtaatcccaacactttgggaggccaaggtgggaggatcacttgaagccaaatacatatatgtatatttctttcttttttagtctttctagtcttgctctgtcacccaggctggagtgcagtggcgtgatcccggctcactgcaacctctgcctcccagattgaaggaattctcctacctcagcctcccgagtagctgggattacaggcatgtgccaccaggcctggctaattttttttgtatttttaatagagacagggtttcaccatgttggccaaatggatctcaaactcctggcctcaagtgattcgaccacctcggcctccccaagtgctgggattacaggcgtgagccacaatgcctagccatctctggctaatttttttattttttggtagagacagggtttcactgtgttggacaggctggtcttgaactcctggcctcaagtgatctgccctcctcagcctcccaaagtgtggggattacaggtgtgagccactgcacctgaccttgacaaagattgcttgagtaaatactccaaaagcacaggcaaccaaagcaaaaatggacaaatgggatcacatcaagttaaaaagctcttgcaggctgggcacagtggctcacgcctgtaatcccagcactttgggaggccaaggccagcagatcacgaggtaaggagttcaagaacagcctggccaacatggcaaaaccccatctctaccaacaatacaaaaattagtgaggtgtagtggtgggtgcctgtaatctcagctacttgggaggctgaggcagaagaatagcttgaacccaggaggcagaggttgcagtgagccaagattgtgccactgcactctagcctgggcgacagagcgagactctgtctccaaaagaaaacaagctcttgcagagcaaaggaaacaacaaagtgaagagacaactcagaatgggagaaaatatttgcaaactgcccatctgaaatacttgtacatagcaccaagttctatatccaagctttgtttttgtaataaaaaataagaaacaatctaatatccattaacgaggaatagttatgtaaactgtgataatctgtcctgtggattgctgcagttttttagtagagatggggtttcaccatgttggccaggctggtgtcaaactcctgacctcaggtgatccacccacctggtattacacgtgtgagccaccacacctggccagtgttagggtcatggtgatgtccttgttggataagaataccctcatcccagaaagttgaagaattgtggtgatatgctagggaagcatcttggcttccactggtcatcctttcttcattgtcatcctgacctgtttctctcagtttgaactgagacatagatcaagccttttactaggaatctgtccgttaccagcttcttgaagcttatggatgtatatgctgcctgatcatgtatgtcagcttttcccttatttacctttgctgattagccagggatggtctgacatttgaatttgtatctagtaaaactgtcacatttgtcttctcagaggaactgagatttaactgtgtttttcttttcctggcatattttttcctctaacaagtcagagatttgttgcatgttacttgctgcaatagagcaaataaggaatactactttgcctctgtctcattacagctgtccccaatctcttcatgctggaaacagtggattctgtgaagttggcagacaaagtgaacagttcctggcagagaaaaggttctcctgaaaggttaaaggttatggtccagattaacaccagcggagaagagagtaagtaaccagacctgaattgtagatttttcttcctttaggatggttgaagcttagggagaatgggtgggcccaagtgtctgatggataaggttatagaaacaaatcacaggatcacaggcctctaagttggctgttttatgtgtgatctaggtagcataatggcatgcaaagcagtctatgtatcattctttactacatcatggttcattatatcttaattttaggggaagaagaatggatggggagttcaagaaggggattgtgacttcgttttgtatttttgttttttttttgagatggagtcttgctatgtcgcccaggctggagtgcaatggtgcgatctcggctcactgcaacctccgcctcccgggttgaagcaattctcccacctcagcctcccaagtagctgggactacaggcgtgcaccaccacgcctggctaatttttgtatttgtaatagcgatggggtttcaccatattggccagactgctctcgagctcatgacctctcaagtgatccacccatctcggcctcccaaagtgctgggattacaggcgtgagccaccacactcagccttttttttttttttttttgagacagagcctcactctgtcgccaggctggagtgcagtggcacgatctcagctcactgcaacctccgcctcctgggttgaagcgattctcctgcctcagcctcccgagtagctgggattacaggcacgcgctaccacgcccagctaatatttgtatttttagtagagacggagtttcgccatattggtcaggctggtcttgaactcttgacctcaggtgatccacccacctcagcctcccaaagtgctgagattaaagacatgagccactgcacccggcctgggattgtgtctttcatctggaaacccccaaaggtcaccatcactcctacaaggagtattttaaatttttaagacctaagattatataaatactcttagatcttaaaaaaattacttgatgttgcattgggagagaatggaagataattactgtgagtgggccaggtgcggtggcttacacctgtaatcccagcacttgggaaggctgaggcaggtggatcacctgaggtcagaaattcgataccagcctagccaacatgatgaaacttcatctctaccatacatacaaaaattagccaggcatgatggtgtgcacccatagccccagctgctcgggatgctgaggcaggaggatccctcgaacccaggaggtgaatattgcagtgatccgagatcgcgccactgcactccagcctgggcgacagagttagactccatctcaaaaaaaaataaataaataaaaaattatggtgagcaccagtcaatgaatatctttatggggcttggattaacagtgtaacatagtgtgaatagaagcatgggctttgaaatcagacagaccttgggtttcagctacactactttccagtattgtaaccttggataagttacctaatctctctgtacttcagtttccttttttggcaatggtatcatgagaatgcttacttcagagggtgtggttaggactgaatatgataatccaggcaacattgttagcacagaaccctacacatgttgttagctattcgttaagaataaatgtatacagatcaggcatttgattgcaaccatcaaagcaccagtattcaccaaatcttagtatgcaggaacacagtagaggcatctgttttctagataacgtcctagagtcagactacctgggtttaaatcccaattatcaatagaaatctgaaatcaactataggtcaagtctttattgtatcatttcttgataattagctataatatgccctatttaaagactgaagtaaatgttactagtatctccgcctaataaatgggggcaagacaatatcaatagctcttataactgtataacaaataattgcttgctgcagatttctcttccagttgttaattagaaagttcagttaaactttgctaatatatagccaaaaatatttaacatgtactttatactaaattttttgcaactccattaaattaataaaactataaaaattcttgatttagaaaagtaattctcaggttcatctggcattttggcaatgcaaatcttcctggtatcccaaaaaagcaagattttttcttttccatgtctcctagctgttttcagctgaaatcctgagatggaggaaagagaatccaactgatagttcttttcttgagaaatttagaacctgaccagaagcagagcaacatagaaaaccccaagtataaagttactctttaggacttgaggctctttcaagaggttctcttgttgggggtcacctcttctgtcgtaaggaagggaggaaaatggagccttcctctggccatttacccttgcagtatacctgttttctgtttcttttcttgaaggtaaacatggccttccaccttcagagaccatagccatcgtggagcacataaacgccaagtgtcctaacctggagtttgtggggctgatgaccataggaagctttgggcatgatcttagtcaaggaccaaatccagacttccaggtactggggggtcggggagattgctcgtgtgctaaagaagcagggtgctggagtgctattgcagggctggctgcagtggggattgcagagtcatcccagacactgcctgttgagtgttctagccctcttttgaactcttctcagaaggaaaagggaagaacaggtttccaaagccccacaaacctttttcaactcaacttgaacttggctaaaacatagtctttagagaatatgagatttcttcctctccagtgactaatagttttctcgaaagtgggatagtttgcaaaaaaccctttcagtaacgtctggcaattttggcaggccttgaaatcataaggaatacataaccgttgtcagagaagttcagattcagacacttttgggcatcgttagagaaggcaggagtaaaataggtgtcatctctttctgtcagctgttattgtccctccgggaggagctgtgtaaaaagctgaacatccctgctgaccaggttgagctgagcatgggcatgtccgcggatttccagcatgcggtgagtgtcctgccagtgccctgtctgcctcgaggggtgggggtagggggtctgagaggctgacacaagagcagatctttgctgtagaagccttggaaatgccttgggatggcagtaaggtacccagtgtcagctattccagcatctcccattccccatgccctttcttttttgaaaagagccaggtgcggtggcgcacgcctgtaatcccagcactttgggaggccgagccgggcagatcacgaggtcaggagttcgagaccagcctgaccaacatggtgaaaccccgtctctcctaaaaatacaaaaattagctgggcgtggtggcgcacgcctgtaatcccagctactcaggaggctgaggcaggagaatcgcttgaacccaggaggcggagattgcagtgagccgaggtcgcgccactgcactccagcctggctggcaacagagcgagactccatctcaaaaaaaaaaaaaaaaaaaaaaaaacaaaagaaagaaaagaaatgtatagaaattatagcctgacatctgaacttttaaaacaaaatataattccgtaagtgtaatctaaaggaaataagaaattaattataattataatttcataaattataaacataattccataagtgtagtctaaaggaaaataagaaattaagctataatttttggaaaggcatttcattacgtaagtgcgtgggcatggctgtatcacagcaaatcacgatgaagcagcctaaggcttcatgtttgtttgtttttttttggagactgagtctcgctctattgcccaggccggagtgcagtggcgcgatctcagctcactgtaacctccacctcccaggttcaagtgattctcctgcttcagcctcccaagtagctgggattacaggcgcctgccacaatgcccagctaatttttgaatttttagttaagacagggtttcaccgtattggccaggctggtctcgaactcctgacctcaggtaatccacccacctaggcctcccaaagtgatgggattacaggcatgagccactgcacccgtccgaggcttaatcttatgtgtagattcaccaacaatcttatatgtacatcaacagctgtaaatatcaactgatacaggtgtgctagattggcaacgcaaatacatgattttctgaaatagcaaataacttgataaagtttcaaaaatcaaaatataaacttgcattcctggaaaattgtatttcttaaaacagtgcaaaaatacattgcattgataagtaaaatggaatttgatcagataattataaggatatttttttcatctacctgaccgtggcacattggagaggtaggtgggctgtgctgtgtggctgcgtctcacactggacgtctaatgtccttgaccccctccgagctgagtgccagccacactctccaaccactggaaatccagagaaacccaacttgtttcctatatatgccctcagaggcaattttacctctgaggagaacaatcatcctgaagccatcttcagctgtgttattattcatagaaggctctgtttttgtttttttttgttttttttgagatggagtttcgctcttgttgcccaggctggagtgcaatggcgcaacctctgctcaccgcaacctccacctcctgggttcaagcaattctcctgcttcagcctcccgagtagctgggattacaggcatgtgccactatgcccggctaattttgtatttttaatagagacagggtttctccatgttggtcaggctggtctcaaacccctgatctcgtgatctgcccacctcggcctcccaaaatgctgggattacaggcgtgagccaccacgccccgtccatagaaggctcttgagagccagaatgggggcacagcttcagcactggctccattttattattttaaacctggtcctcgataccttctcttttttcccacaggttgaagtaggatctacaaatgtccgaataggaagcacgatttttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctcttgggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttattttttatga

SEQ ID NO: 591 - DNA, 738494 bp, Homo sapiens
ctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggtgagtaccttctcagtggcattcttgtcctattcttttttttgtccttttttttggttttttgttttttttgtttttgttttttttctttttttccacttctttgattattgtttatatttgggaaagctggaggagcatggttttgagccttttcctgaatccaagtttttctagcatgcgatcgttctgtagacaaggcgctgtgtctcggagtccgcggcgaccgtgcccgctgggagcgtctcccaagtccagcaaaatgtgcaactggttttatggaaaaagcgatgtgaagtatggtgcctatttttttcctttgtaaaaataaaaagcatgtttctaactctttttttgcatactctttttctgataacatttttgtataggtgggattttacggcagtgtttacaagtttgtggtcttgcaatactggtgcaaaccactgagcaaagacattaattttatattttttgtgccctttttggaagccggtgaaaacaaattcgttttttttccctcctgtttttgatacccattgataacatgaaacttttcttacagctggtgattgggatcatttttaagcaaaatacttttttcctcctttaaattaactatgacttttgcacatttgacttttttaaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcaggtacttggtccccttggaggcgtttcccgggtgtgcagtggcaacactggtcctagcaaagaaatgtgtgagtgtgagtgtgtgtgtgtgtctgtgtttgcgcgcgcgcatctccgggcagtgtccgagcccgaggtggggagagcggcgcagggagccagggaaaaccaaagtccgttccctgcttcaggatcgttttctagatgtgcgcaaaatacagtcccctccccccacccctcccacggtgagctgcgcccaggtcgtctcccggcggggcgggtggcgtctgcgctgcgggccgcgccggccgggcactaggcggccggcgggccctgtaagttctccgagggccacttgcacagcaggaggggcgagggccgtgtacgtggcgctggccgtcgggcgggctagaggggaccctcagagcacccgggagatgggggtagaagcggcagagaccgcatattccggaggggctggctccaggccacgcgagccggagctggagacatttccagagccttgaggatggcaccggccctcgcacgctcaactcctgctcctcctcttcgcaatgagtaaacgacgcagtaggtcctacccagcctattttgctttaccaaagggctttgctttcttagggatgctgtctttggatcttttttttccctgttgtgttgcgttggttttaagtgcctgctggtgtcgtcttccaggggatggggaaatagtttcttataagatgatcacttgggtttaatgttgaggacgacgctgttagtttgcagtaatgaccctacacctctaaggtattaaaaaaatgccttttatttaaattttgttaaaggggcagagttttccctctttttaaccacctgatactggctctaaaggttttcccctgagaactgtgtacagggcaggagtgaggggttggtgatagaggtgatgatttcgtgtgttggtagcactgacgtattcaatgttgaatgtattctatgatattttatgattatcctgttacatgttttcagtataatttagcattacttttcagagacgtaccagttggcaataaaaagccttttctgtatttaacactgtgaccgaatctgctggaaatttttctgtccaaataaatttcctgaaggcatacatcttaaaatctggagagtcaccattatttaaatactttgattttgaagctttgattttcttaccttttccccccttaaatgaaaagcttagctttaaattaccatgtgtatatactttgaattctgtaaaataaacataaagcaaatgaaacaacaactttttacctctcagatgaagttttcttctaggtaactacagaaataaaaactgactgcaacatacagaggggcccatgacaaaggggtttataacatacactggctttttcaagcaaatatttcactgtctgtaacctcagtttgtggaatgaaaggttttacgccttagtttttactctttgtggtcaaaaagtaaggcgtgcaatgggccatttaactgtagaagattaaaagttagtgtaatatctggaaagttgtatatattttttattcacaactcatgcaagtatctcaaaagtctttggacatttcattgtatttcctggcggggaaatacaatgtatgtgagttattttgttctccgagtagcttttctctgtgaaggaaatcctgttgcatttatataaagaagatagtttatgtcactgtctgtggacaccatatttgatatcttgaggtgtatagttctaagatttgaagccaatatgatggcactaagcctgaaattaggattttcttattttgtatagtgagctaattactaaaatacagtctttcatatgcctcaaacagctaacataaaacattaaaaaagccacttgcaacattctgtgattttaaaaatcatttcaattataacaatgtatgtacatagaaatgctcatttattaaaatgcaagacaatttatgtgtataatatatttttgtatgttttatgtattgtaagtcgtttagttcttttaagagagagagagacagagcaagcaagcaagaacttgaatgatcgaacctgcattttcattaagagaatcagttgctgccctaaggttgaggtagtatgtggtttaagattgggcaaagcactagctgtactgtgtgatatttcccaatgagattgaaacaattaatgggaccaaagacgattttaatgtgaggacagagaggtagttgtgctttaatttctgtaacttaagatcattctaagaacctttagttatctatgttttcatttatttaagattcatttttaattatattgtagacttgtattacatttctatctattacattcaaatttttcagatttcttcctgtgtgaatcattctgggaattctacaactcttaaactggccacctgtttagtttttgatttaaaattgttgaaggtagtatcctagatttagcaccgcctactggcttctcatggaaaaaatgtattttttcattcgccaagcgacccacagggatttagatcaatttaattgtgcagatcttttcaactgcttactaagcgagaaggagggaaaaaaaagtttctattttgtaatgagagagggtttccaaggtaaaggtggggactgagggaaataagacccacaaattaaattggcattggatcactatctgacctcaaacattgtactatctaaactgtgacaaagaaataatcacaaaatgaaaacctgttaaattttcaagaactttttatgggataataaaatgtgggtattgtttaaaatcttggattactaaattaatttttcaatgtctatctcagtcttgatataaagaaagaaagttctagttggaattctgtcttgagtgtgtggtctgttgaagaatatttaaatgaataacttttcatcattgaagattaacagttaattatttttcatatttattttttatggtcataatcaagtaacaccctgatttttttcttaacatgcatcaaatagccacaccgtggtggtgtatatacaagggggaaaagttccaaacataaaattataaagacacatccttagccataatagatgtgttacctttcttaaaaatgataattggtttattttctctaatttatatgaaagtctagtggttaaaagagctactataataatacaaataaatgatgccttaagaatatacaaattgttaattagaaaaataatttgatatgctaaaattttcttcctaattaaaagaaatgtgaaatatttggatagctgttccttaaatgcaatattgacttattttaagagccagtagtaagtatatagaaattccagtgagaagtataggtctgttgcgtttttgcaactctaccccagtaaaagtgtggtcatgttttgtttactgtttactgatagtgtaagcaactaattaagcagggcattcattgatataactctacatttcaagtcttcaaaaagctccattatggaagtagaagagaagtgaagtgggtatgtaagattgtttgaatagtaaggacgaatttgagaaaaatatttcaattacaattgatttttctctctgacttttgaaacttttatttttattttagttgtttatttttattttttctttccaacttttagtttcaaggggtacatgtacagttttgttacatggctaaattacatgtcacaggggtttgctgtacagatagttttatcggccatgaaatctttatttttaaatgatgattagctgagactttaaaaatagttatttctttacttcttttatcatactgtcattatgaaaactctgtgttttgctatgaaaacctgaagtaatgattaattttattcttcaaatttttatggacttccagaaagtaaataataacatgtttaaaaaggtccttattgatctgcagttattgttattattctcttattactgttactatctactacttccagtgacctgtacgaatgcttgtaaagatgccatttccataattcagtttgattctttgatttaataaatttctcttcagtaattggcaggcaacataaactttcattttattggcaataacaacagtttgttttgctaaatcatgattttgaaaacaatattcaataacatgtaagtaatatctgatttctgaatgtatcaatagcaagttacactgttaacaagtttacataattatacttgtcatcacccttccttttattattaaattttgatgtgcagactgcatagatataacacagctattgccaactttagtagttttgcttatcctcattgcttttagattttcaataatacattgggaattttgttttcttttgttagacttatgttaaatatcaaacttaccttgtggaaaattaactttgtgtttttctaaattcttccttacgtttaaaaagatttttgtttgctagttttgaattatcctgctatttttctgggactgagtcctggaaaatagaggcattggtttaatgtctttttctatccatttgtagccacagagatggcagttggaggacttgagttagtatttaggatttacattttctgggctgtccttgcagactcctcagctgggggtcaagactctaagagttatttatttgaccatgtaaaaatctaaatagagaggaaaattatggagtagaacgtggaagtcttgcactggtcttctgaaagatacaatagcatgcatcactaagtgctcttatattacaaaatactagagattttctgtgcataaatatgtttggcaaaattccatttaactcactaatatgctttttgcttgaattctttcccaaacttcagagtgggaattgattgcattcatacataatccatgtgtttagagaaaatgtttatacacattttgatagccatatgctaaataataagaggagcaacacatttctgagtcatttcggaaattattaacaggtgggagtaaggaacggctattttttcattaaatcaagatgagagggaaagaaattgatgtgtcaaatgaatgcaattccatttgtacttcccttccgtgattagataatagtattattttatatgttggaggaaactgagacttggagctcagagctccataggtggtaaagggaaatttgacatgtaggaagtcttaactgacgactcatgttttttttttttttcctacacagatatgcttcatttgtggagatgatttttttgtttcttttgtttttcctaatataaaacaactgttatgtatttattcttgatacattacttaagatgtctgtagtttggcaagttttcaacagggagtgctttccactagtgagtgctttgagcagaaacaaaagaatattgccccacacagatactcttaactggtcctgaaaggacctttctgtgaccatgtcatcacacatctcttcaagacgggttttctgaagagagccaatgcatggcatcacatttgtgagttaccactgttgctctgtggttgggtcagaagagacggttctctgtccttagttgctttgcagagagcctgggaaacacattcagcatttacttactgagtacaaaatgtaatctctactcttggagcttttgcagtgtgatgtggaaaattagtcttttgtgcaaggaaagctgaacagctaattctttcataacacagagctctgtaaatataggtgtcttgtctgtctaccaacatctcaccatcaacatcataacacctcacaattttactgttacacatatttgtatgtgacatttatcaagctcattttatgttagtaacataaaacacatataagtgtaacatattatttgaggattctgtgtttaattgcctcttcagatgtgcaagaatgtcttccatcattagtttccttggaacttgaaaaagtgaatactttcaatgcagaatgggaaacataaactatagtggaaacagtgtgaatgcacatgatgagatggatttttaaagacttggtcataagtcctcacgttcataaaatcagtggatttagaggtcaaagtatagggagggttaaatgctgcctttgaattttggaatctggatatcttgaaaacaggtggtataaaacaaaacaagagaaagtagtatctgtaggagagccttatttggttggaggtgggaaaatgattcaattttgaacatagtaatttgaagttctgacattaacttctggattaaatgaccaatgtgcaatggaaattcaggtctagagctgggaagcacacttaaggctagaaggagatatgacagtatcatctacattaaaactctttaagtgggaataagtcctgcacaggtagaaatttgggaacatctgcttttttttttgagtgaatgtaaaaggggctgataaagggcagaaaaatagagttaggatgatagccactgaagctcagaaaaagtatgtggggtgtgtgtgtgtgtatgtaagtattgttcaacagagctaatgctgcataggctcaaaagaagataagacctgagataaaagctttgtaatctgtcattaaaatccatgaatttttgaaataaactaaatgaatgtgattgatgatcctcaatatgatgtggcagcgtcataaagagggctgttgttcccaggattgtatgtgtcgtgtgtgtgtgtgattgtgtgtgtgtgtgtgtgtgtgtgtgtgtgtacagtgataacatgatctaaataggaagaccagtaggaagtttttcctgaaactagctaaattgatttgaaatttatatttatatgcaaaaatagcagagaatattctgagaaagaagagagggctaacctgttacataataaaatacactataaagctttaaaaataaatatatttactagctatgtctactgaaaaatcttcaaagcaatgtctttcaggaagcaatgagcccttctagtgcacaaagcatggcttcttaatatcattccccattcaagaggacaagagccctttagtcttccttaacctagaattggctgattctaagtctgggcagaaaaaacacaagatgagcctgggacaactcactgcagaaagtaaggaaatggtcaaagacaaataaggctgtatcattgtaaacaagtgctagcttgaagggccttccagttgtgcaatttaaatcagtttgaatttcaagagtgaatataacaaattgtaaacgttgagtaaagtaaaatccatgagtgcataatgatactctaaataaatatataaaaaagaaaaatgacaattaataattaaattgagataattaaatgattagcctgcctttcttagttgatgagggacagctttttacaaaataatgtgaattaagtgtaagaaatgtaagaattagaaaattactatttgtaactctcagtgaagtaagtgattcagtcaaagatgatcaacaagtgataaaataatcaattaaaattattttgatgaataacatattctcatagtgctcaagtattaattgcatctgcaagtcatcgttttaagtgactgaatgatttaacccaacatcaccaatagacaacctgacactatgagcctcctgacgagatgccatataaaggctatagtgccatttgtgaaatattgttgctagaatgtctaacctgaatctaataaaacctggttagatttaacttccagtttatagaaaaattcagagaaaggaccagttaaactaaaccatgaggaaataatgagacaaatgcataaggtgaggtattccacattgaagatacataccagccctgtggcctagacttgtaaaatgtcagtgccactgtgggaggacttttccagattaaaaaggactaaagacaaacaaatgcagtgcttgaagatttattttatttcactttttaaaaatgtggtctataaaaagtcaaattttggtagaattgggaaatttttcatatgggctagaaaacagatgatattagcagatgagtgctgaattatttgggataaatgcagtgatacatgaaactgaattttctttttttttttctttctttttttgagacaaagtcttgctctgttgcctaggctagagtgcagtgacacgatttcggctcactgcaacctccgcttaccatgttcaagcaattccccttcctcagcctcctgaatagctaagattacaggcgtgtgccaacatgcccagttattttttgtatatttagtagagacagagtttcaccatgttgaccaggctggtcttgagctcctgacctcgtgatctgcctgccttggcctcccaaactgctggaatcaccgtgcccagcccgcaactgaatttcttatgagtcatcaaaggagtgagggagggagtgtgtgtgtgtgtgtgtgtgggggggggggttgtgtacgtgtatatgtaaaataatcatttgttaaccaactttaaatcagggagtgcttatgctggttttattgtgttattctttctagtattccatctatttgaattttttttcgtaaggaaagttgaatagtctattagttgccattgagaaaaaaatatgtttattgaggctaaatagaagcagaagtccaattgcccatgtttaaggtcatctgggatcttgaagatatggagacaaaaaaaatgaagtttaatgttaaattgtgggaatgaaatattactcatcgaagtaatattattgaaggaaggatatttttaaagccacagtaaggaaaatatgaatgcatctttatgtttttcaggatggaatccccttgcaggaagaggtggaggtataatagaaaggaaaataatttttcagggtcaatttcagaatgttctaagaaggttggtgtgattagtagtagcgcaaggagatgctggttacgtctcagaagaggaagagaattgaatcagttcattagttaaactaagtaactcattatttatttaacagatatttcttgagcattttctttgtaagtactgtgctggaggatgaggattctgtggtaaataaaactgataacaatgctgactgcaaagagtttgccatttaatggtgacttcagtcttctcagataattgtaaatgaggtcctaggttgaaattaactggtatggagataggagctaggggagtgtagtagggaataagcatgaaatatagaaagattctagagctgtaatgaggaacttggcaaaattagcatttgttgtcactttagtcaacacagttacatcacttctctaggaacacttagcctgtaatctgaatgggttaaggaaacagttgaggattacttggttagagactagaaaggcatccactttgtgtaaaacaaagtgaggagctttccagaggtagtggatatgaagatataaataaatctgggctgagaaagagagcaagggcagctctacgagatgaacagaataagaactggtaagatttgaaagcctgaagagcaggatgaaaatgaatagcagactcactaattttaatagaatgagagtagtgcaaggatggataggtttggtcagaaaagactattgtatttctagcgtttgacagtggaacatcgtcaaatggtgaataaattttagagtatggtaaagcatgtggctaagaaaggaagacactgctgattttgagaagttaagatattgtgaggtgaagctgagtattaaaagtgtaattttgaaaacgtgatttaaaaaacctgtaacaggatgacaagtgaggaggtggaaaggaaaactataaatgtatcaaaagtatcagtgatatttttagagctttacaatcaactaagaccaaaacagatttttttttttcatttgtgacttctaggactttagtcctttctttggaacattttgaaggaagctatagatatgtaatgtgtttgtgtatcttgcttacatttgaaaagaattttcagttactacagaaataaattctgcagtggatacagcaatgcaaccctttgtaaggaagtctcttttcaaaaccaaggaaatgaatataggatcctataattaagtataacagtgaatgattcagattgaaaagaaagctatggagtatttgttaatacatttttattaacatcagaagtccagatagcaggtatatagctatatttactgctagttctgttgctgctgctctgttgagatctcattctatttatgaatcaacattctggaccagactgactgagaaatgcttagtcagatagagcctcatctttgcaacactaggagagtatattaccatagataataatatttaggagaaaagagaggatcagacagttgacttgttaaatgtcttcttgctattaaatggctgagtaaagatctgaacccaggagtttttggcttcacaacttgaatgtggactactgtattttgttcaacagatggaaaaaaggagatactttgattggtacagcaataggtcagcaacatttgtccaataaaatagacacgctcacataattaatgccctcacaatagctccctctgcacagcatgttaaaaacacacaatgcttacatttagaactgtagtgcaattgattctgattctagcccctcttttcagagtcttccataatgtctcttctgtgggcataatgggtgagaatttcaacaattgtttgtatatttagacaatatttgtcggggatctattatatgtaagtcactgtatttgggtcaacatggtgtgaaaccccatccatctctactaaaaatacaaaaattagctgggtgtggtggcatgcgcctgtagtcccagctactcaggaggctaaggaaggagaattgtttgaacctgggaggcagaggttgcagtgagccaagatcgcaccattgcactccagcccagcgacagagcgagactccatctcaaaaaaataaaaacataagtttttaaaaatcagaaaacattggtcttaccctcctgaatagacagttttcaggaaaaggaaatgctttatgtgaaaagtgacaatgcataaagttatgactattaagaaaagtaaagatgattgcttgtagttctttgggttattaaggcacttgaacaaactagcatgcaatttctttctcccctttctagtgacttggtgagtcctcaggttgggagattatgtattactctcgttccattgtattccaaagccaggaatgtatgacagtgtagagaagaggtgtgtagacaaaaaagtaaagggggccaagtgagaggaacaacagcaacaaaaagatttagagcaaattgtctggaaaaaaaactggaagatgaaagtaaatggtgaaattttgaggaaaataggagagagtcagggtagaggtacaattaacatgagtttgcacctttgtatttatccttattttatgctttaatatgaagtctattgttcaggagagtgaagtttatcctggaatatattgagattactcaaaacttcaaataaacttattagaaactgttaagtactataaaatatataaaatgaatttagaaaatatctatgcttttagattttttacaatggctctaatgatatagctttattgataatttaaagtagattagtgaaccaatagtatgaaaatattttgttttattctgaacccatttcatcatgtatgcaatctttttatttcataattgctggatctttttccctgttctagtcctcccactggacagtggtacaacttaaaagaaaaagggaagcgtggaagaggggagaaaggaaatggaagagaaagaaggaggtcaacaatagccatgaacaagctttctctagatcactgttcaaaagaaacgatgcaagtcatgcaagccagccacatatgtaactgtaaattttctaaaagacatattaaaaaagttaaaaagtgaaacagctgaaattaattttcataaagattttatgtagctcagtgtatcaaaaattattttaacatgtaaccaatataaaattacttttaaaatattctgttttttgtgctaagtctttgatatctagtttgtattgtatacttaacagcacagaacagccacatttcaggagctcacaggccagtggctatcacatagaacagtgcaaatatagagtgttcatagaggcttcagggctatgtcatgttttcaaactccttttggcatttgttccttatcggagattatccaagatagattttttaaatactctctgatcatttcaatttcagctttcactttttattaaatcctaaatagaaatccattgaagttcatatttgccaaaaagttatcccaaaatatggtcccattgactaagaaatattaaatttatcttgatacttattgttcttcaggagcaagatggccacttttactaaatttgctctttcagtctactcatttgttatttggccctggaggtaaggaaataatgcaattgtcagaaattggtaacatcttcataggataggcttctatattagtggtatttgcctaacacctaatttaatgagaactatccatggccttgcagagaatcactcattattttaaaaacagaatgatatacttaacatgtaaatttgctaacagatttaacaccaattgaataccaacttagtttcagaagttatttgaaaacataatagaaaatcctgtatctagttatctgtttcctgcattttcgaagtccataaatgtggaaaatcaagaggcttatatactgtgaaaccccgcaatctacacagcctcattttcttccccacattcttttcttcttatcagaccagtttcttctgagtctcacatgttttctaatatggagttaaagacatgtttacccatttttaggtcctgactttcatacaaagaagataatcctacaacttctaaccttccatttttacatcctatttacatttttgagatgaatggtgataataaagatattaacaaccaccaaaacaaccaacacttatttagtatttagcatgtatcaggtgttgtcctccaaaccattgctttatttttctacttccccttgatctccatccattgagctccagaagatgagactatctaagtatgaaacttattttggggccgggcgcggtggctcacgcctgtaatccgagctctcagggaggcaagaggcgggaggatagcttgagcccaggagttcgagactgcctgggcaatatagcgagaccccattctccagaaaaaggaaaaaaaaaaaaagacaaaaaaaataagcgaaacttattttggattatttatcaatacctgaaattttatttcactcttttttgtttgtttgttttcttgtttgatgccttcttctcccattaggcgatagctttatgacaatacagtttatcttaatgatgatttccagtacctagacagtacctggcacacaggaagcactcaataaacctttttgaattaattaattagtgaagtagttcctcactgatgttttactgcacttgaactcttttctagatattttcaatatctatgtacacactctttagtaggatgtaggtagaaactgaaaagaaaagatttttgaggaactttcactacaattcatgacaattatctctaaaaatgtgaaaaggaaaacataatttctccagcatgaaggagaaaggacgtaactgctaagagcatatgtgtactgaaatgataatttgtcttaacagttattctacatttgtagagggctttatcattcaaacatattcatatacattttaattttattctcactgcttcatttctgaatgttgaaatttatttgtatttatttattaattttttattttgtgggtacatgataggtgtatctatttatgaggtccatgagatgttttgatacaggccggcaatgcataacaatcacatcatggaaaatgtgatatccatcccctcaagcatttaccctttgtgttacaaacaatccaatgataccctttggcattatttaaacatgtgcaattaaattattattgattatagtcaccttgttgtgctatcaaatactaggtcttattcagtcattccattttttgtacctattaatcatccccacctccctgccacccttcccagcctttagtaatcatgcttccactccctatctccatgagtttggggacgtttggatccccagaataagtaagaatatgcaacattgatctttctgtgcctatcttacttcgtttaacataatggcctccagttccatccatgttgttgcaaatgacaggaactcattcttttctgtgtctgaatagtactccattgtgaagtagatagtatgttttctttatccatttatctgttgatggacactttggttgcttccaaatcttggctgttgtgaacagtgctgcaacataggagtgcagctatctctttgatatactaatcttctttcttttgggtatatactccagagtgggatttcgggattatgtggtagctttgtttttagtttttttgaggaacctccaaaccgttttccatagtggttgtactaatttacattcccaccaacagtatacaagggttcccttttctccatatcctcgccaacatttgttattgcctggcttttggatgtaagtcattttacctgggatgagatgatatctcattgtcttttcgatgtgcatttctctgtgcattactctgatgatcggtgatgatcggtgaccttttcatatgcctgttttcttcttttgagaaatgtctattcaaatattttgtccattttaaaaatcagattattagattccttcctatagagttgtttgagctccttataaattctggttattaatcttttgtcagatgggcaatttgcaattttcttccaatctatgagttgtctcctcactttgttgattgtttcctttgctatgcagaagctttttaacttgatgtgatcccatttgtccatttttgctttaatttgttatgctcgtaggatattactcaataattttttgcccagaccaatgtcctggagagtttccccaatactttgttgtagtagtttcatagtttgaggtcttagatttaagcctgtaatccatattcatttgatttttgtatatggcatgagatggttgtctagtttcattcttctgcatatgggtatccagttttcccagcaccatttattaaagaaactgtcttttccccaatgcatgttcttggcacctttgtcgaaaatgcgttcactctaggtgtgtgaatttatttctgagttctctatgctgttccaaatgttgaaatttaatctcagaggtgaagtgactcagtctgcttacctagtaaatgtcatggaaagaacttatctctgccaattgcattggaaggtaatagtgtagcctgggagttctgtagatcctctaatttaattttagtcagctatttggaatagtttgaaaatcccagtacttattatgtaattttgggtgcttcttattacatttatgataagcaattcaaaatattatatattcttatgattcaacctgaaaccaaagttttctgcttttactcgtttgagcttctgtaacagtattagtgtagcatgagattctaatggttatcatgaacagttaaactgttaccatttacaaatacttaattatattgataagaattttcgaaatacagtacactaaacaaaataaatacattggatgctgagactgatataggatagcagtgatgatcagtggactccagatacaaagctttgtgttcatcaaagcaaacgtcatttcaggtattgattaactttaaaatagagtttcacaaatgtaaattaaaaagtaattttaagatagaagttactacttatatctaatttaggatattttatatagattttcattaaaaggaagtgtcctaagactaaatacattttaaaatcatttccttcatgcagtttttgctaagaattttaactatttgcaaataagagtatcttaaaataattttaactgttaactaaaccacaacagttttgacatttgttgcttgaaaagtgtagatacttttctatctatattaattaaagcttgaacaaataggattaatatttatttaaaagatgatcttggtgatgtattttaacagtttcttgggctattttgcaaatagtttgtgagtgtaaaattaaaaggcttgaaaatgcattcctacttttaatggggggatgggatgacaattgtgtttttaaggttgaataatcactggtttatggcacttaactcttttactagttcacaaactatgagtatattgtttacattaatttaagcaatgcattatgttcacattatttcatgaatgttttagtgtagttatccaacaaatatttcatgaaaattcatttttttatccttctgtgtgtcacaaggcattatataatgtataagaatggagcttacagtgcagaaggagctgatggtgataaatttcacaagtaaaaataaagttcagggttaagatagtatcttattctctattaaatcagaggattaaccttcctatgcatttccagctacaaaatgtgacccatgatgaggtgagtgaagtcaaatcagcttttcaagactatatgtaaaataacatgaatagaaagaaatacttcaaatttatagaatgttaatctgtatagtctttgaggttaaattgatttagtatctttgactaaaacttatgaatcagtgagaatttgatggggaaatatgagcatgtaatttcgatccatcatctatctttatttgttggtttagagctaagcatatgtcagtattcccagtataggtctttcaaggtatgtctctgtatgtaagggtaatataaccttgtgagtatgagtatgagtgtgagtgtgtgtggagaaatcaattgcttattaatagctttaggaaatggtattagttatttagttgcctaattgggggagtagttttcattcattttgcttttcttttttttttttcaagacagagtctcactgtcatccagtctggagtgcagtgtggcatgatcatggctcattgtaatcttgaactcctgagcataagggatcctcttgctttagcctctctagtagctggggctgcaggtgtgtgccaccatgaccagctgattttttatcttattttttgtagagacagagtttcactatgttgctcaggttagtctcgaactcctgacctcaagcgattctcccacctcagcctcccaaagcactggtataaaaagtgtgaaccactgttcgcagctagcatatttatttgatactatgtctctttgtccctaaaagataaatgatatgtattacatttaagtaaattatattatgtcatagatttcctttttttatatccaaccctcacaacaggtgttaggattttaatggttatacagcattccattgtaataatgtactttgtcatgccccattgtgaatattttagttggttcttttttcactttcttttcattgctattttgaataatgagtatttccatacactttttgtggttattttactgtaatattgcagttttgtatgcacttttattttatatgaatttatagacttaatttatatttttggtttaaaaaaaaaaaataaagcctagctcttcacctagtcttcatctaaaggactttaccttcttacctaacactggtagagaaactggctgggttagatttacttaaagatgatataaaacatataaaatcatgtataagtattatatgatctattgaagggattttttttttttttttttttttttgagacaagtcttgctctgtcgcctaggctggagtgtagcggtgcaatcttggctcactgcaacctccgcctcccgggttcaagcaattctctgcctcagcctcccgagtggctgggattacaggtgcccaccaccacgcccagctaatttttttgtatttttagtagagacggggtttcactatcttggccaggctggtcttgaattcctgactttgtgatccacccaccttggcctcccaaagtgctgggattacaggcgtgagccaccgtgcccagccctgaagggatttttagaagtaatttttatgtatctttcatggtgactttagactctaaccactaggaattatgctacaaaattgcattttgtacagtattttcctggtgtaggcatgacattttgaacatttactttaaaaacttgctaaatgtattttttcattaaatttaaaatactataatgatttcttaatattttcagtacgtacatgtatattagcttttgagtacaaatagtaacacatttttagtaatttatcattcataggtgaaaattgcttgaaacccataacataaaaacagaattacacaggaacggagtagagagatcagtccctcatgtagttgtaaattatttctagccacacaacaaaagaatgttagttattcgcaaaggaaaaagaatggaaatgagaactgtgcttatgacattatcactcaagtggtttgggtttcttacttaccataaggagagtgtttgataatgtggagcctttctagggaaaaggagatgtaaagtacattctccttttgagtcctgcagagttgccaggatgactagtttgttgaaaagaaccatttggtgtccttccttcttttctttctttcttttttttttttcttctcacttgagtgaatcactatagaattctggaaagtacaggaagaaaatgataaattttcccagcagatttttctaaactaatcttaatggaacttttcaagtgcttttatttaatttacccatgtgttaagtggggtgttctcccatcatgttgttcatagtgatagtaaaaagtggtgctgcttaaaatatattctgtagcctgttggtttctgttctgaaacaagaattgagatttccacaacaattttacagaataatttcatgtttcattatatgtctttgtgttttctccctcacttttctagtaatatattttcattgtattctgtaaaatactggtttgtggttgattggaaatggaaaatgagcttctcaagtgcaatatagatagcttgagaagttcaggtacagaacacacactgcatttacacagttttagtttttcctagattatatgcttcttaaagataggtattgtgaaattcagtcatttatttattctcatattctggcattcattcaataatgctattgacatagtgttagtcactgatgccctggatgaaaaaaacatcatcccattctcaatggactcaaaatatccagagagtatctcactatgatactctcttatagtgcttatagattaagtaaacattcctggaattgaatgtacttctttaaatgtatgtgtgtgtgtgtatgtgtaatgtatatcatatatactcagtgtataagtttttttgttttttaagcccgtggcattctgtgtaaattgcctaaatttcaaagttaatcatcacatataaataatactgaattattcctatagtttaagaattctgaataagaacacagaaatatcatgtagagattgatagtctcagtagtttacccaaaagatctgaataaatattggaatgatcttttaacaggttgactctagctcagaaaaaaaaaatgagaggaagagcaccacaaaaatatatctttttatcattggattaaaatatctagaaaaacactgataaataaaatctataaataatattctgccgttgtcttaaaatttaaaaaatggggaataaggtattttttctttcttacaaagactacacatattttgacccaatctgtttcatgttgaatggaaacaaacttgcatcataactgtgcatgtcattactgcctgctggttctaccagtatgcttttgcatattcttgatgaacaacaatattacctaaatcaagtcaccctgctttgtgttcatctgtttggtttttcttgttgttgtttctacaaaaatgttgtctcaccatactatgttccccaaagtactgctgtgatactttgctcctttctaatatttggtgaattcctaaatgtatctactttgtgcatgccatatgttcaactgctgtctccaatttcattataaagcttatgtatttatataatcattccaaaaataattcactctgaagacataatttcagtaagcagagagtgttcagcattactaagttaaataatatataacacttatttgaattcttactgtgggctaggcatacaaagtatgtgtattttttctcaaacagtcctcagagctttattgtttttattcctattttatagatgataaactggaggctcactgggcctatgcttcttgcccaggatgacagggctagtaactagcagagctaaaacttaagcccaggtctgattctgaaatcttctaactctgacccactagattattctcatctcattttatatgctaggttaactaggatttgattatttacaaatatggccctttcgttttatatacattgttatattttctgcctaataaaacatatgttgttacttccaaatatcttcaaaacccatggccacaggtactgttctcgatatgcaattactgaatatttacaaatgtggctccagtcagctaaagagaaaaatgtaatgatttccagggtccacccctctaatagctgttgtctttagtttttcaaggtcaaataaatgaatcgtgatgaggaaggccacgtgtctagaaaccaactgcatgaaacccttttctgttcaggatttaagcagtgatctatttaagtttgaattagacaggattccaaaaggtattataacctgaaaatattacacagcccccctctaacacatataccacatatgcaaagggaaagccactgtagctattttactcggaagttttatcttttcaatattctttgacttctaatgcaagtatgttacttgaaggaataaatatagtgtatatttgggtctgaatattagcactagttatcaataaagagcacaagtgggaaatccatgatgtcaagtaatctatctttgtaaatctaccttaacaacctagtctgagaaggtgataaaagtagcatcataaattcccatcagtttagcaaataaatgctgaacattgtgttagtttactagggcttccataacaaagtagcagagactgggtggtttaaacagcagaaccttaactttctcatagttctggaggctggatggccaagatcaaggtgttgccaggtttgattcttctgaggcctgtctccttggcttgcagatggccacatttttgttgtgtcctcacttggcctttcctgtgggtgcatgcctccctgttttctcaatctcctcttcttaacatatgtgtacaccagtcttattggattaaggcccacccataagacctcattttacttttattacctctttaaaggccctttctccaaatgcagacatattctggagtactgagggttaggacttcaacacatgacctttgtaggggatacaattcagttcataacatgtatgaattattcttctaagcactgtgggaaatactaagagtatagatcacagttctggttttcaagtagtttaccattctatgtgggaccaagtaaaatagccacagcttgagtgcatgggtgatctggaggtaacttcagccttcctcgtggtacctaaagtcaggtgacctcatttgagtagctgggaaagtgttctttgctcagtcactcaaaagctccttattttaagagggaacttttcttattagaaaatgtaattatttcatcaaggctatatacacgagacactgaaaaaacagtttagtgagagcatatgattaaggactgaattagtgctaaaagtaaattcaattagaggacaatatgaattccgtttttcaagtgagaggtatgaggtgtctctagaaacagtaattgatgatgcactttgaggaatagttaggaatgaagagaaagattttagaactatctgagtggaggtgatatgtgatagttgaaatgaaaatggatttctctgggaataaggaattgtgggcagcaaagagattgtggcgcgacatttaatcatgaggcatgctgaacatgagtgagtcaaaggaaggcacaccagtgaggaagttgaaagttgtgtagctttatgaaaactgaggcagagattatcatgcaccaaagccccatccttgaatagacatttctcaaaagaagaaatgcaaatggccaaaggtatatgaaaaatgctcaatgttacataatcatcaggaaatgcagatcaaaaccacaatgagatatcacctcacctattaagataactatagcaaaaagaccaaaaagataagtgctggccagagtgtggagaaaagggaactcttgtgtgcttttagtgagaatgtagattagtacagccattatagaaaacagtatggagattacccaaaaaattaaaaatagaactttcatatgatccaacaatcccactttgggaattcaaaggaaattaaaccagtatctcaaagagatatctgtacttccacattcattgcagcattatttacaatagccaaaatatggaaacaacctaagtgtccatcaatggatgaataaagaaaatgttatatatataacattatatatatgaagtatgttatatattatgctgtatataatatacattgttatatatcaatgaaatattattcagccttagaaaaagaaggaaatcttggcatgtgagacaccatggatgaacctggagggcattatgctgtgtgaaagtaaccaagcacagagacacaaatactacattatattacttatatgtataatctaaaaaagtcaaagctggaagcagagagtagaatcatggttgcttgggaatgggaatggacaaaatggggagatgttggtcaaaggtacagtgtttcagttatgatgggtgaataagtttggaagatctaatatactcagcacagtgattatagttaataatactgtatcagatacttgaaatttgctaagacagcaggtcttaaatatattcaccaacccccaccccccaggaaactgtgtgaggtaatgggtattttaattaccttgactgtgataatcatttcataatgtgtgtgtgtgtgtgtgtgtgtatatatatatatatatatagaaacattgcattgtacactatacatgtatacaatttttatgtgtcatacctcgattagggaaaaaaagtttcatcaaagggaaattagggaaaaaagtttcatcaaagtagaaattgcagttcgctctttgaagaagttagaaatgcatttaacttgttagggggttattaggagggaagatctttagctgcagagttctattagcaatagtaaagaacggatcaaagccaccgtttttctgtcaaaaatttgagttttcttcatgggctgtttggtacacatatcggattatgatactctataagtaacacaagattgatcggctatatgaagctcttttctgtagagtattaaattgtgaaatcagtaataaaagtctgtgtgttaaaaatcgttagcacagaaacaaaaattttagtgtttgaaattttttaatttcattgacaaactaccatttttctctttaaatccgatttttctttgtgtctaagtatatcggatgtactggcagattagaaacattatcatgagtaatccttctcccctcaaaatatgattggtaccttttttagacctactctcagcttcactgtgtctggtaatttttttttaactaatcagtaaatagccctactgttaggtctgtgatggttcttaatgccctcggaaggagcgtaagctttctgggagggttttaagcttctcaagaatagagaaacttggaagggcctgggagctggcaggcaggtgacctgcctataattcctgccctgccttttgagctcatcccacacttttcttgcttgagcctcagtttcctcatctatatatcatctatagaaatgatgccaaattttttaccctaattaataaaatgattgacagaaccacttaggctagtgttactcaaatgcattattataattacttcctatttaaaatgtttaagtttaaaaatttgggaagttttaaatcaggggtcacaaacaaagcggaaactttccttttgtgatataagagacttctttaactcaggtacctgggagtagcagctctgtctaggaagccagggtaaaatagatgaataaggaaggagacattttagctggaagactgtattggctgcatgaggctctcatccctttgggagttaggcgaaggctgtactttagttttaaattggagaggctttgtatatgtacacatgcatacacacatttaataataataaaaacatttaaaaagatttaacaaatattgcataaacatcccactcctccaccaaaaaaaaaaaaaaaaaaagaaaagaaaagaaaaactatgcatgcgagatattacaagaagcctatttttaggaggtattgtcttgctgatattccctgatgtccaacagatgcatgtgcaattttcaaagcattgctgccggttgaacaaaacataagtgctggttttttgtaacctccctttctgtggccactttgtggccccggttatgaaagctttttagttttactttgatgtgccgtaaaaaacacaaatttagaatcagacatatctagactcagatactagctttgcatcctacactctaaaagcttccttttgttggaaagaaaatggggatgggaacatctaactctaattgttattgtgagtgtcaccttttataaactgagccactacagggcaatattttcaataaatgatggcttcttttttgtaactcagtggcccttatgccaaatttagaattacctgggagttttaaaaaattttagtactctgattgaagaccctagacttaggttcacctgagcctaggatggagctggaaatctatgtgttagaagtccctcagtttgttttacagtgctatcaggtgggaaccagtgctgtaataccatcagataaatgaaaaacatgacaaagtagatttggcattcaagtatagtgttctaacacctcttcatccccaactacatgtgtatgtgtacatgtgtgggtgtgttccaatacaatgactatttctgaataggtagctatcattatttgctcaggatactgcttctatgtatttttcatttcgtatttactcctctttggctgacaacctatgtagtgtgattatgaattaatgtagctacttttctcatatggaaaactcacacaaaggcaaaagtagttattaaagaggactagtgacagcatcactggaattaaatgtgtgcctctgaagctgattgctttggattgacagtacacagctcaaggtagatattctgatgtttttgaaatgcaccctacttctttatatgctgtctagtcttgtggcttcagaattacacaagcttaataataaatatgcatatatatatgtgtgtatgtgtatatatatatgtatattcttaattacttttcaaattatttaaattaattttaccgagcctctgtattgacagctgataaatctttaaatcctgtatttaatattttaataaataatgtttaatacattatagatttctcaaattggattttttttttctaagcaactccttatatcaccacaggaccagtagtgctagtaccagcacgagttgcttctcacttaattagtgggtcattcataaaaacaatacttcattggcttaaaaaaaaagctattgtgatgtaataaatatgtacaggcgcttattcaagagtcaaaatagaaataaagtataaatcgcctgctcttctggatcattccctctaccagtgcggaaaattcaggaatgttcataatatacagtgttttattttatacattggcacaatccatgctgtaaggtcacgagccacggaaagcttattgtatagtttgctgaacattttttattatattttattttcaccaacttaatttttcagcaaggctctatgccattcatgcttgtacaagaggcaaatacacatggattattcatttcactctgtttccataaattgcatcatttagcatcagtgtcatgtcatagctagctctgtgtacctagtgtgtgctctcggcattgatgtatgaatgactagcataatctccctattgcttatataattatagtgaataataatgcagttttctataatgtttaaatattggctagtttcttaatacttttttattattttatgatcaccaataaaaaacatcgccaattcctgaataccaactgtgtgcagatattgtgtggtcactgtctttatataatccctgaaagatcagtgtgatccccattttacagatggaactgaaaaattaggtcacttgctcatatctgtcatcaagtggcagagcagagatttgaaaatatatatctctgactgtacctgacctctttcttgcatacctttctcgtacatcatcataactcctaccacaagattgctgttacttaaagatcataagaattagagttcctgaagccccttagttaatactttaacaactggtcttcatttgaaatgcacaactactagctttccactcgcagcttggactggggcctagaatggtctattgaatgtttggttgtttaaatgactgcagcaacttgcccatcttctccatcaagctactgaatagtaatgtaattagatccagcacttagattttgcttcctcccataatattttttatcatttggtgattagattacaatgtcaatgattagcatgtagtttccccaatctaagcagtaagaagctctctgttctatgtttgaaaatggctgtaaggttaatccactaactgcatgtaccttgatccaaaattatatactgatgaatggtgatgaattccatgaaattcaggaaactgccttgttggctgacagcaagatgtgttatgattttatatagctgtgtataaatgtttgcagtcaatcagaaccatgggaaaacagatttagaattatagaaaatacatgaacctggaaaattaaccctagggaaaaatctgtggagacataataataatagtaataataataaaacattatcaaaaatttatttggtacttgtatactgccaagcaatattataagcacattgcacgaattgtatcgcctttaatagttacaataaccaaggaagaaattgaggcataaggaaggtaagtccaaggtcacagaacagaaaattcactattgcaactcaggcagttttagttcaaattttgtgttcttaacaattgtgaattctgcctcttagctcttctgagtataaaatggatgaaaatgcagttgagtataagatgcagatttaatttacataaagtttcatagcagaggttaataattctgaatatacattttgtgtaaaacatattttctatgaattacatcactgtagtgttttttgacaaataaatggaaattccatttattttacactgtatatttttaacataaaagtggtattctagctttctcccttaccataaattatattatcatttatttacctacgtttgtattttcaaaatcatgcttaatagttgataccgtcctcatgacgccttcattttttttctggggagatatgattttctcagtgtttattttaaaaaattattcatagagacatgtaataagtaacatgaaatcaccagcaagtgtatcccaggcttaaaatgagaacacacattgatctctgaagacacaaagcacaaaggttattgcttcatctaaattttgatgaaataatttcagaattcaggaaacaagacttgataggaatatctggagctgtaggtgaagtacaggcagtataagtgaggtaaagcaaatgtgagcaatgtataaatagaaatctttccattgaaaaacaagactgataatttcaatatttccctaaaaatatgctctatgagtttatgaatatatacttgaaaaagatcagtattctcttaggcatgcttttcttcaattacctttgcatgtctgaaacaagctgttttattggcagtttttatcttaaaaaaatttttaagaagatttagataaataacagaaatgacagttcagtcataaataagtaatacaataaaaagttatctccttacataaatgtaccaaacaaatgagattttttgaatcattagaaattattctttataacatgcctaatgaattatcattgttctctttttttacattctggaaaattctcagagtatatagatacaatagataactgtcttacttactgtatgaaaatagaaattttcagctgggcatggtggctcatgcctgtaatcccagcactttgggaggccgaggcgggcgggtcacctgaggtcaggagttcgagaccagcctgaccaacgtggtgaaaccccatctgtactaaaagtacaaaaattagctaggcatggtggcaactgcctgtagtcccagctactcgggaggctgaggcaggagaattgcttgaacccgggagacagaggttgcagtgagccgagatccctcaacgccattgcactccagcctgggcaacagagcaagactccatctcaacaacaacaaataaatgaataaatttttaaaaagcaaaaaagaaagtagagaatagaaattttctgcaaatagtaaaagtttgttttatgtttaattattttgaaaacatgcatcacattttatttttaaaattcttatcttttaaaatatattgtatttggaatagattagcttttcttctcaaaaggaaattgtgtgtgtgtatatatgtgtctctttttggttcaagatgaaagtaatcacaacactaacacaaaatacatgctacagaatatgtgttacataaatcccactttgaaaacaaatccctgaaatgaatttcatgtatttccattaattacagagaagtattacaatgacatatttatatttcggttctgtcctaagaatatatgttcgaatgctcaattgacatacatacatattggaagttatgtatgcaataacgatcaatctatgtattgtgaattccctcaatgtgccttattactataagagtgacatttcaatgatacattttattgaactttttcattgatattattggaatttgaatgaagaaaatgtgaacagagtttaaggattattaaagttcctctaattttatttctaaagtattagcacattatttggttttatctttagctaattttctctgctatggctgtggttcattattgttatcaattgccacaacctgtatctagtactttaggccaattatttatagaatatacttaattaggtcaaattaccttaggttgttaggttgttaccttgggtggaaaagataagacaaggtaattaggcagcttgtaagtgaactctgagtaatgaaaattgataagttgcatataaggaattggtatcatttcatatacatataataagaaatagaattgtggattttcttatggtcaaactatttctgataattagatggatttatatagcctgggatggaatgagtctgtgatttatcaaatgagtctttatgctttatcaaatttaaataaactaagtagagaatatataatatttgcatatatattcatatttggcataaataaaattacatatttactaaaaattctatttacctaaatacttctaaaatgtgcaataatgacttattttgcccttttagttatatgttaaatttttcaaatactgtgagaggcaatttaatatcatttactgtaatatccttgataacattaatatacctaactggcaagagttagttgagacatttttactgaattgtatattaaccctcttcagtgctactcgaagtgtagtctattcactatatcactgtcatgttaccagtgtctgttacagatttgttgggagacagaaaataggaattagcatttaagaccatttatgccaaacaacagagtaatttttacctattgcgtttaataaatattttggatttttttgtgtgttacattttgtatcatttttctagtaattaacttttattttttttttaatttttatatatttatttaatttttgagacggagtctcactctgtcacccaggctggagttcagtggcatgatctccgctcactgcaagctccacctcctgggttcatgccattctcctgcctcagcctcccgagtacctgggactacaggcacccgccactgtgcccggctaattttttgtatttttagtagagatggggttttgaggggaaaggagaagcctggtccttcctcagagttttacaagaaaaaacactgatttatctgattcatgattcaaaaagttcaatactacaaccaaaatatagtacacattttaatatcatcattgtaacaggaaaaaactgtcatatttgagtaaatgtcatagccataatgatttttgacatataaaatgcaaaaattggcattatgattcaaatatggaaacattttattgaaatggccatcagcactaaaatgtgttctttctgtttataaagaaaatattttataccttaccatttattgattctgaataatgtaaaaattcttatatttaaaagtttattcatttaaaagcaatgtattatgcattatatttatatatggatataaatgcatatctattcataaatatacatttatttatgcataaggtttttttttttaatcccaggccatattttttaaattgacctcctctgcaatttacatcttcatttttctatctgtagctgcttctctctttcctgccaatttacttccttgtcatattaacagtagcttgttaatcttaaattcataagccagtcaatactttattttctaattcggaggtttggttggctttagtgatttctgggtcacactgcctatactaattgatctgtctgtaaagtgcacaaagaagaacacagaaagaggatctttaaagaacattaaataaatgatactttttgataagtaatgcgtacgcatggcaaacaacaacgaatgctacaaaaagggataaaataaaatgtgtgtctcccttctcatcactgtacatactccctggaagaaactatggccagctacttttatgagaaaatataatattctcaaaatttatagtcccagagtaacatttgacaataaatgataacttcagtaaacaatgccacattttgcacttatcatatattaaggcacatgacctcttttcagtatgctgtgacccagggctgtaattatctctgttgtacagataagaaaacagctttatagattgaagattttgcagggatttcagatcctaattttgagacttgacatatacagatatttctgctatgatgtatacatttcaaatgttttgcaaaattatacactaaaattttgaaggttaacagaaaaaaatggacattcagttataccaccataagcctatgtagcaagatcatgaagaaatataatattattttaataaaagtctcagcagagttaagagatgtaacatttttaatagggaagttataagagacaacctttaaaaattttttagaaatacattttattgtgtatacttaaggtatgcaacaagatgttatgggctatgtatagttagtaaaatatttactacagtgagcaaattaacatattcatcatctcacatagtttctctgttttgtgtgcgtgtggcaagaatagctaaaactcagtcatttagcagaggtccctgatgcagactcttcacttcttgggaaatattaagtaagtgtccaccaatgctatccaacagaattttcttcactgagggaaatgttctgtatctgctatttagtacagtagtcacatgtggctaatgatcacttgaaatgtgactactgtgactaaaaaatggaattttaaattttatttaattttaatctatttacatttaaacagctacatatggccagtggctaccaaattggaaatagcaggtgtaaaccaattgatttccactttgtgctgacatcatttccctatttgctcatccatatgagctaattcacgtgctagatagaggtggtgtataaccagtatgctctgttcctttcctgagataaaattggaactagcttacatctatatgctgctagcatagatcaactttgtaatgacaacacaaagggttataataggttataacccttttaaatagaagcctgctcatccctgaacacagcttagcctctgagcttgtgcaaactttctgtatcattaatatgtaaatcttaccctcagtaggtaagctctttcaaaactgtgatccacttagtatgtccttatttccctgtgaataatcttaccagacaagcacattttgcattttaatttgctgtgtgagtttagtttctagaaactactaagccatttaatgtcaatatgttttattagtcaaaaagaatgattatgatttccaaaataaaaattgtctagcaaatacatattaaaatgaattttgtaaacatatattaaaatattttaaatacactcaatattaaatatatttgaactatattatttttcattttgtatgtgcacctagactatcttaaataaaatagccgtcagaagaggatgacaagttgtgcaatgttaaaaagctggagtgtatttaacactacaaggttagacactatagtgttacacagaaaggaaaataattatgaattaaagttggaaacgtaaggtttttataccactcatatatacgattttttaaaggcttgtgggacatggtccatatgtagtgggaattctcaaatccacctgaaaagcagaatgcatgaagatttacaatagatcatccttggaattactttgtctcactacctgttttctcattaaaatggttgcctttaatatgatctgcataactaggctgtaaaatgatgattgaagataaaactaggagcctaatagaatttcccacaaactagttctcctcattgacccaatagttttaagtattgttttaagatgttttcttttttaaaaacatacatgtgaaatggctattatcaagctcattaacatatcctctacctcacatacttacatttttgtggtgagaacatttaagattttttttcttagcattttcaagtgatttgaaactatttttacaatatgttttaacatattttctgaaaaaatataaagtctttagaagagatattctagaacattttacttcaccatttgtggaaactatggatgagtggcagccattgttggcaagtagagagactagtcatagaaaatttatttaagccaatttccaagttaatataggtgaaattatgataggatttaagtctttgtagagagtaagtggaagaagtaaccttatataattgcagagaaactatcagggccagttacactatcccagcagaaatattgcccaagtgatgtcttgcagaatgatgacttcctatatatcatcaagctgaagatgccattgacaataagatacaccattattttcttaaaaggaaaaatgctgtcagttcaactgtgacatgccttcaattgcaaaatatggcctgtgttcagagctgttaaaatgtgataaatatgtccttaaaattacatgaaatagggtaatttttttcacacagattactctggtgcaatattttttgtaaataatgcagactgatatcaggaaaatccttcattctgtacaggtcagaactccagtgaggtttcactccctctgaagagtgtttctaactccaacactgattggaattaggtgcctgtcctgtgagctcctacaacacctgtacacagctccactgaagcttacctcaacagtcagtttattgattttctgtacctaccacaggatttccaaagccctgagggcatatgataaccctttaaaaaattgtacgatagtgcccagcgtgtggttggtgctgaatgactcccatgaaggaacaaatggatggataatacacagaaggggtgctgatgtagtgatgtagtagccacaatgccaaattaagtttttccttttaaactcttccaaagactaacttcccacatctgaatcatgtttcagagacattttcaagttatcctaaaagctataaaatttagtgccctcttggataatgtgatgcagaactaaaacctgaaggtagttacagtgaactaaaataaaaaaatacgtacaagaaaagttgtgattgtgtactgatatggttatgctttgtgtccccacccaaatttcatcttgaattataatccccataatccccacgtgtcaaggaagagacctggtggaggtaaatggattatgaggcggttttctccaggctgttcttgtgatagtgagttctcacaagaactgatggttttataaatgttcggtagttcctcttgcattcattctccttcctccctccttgtgaaggtgccttgcttccccttcttcttctgccatgattgtaagtttcctgaggcctccctagccatgctgaactgtgagtcaattaaatcttttccatttataagttacccagtcttgagcagttcattatagcagtgtgaaaattgactaatatatgtattaataatttatacattttgtttttgtgtgcgtgtgtaatgatccacttgcctttttcactcacacttcgtattaagtgtaacttaaaaataaataagacatgtctgtgtgtgtgtgtgagtgtgtctttaacaaaatgaaaaggaaatcatatttctttccagagaaatggatgagaatgcagggtgcaacatagcataactgagtaaaaggaaattaaaaaagaaattataatattaaaaattattgggtaataataattttgactgggtctaacaggatagtaggacctataaggtaaggaaatgaagatattggaagcagaaaattactgcttttcccctcttaaaaggtaatgataacagaagacgtatagatagatagatagatagttagaaatgaatcaataataaaagattggacaaacattcttctgatgccttgtgatgtaaaactgaagaaaattgagtcctttatattttgtccatcacaacactaacagtttgattttttagatgcctgatgtccctaatttagtcatgtcaatgaatgttctactagggtactcagcaaagttttgccatcctgagttgcgtaatttggatatggtcaaccagtgcttcataccaagatagctaattgtgtgtggtaatatagtgctcactcctctctttaaaattttgtattactaagttatgagattaatgctgctacagttgtaaacaattatgggatcttaagttctttaagactacataaaggtatttgtactatttttatatattcaataacttgctttgtcatatatgtaagcatatatttttgaataattttgcttgacataacatgcatgaatttgctgtgaattaaaggccagtccttatatacatggtgaaatatggtatatttttgtctctggtaaacccacaactgggaagcagataatattcttgtccagtaacactaacttttgggaaacatagtttgtcctagaaatgattgacatagggctcatggttttaaatacttttattgaagattatggtaaatgataataaatcaagaaaaaacataaccaatttccaaatgtcttcctgatttttacatcagaacataatttttatgtacatataataaccatttgaaacaacttttgaattagccaatattttatttcccccaggtgatgaaagtagacacttttatgagtttcttttgcagtgagtttcatgcaattaagtcaaacaagaacaatttttgtaaaccacagactggaaaaattaaatggaagtagtacataaatgattaagagtgcattattaccataagtaaaattgttcatttcctttacttcgttaaaatttttatcatatatatttactttattaatataaactatactatcttagtaaacctcaccaaactataaatcattaaaaaatttttaccaatatatttatatcatgtagtattagaatgtgtcttgctgaacactttataggaacactattttcaacacattcaggtgaggtaagatataattttcttgtatttcctcctaatgatatggttgactgtaaaagaacaataatcactattgtctcaaagtaaataggctttgagactcattaaccaccttagttttgcttcagctattaatctgagaaggcatttattactttgcatattacagtccgatagagaatatcagttaattaattccagtgggagattttggtatcatcataaacaacattttaaaaaataagctaatcttataagaaaatggaaagcgggtgtgtgtgtgtgtgtgcatgtgcgtgcaaagagaaagaactgcaagtaatactgttttcacattcatggaagagacaagtagttatagctcagaaattcacagaactggaggtgacaggatacactttgatacgaagtcagcatatcagcatagtatgacagttaactgtgtaagctctggggaaatcttgggttcagatacatgctttattgatcattagctgttagaccttatgcaaattacttctcttttctaaatctggggtttgtcaacataaactggaataaaaatagtaccccaaaaagagtgtttaaaaaattaaggtactgtatgtcaaatattcacagtaatgctaaataaatcttggctgttattattagatactaggagtccacgtgatataaatgtcttcttcccaatcatatcatgacacatagggaaatctaaaattaaagtgagaaaaacttaatatctcttatgtttcagtatccctatacttggatgtaggttcactggaataaaaatggaatggaaatatctattctgtattcttggaattctggtgtggtctgtctttctagagtctgctagtctaattttttaacacaaagcagacagttgctgtgttttatgcataatcttaagtatttatttttgtgtaattataatttattttaaatatctatctttgtgtttaggcttagtatgactgttttaaatattctgaggtagatggatactgtgcctatgatattgggcaagtaaaattagcattgcttaatcacctatatcatggctgcattaatatcggctccttcatgagctgatattaatttccaaaatagtgcattgtgaaagatgagtggtatgcagaggtaaattactattatgcttgcaataattaaagaaaataaattaaaaattgattgcaagtgtaagttgaaattaatccatatagactaatagtttatccatataaaccaatttattgaaccaattatttattgaacacctgtcacattcaattttctatgttacatctatgctgtgttaacacactaattttatttatgtagaaatacatatttagcaactggagataccgacacaaaccagatatagttttgagcctgaattagatttcaaaatggtggatgccataacagaagtacaacagtgagtcatggaagcccagaaatggatctacctgatcacagacttctaggagggttttcttaaggctctgatgattaaattagagtggagaatatgcagaatactttatcccaccttgggagatgaggaaaagacggcacatgactgcctgtaccattgaaatttataagtaacactattctatgggattaggaaaacctcactgaaagggtgtattaagtcactttggccaatagtaatctggttcttgctgcatgcaaagaccttaaggatttgtgtaccattgagaactaacctcagcttcttatgtaacaagcagaggtgaaggagtgggggaaaaatgctataagaagatcgagtctttggttatgagatgagagtggtgtgattggtcttgacaaatatactctgttcaaataaattctgaaaaggtagccttgtaggaatccaagtaccagaggagctgttattgtagtgctactgcctgccacatctatcttggataatttctccatttagagaatatggtgtcttcagaatttaagtgggaatttgggggccaggtagaggaaatgagtcttcttatcttgcttccctttctctctccctttgccctgcctttcctttcctttcctttcctttcctttcctttcctttcctttcctttcctttcctttcctttcctttcctttctttccttcctcccttcccttcccttcccttcccttcccttcccttccattcctcccttcccttcccttcccttcccttcccttcccttccttctttccttcatgtctcttttaaatgtctagaatttaatattgaatgctatttgggtgaatgggttatattgggagggtcttaataggctcttttgtctccacctcatctgactagttcagactgatcacctggcatgatatgtaagtcaaataaaagcatttgcctttttggtggcacttagggatgacagggaacgatgggcaaggaccatggtagaagtttggaatattcactataagaaaagggagatggaggtgagcaatgatatgcagaaagaatgccaaatagcagggtgttgcaccatgaaccctgattgacccatgagttggttattgccttaatctacacaatgcagcattttctctagtagctctcagaacagagtatttggttggaaggaagtttgagattccaggttgtaatcatgggattctgaggttctaaagttgaatgattttaagctgcacagatgctgcaacatcttgtcctgtacaactttttaagttttgtgggaagtggcacatagtaagtgatcagtaaatatttctgaatgagtaaatgaatgtgtgaagatcattaaagtcaacatgatcaagaaaatgtgagaccagagtgttatgaattaaattattccaatatgtcaatagaagttgagatgaaaaggaatcagatacccaacactcaggcattacttagatatcccaaatccttatggccagtagcttactggatatcttcacttgagtatgtgtaggtatcttaagtttaccctaacttagttagaaattctgattctcatcttttccaatccttctgtttctctaataccacccttatacatagataaaaatggtccctaccgttggcactgtgcttactgtgacttctttcagctatggctcactttttggggcaaaatggtcatatgctcactgcaaggcaatattttcgtccacatcagaaccaagctctaagtatcctgagtctaagagttactttcccaaatggcccattttccacttttggctctgtacagctctcaaccccaggttcattctcaaaaaggtggatggtgtcactagtgtgcataccttgaggctcactaagtgaatatttgcaccggtgggagactggacagaactggatatttaaattggagtgtccaaatgaatgtgagtgagggtactggctgagaaggatatagcaaggtatgaaaaataaagggtttaggctgggggccaagggccagtgttctctgtgcacagagaacacagagaatttttcctgcacaaaattccaaggaatttgaaaattatatatttaagctaagtataaagtttattaccaggtgtttttatgaatgtagaatgatacaacatattatttaatggattattaacttcattattactttttttttttttgacacaaagttgcactctgttacccaggctgaaatgcagtggcatgatctcggctcaccacaacctctacctcctgggttcaagcaattctcctgcctcagcctcctgagtagctgggactacaggcgtgtgccaccaaccccagctaatttttgtattttcagtagagacagggtttcaccatattggctaggctggtctcgaacttctgacctcgtgctctgcctgccttggcctcccaaagggctgggattacaggcatgagccactgcacccggccacttcattaatacttttaaaacacttaagcacatgttgaacttcatttggaaccaagccttgggacccacagatattatggatgagtctaccttcctctaaactttgctgtctcagttgatgacatcaccatccatccagttgctcaagatagatagttagaagttatccttaattcttctctttgccttgctcttattttctgatacagaagccttaagattctggtataaaatgtgtgttgaaattttatgtatttcttcctatatccattgccaccaccctaggccaagtcatgtcatttctagcttagattagttgaaatagtctccttagctggactttcatgtttacaagctctaatccattctctacatagcagttagaagtcatccttccaaaacgcaaatcagatcatgtcacaagctggcttagtccttcagcagattttcattacccttagaacaatatccagattctttgcagtggcttacaaggccctggctgacttggctcctgcttatctctccaaccttgtcttgtttcctcttgatgattacatttcagtcacacagtctttctcggttttcaaaaaaagctttatttgtgcccagaatattggctatttctctctctgcatgaaatttctttcctcagctcttttcactactggttttgtcacctttttgatgtctgagattttattccatctactaacagaagctttatttggcctcaaacttgtgtgactgcccccactcctgatttccaccttcacggtgtcctctttatttcctgtgttacacttagcacagtctcgaatgtgtgtgcttgtttatatgactgctcatctagaatgagtactgcatgaagacagaaactatgtatctctttatttctattgtattattatcactcagacccatgcctgacacatttgtagaaccaatatgctttgtgatgaatgaatgactgagaagaaatgagaagtaggttatttagtgagtttaatagaaggagtggagcagctgatcattatgggtagagcaggagttcccaatccctggctgtggaccagtactggtctgtggcctattaggaaccaggtcacacagcagggggtgagctgccagctagggaactttactgccttagctccatctcctgtcagatcagcagtggcattagattctcataggagcgtgaaccctattgtcaactgtgcatgcaacggatctaggttgcatgcttcttatgagaatctaatgcctgatgatctgaggtggaacagttttatcctgaaaccatccccatctataccccactaaacccctccctgccatccatggaaaaattgtctttcacaaaattggtccctggtgccaaaaaggttggagatcgctggtgtagagtatatcaaaactatgtatttcttttttggttgtttgtttttgttttgttttgttttttgaaatggagctttactcttgttgcccaggctggagggcagtggtgcaatctcagctcatcgcaacttccgcctcctggattcgagtgattctcctgcctctgagtgattctcctgcctcagcctcccgagtagctgggattacagtgtatatacatatatgaaataaatggtggctgggaagcaatatgacttaaaaggagataatttacatctacatctactaccctttcaattgtacttagctgaagacttctttagaaaagttcaaattttttttgaaaagcagtagtagagtgtgtttgaaaaatagagtttatcattgaagttaagttctaatttctctatacggtgtttaagaacaattttcaaaattaaaaatccagttggattgtgaccaagatttagtgacctccttccaggacaggatttttggagtgtggatcacattgcaatatgttgctatcaatatctgttagttgatctcagctgatgtgttattagtgaattaatggagtggactagagtaccttgcatgataggttaggtattgtttcatggaatttgatccagttgtgtgtatgtacatgtttatatttttttctgtggtaggcttccagaaaaaattgtatttcttttttttttttttttttttttgaggcagagtctcactctgtggcctagactggagtgcaatggcatgatttcatctcactgaaacctccatctcccgggttcaaacgattttcctgcctcagcctcctgagtagctggaactacaggtgcagccaccacacctgggtaatttttgtatttttagtagagacggggttttaccatgttggccacactggtcttgaactcctgacctcatgatccacccgcctcggtctctcaaagtgctgggattataggcgtgagccaccacgtctggcacaaaaaaaatgtatttcttaaaaaggctctaataaaaaacatttgaaagccactgttctaggtgataatgattgtaagatctttgtgtatagttcttgctagctcagtcttattaatagtttcattgagagagaattcaacaggtatttgtttgtaagtactaacaaaaaattgtacattcaatacttatcaaacaaaagttacatgatcttattcttccactattaaatttttattttatttttaaattttgattttttggcatttcacctgcaagtctttttgtcttattagagtcacactatgtgatggtattttttctttatccacaatctcccctgactcccctgttactattatggaataatgtaaagttaagaattaattatgattacagtagttatgggtaattaggtactatgaatcaaatcttagaaatcactttcattattgtaatagtgcctcagaaaacaatttttcctctttgactttttaaattgttaatactatcataaatggcatttatgtattcatttaccaaatattgatcaaaaactactttgtgtctaccatcagaatttaaaagacaccttcctagatcatagagaaggcttactgacatggcacatacagaatggtaaacagatagctacattacacaatgagataagtgcttcaataacaatatagagctgtaagggagtgaattgaagagatactcccctattcttaaatgttcagtgaaattcctttgtcccaaagtgctagttaaacgaagacataaagaatagtctagcaaaaaaaaaaaaaaaaaaaaaatgtgattgtggtagttaatgttccagtcagagaaaatagcatagtatgggagatgagggtggaggagggctatgaaatacagtcgcaagaataagccaagttaaataatttaagctccatcctgggtatatagactttcaagtgtgtgagagagcacatacaaaattactaccatagaagaattttgatggcacttttaattcaagtacacttgaccataggtatctgaggtagtactagattcttgaaaagagagctaatccaagacataaagggtatcaactgataaaaatcctgcaacttttgtatgcagttggaaatggtaagaataccagcatttagaagagaatctccaaaattggcagatagaggaaaacacttctatatgtcttaggatagtagggaagagtgcatcatttgctatataaatggaaatgttcatctaagctgcattttgtatgcacactctgtattggtctggtctcataatgctatgaagaaatacctgagtctgggtaattcataaagaaaagaggtttaattaactcacagatctgcatggcttgggaggcctcaggacacctacggtcatggcagaaggcacctattcacagggtggcaggagagagaatgagcgctgagtgaagggggaagccccttgtaaaaccatcagatctccggaaagctcactcactatcatgagaacagtacggtggaaactgtccccatgatacaattatctccacttggtcccacccttgacacatgggtattattacaattcaaggtgagatttgggtgggaacagagagccaaactatatcacatccccacattcaagatgcatgtaagcacttctgcaccattgccatactcaggctccagctttttatggaatttcatctctggctattcattcatccattcattcatacgtgcatacatacctaaatgcatttagtcaattaatcaatcagccattttggtggccgaaatttataaggcaagtaatacttttagtttctttgatagacaccatgatcagaaacatagtctctttcttaaagggaaaataggaagtcttctgagtcataacagatgcatacataaatttctctgagtcttcataagaaacacaagcaagatttcacagaggcagtggaatttgaactgagtcttgagaaataagcaatatctgaacatgtagaatgcaaaataaaggataagcaagtgctaatgcccagagggtaatacatattaaataaccaataaccaattgctacttgtgtttcttacactagaagacaacttggaactatttatcccaaatattaatttccagtttggggtcctgagacagtaacttcaaaacagtcgacattaacttccagtcctttttttcattccagcctataataataatttgtgtagctgcccacatctctcactaaatgttaagataactctggtttaaaatataaataattgaagaataattagatattttgagattaagaaagaggatggaacttacagaggaaagataaattatagttagaagtaaccttgaggtacttcttgcccaatttctcattttacatatgaaaatataaattatgtgacatcccaaggttgggcacaattgtagtggcagagctgagactggaactcacagttcctgacttgcagtgattttctccccatgataaatctgattttgaaatataggataagaagattgcttgtagaattaaaacctgagaacttgagtgtaatataagtgaaatagaaaattgctaaaataatatttacacataattttacttggatatcactcctaattagtttgagaagtaggtaggacataaataacaaataaatgaagtaatgtatactcaaataaacaaagcttaatctaatatagtcctcatatatagggttaattgttgaaaatccactagtgccaatagactgtatataagtatagaaatagcttcaaattcctgatttctaaaaatatatatgtgatatttcacaaaaattattttatggtagctaatataattaaggaaatgtgtatttcattccataagttaaatattttatgaaattctcaaaacaatgtatacatggagagttgcaaccaaccctaaaaataaatattaataaatattgcaggagaatttttgaggatgatacaaatttattcagttaatatggatgacaaaaataaacaaaataacatgattaaacagaactttctggaaatttagtatactaatgaatgttataaatatcctgtgaataatgtgaacaggagcaaattttggtatttaaaaacctatttatttacattagttaaaatatgaattagttgtataataacttactctctagttattctccttagaattcttacaaatcctgaagaaatggagctttaagtttttcgactttcataccagtatagttactactatggacactacttgttactactatttactactaatggctctcatttttgagcacatttttatgccaagcattgtgctaagtcctttctctacattttctcacttaattctaataatattcttgcaagtttgttattatcacccacattttacagatgaggaaacagcgtctcatggggaataaggaaatgattcaagtcaagcaatcattaaatagcgcagttggtacttaggcctaggcctctctgatttcaaagcccatgctcttgacttccatgctacaccacctctgttcagttgccacatatgtacggagcctctagacactaacactcttttggatattagggatgccaagaacaaaagaacagcttcagcctttccagactttctccagaagagaagacatttaactaaacaattgcaatggaatcttacagttgctgtggcagtaaggcataagaacatagtcagctcatcaaagaagtcgtatcctttctacttacaaattccaaggaaaggctttttctaagaagtgatgcttgagctgagactagaagataaagaaatgttggatggatgagagaatgaatagttgtccagatttgagaaaagactaagaaccatgacacggcatggggaaaagtgtagttttcaaattgactgaagtgagaaatacagctagagaaaaaggcacatgtattagcaaatattgtatgacttttattcacattaatcacatataagaaaggttacaatatattccatagttattgagatactgttgatgaccttatagtactgaaaaaatggccatgtttgttctctgtgttcactctgaacgtaaagcgcaatgccatgaaaggggccacactgggaagaagaaaaccagtaaggagaatgtaaacatgactcccggtgagggctggagggcctttttaaagattttactttttctgtttttaaaacatatttcttgggttagatgaacctaagaaaatatatggagttctgtttatttcttacatactttaagttacatgtttacatctgcaaatatctctgtagttgttgggttatcattgtccatcaaactctttcaaagtagtcattacatccttttcaagtgcacatctattgaatagttaccatataccaggccctgtccatgagaagatagttaaatatctaggattctgggtaagactgctcttcctgttcagaaaagttcagtacagatcaggaaactgagaaacaaatataacaatgtgggatttgtcaaagatatctgatatataggtatttaataaataataaaggtgacatttaggatcatcatggaaaaggcagattattccaaaaaaaggctttaataaagccagctaatcatttgggggaaaaaaggtctggtcagtactccgccctttacaccaatataaatttcggatgaatgggatatttaattatgaaaactgaaaataacccaaaatttgggtgacttaccaacccaaaatttggctgacttagaatgtggggggattttcagtaaattataccaaagacagaaatccataaggaaaagacaaatttgactatataaaaacttccaacttctctgctatgaaataacatatacatggtggaagaaaaataactgtgaaagttgtgttcaacacaagtgagagatgaaaggttactatacacaataaaatattaaaatgtattcagacttgctaataatctaaaaagtagaaataaaatgataatgagatatcattttagcctatccaattcaaaactattttttaaaagtaaaggatacaaaatttcagttagataggaggaagaagctaaagagacctattgtataacatggtgattatagtttataacaatatattatattcttaaaaaatgcaaagacagtgggcattaagtgttctcaccacaaaaatggtaactacctgaggtaatgcctatgactgtaatctgactaactagatttagtcattccacatgtaaatatacttaaaaacaaaacttcatgttgttttgaagagagacggtaggcatatatgtgttgtataacaattttatctgtcagttaaaaaagctatataatatgaatgtgtgattatattatattaatatcctataaagtgatcatattataactgtgtggaattataatgatgtcatattttaataatataataaaacagccattaaaagtggtatagtaatattcctgaatatggaagaaacctttcgcatactcaagataaaatttctttctttcctacatttgcattttaaaatttgtattttctttttttctttttttaaagacagggtcttgctttgccatccagactagaatgtggtggtgcaaaatcatagttcactgtaacctcaaacccctgggctcaaacgatccacctgccttagcctcccaaacagctaagactgcagatgtgcaccaccacacccaaataatttttattgtttttttgtagagatgaggtctcactgcattgcccaggttggtgtcaaactcctagccttgagacatcttcccgacttgggctcccaaagctctgggattacagagtcgcattcatcctatatttacattttatatgtaatgcatttttatattcagagaatacaaaaacttccattttgtaggaaaaaaatctgatgcatttggtggagacattttattactatggcagatctgggttctaggtatacccataacattgtgtcactagtgtgagggagctagactaactcccaccccaaagcacctcactcattccagctttggtctgctttaggtctggtgctgagtagacttggaattaatccttgccttttaaatttgagatagcagaaagcaaggactagtactgcttcttagtcaccactctgccacctccattcttccaaccgttcaaactcaaaaccctggagttttgggtgaactttccttttctttgtcttagccaacatcagtactcaccaagtcctactcattcttgcctccattctttttccttcacttggaccaacattatcatattctggggtctcatgggtattgataatgcaataactttctagttggtcttgtttccctctgtctttttccctttaatttatcctaacattgctacttaaattcttgagaatagcatgtttcatcttagtcattttctattaccttttggatggtgatttcctttctttccttacttcagatgaaaactgtgaaacttgtagatggccaactattgttctaaggatgtgcagtgagcttttcagtctcatttgtctgtagtatcctgatgcacctttgattgtcttgccttcctttcttacttgttggcatctcttttacctatttatctttttgtatctctctgtggaatgaagtataaacataaatatcataaggaaaagccagataactccaataattttcagtgtattaggcatttttggaaaaaaatccagagttaaattgtttatacactttcaagagtctagtcactgctaatttctcctctttgctcatcatttcttagctttggcagattggcccatttgttcatttgtcttttgacccaaataaaaatggtatcttttgtagaaagctctgtaaaggatacctttatatatgtattttcttattctctgttataaaatgacatgcttctttttcacatcttcaacagaaataacataatcttgcaagacttcttcaacctgaatccttgagcttaaactgatgaccaggatacaatgtgatataaggattaagtacttgatctttaatgttaagataggaatttattttaaaaagcatgtttcataactgattcagctgggtgacttggggaaagttacttaagcattttaagctcgagtttccttctctggaaagtgcaaccatttttgagctattttccttcatcggaatgtcctttcctttctgtccatctgcccaccttttaaacattttgaacatcttaaaatcaattttctgagaggacatgcaactttacttcattaaagtatttactaaattgcaaaattttatttatttatttatttttttttttttgagatggagtctcgctctgtagcccaggctggagtgcaatggcacaatctcagctcaccacaacctctgcctcccaggttcaagtgattctcctgcctcagcctcccaaacagctgggactacaggtgggcgcgaccatgcccggctaatttttgtatttttagtagagacggagtttcactaaattggccaggctggtctggaacttctgaccttgtgatctgcccgcctcagcctcccaaagtgctgggattacagacgtgagccaccgcgccgggcctaattgcaaaattttagaaatagaaatgttttgctttgttctaagtagcattttccattttgtttattatgaatattttatgacaattgttattcaaagtttgcattcttcagagtttctttttatttaattataatgtgaaaattaattgacaagtgcaattttattttcattttaagaatttgtagcaaaatacacaaatattcagatgaagttgaaatacaggctaagaagtcagttagacaaactgatttggggcaactgaaccactttagacatagatattcattatcagcttcccctcttccacaataagatttgaaatatgccccttttacttcatgtaccaattatatttcagattgccaattatggctccttgaaatatgataagaatttgtattaaaccatttcttgttgctgtaatttgtagtcaatttgatgttggcatggccagaagataacctcagaatgtcctgcaagattttgatgtgtaagttatataaatcatagaagaagaaatccagaattggaatcttgaatattaacagtttaccttagcagagatgctaaaacctcaacacagcattggatagttagtaatatttttagtacatactatgttactaattcaaagagggtgaaactacattgatatgagttgctaaatattatccaatgcatttctttttctttttctttttcttttttttttttttttttgagacagagtctcatgctgttgccaggctggagtgcagtggtgcgatctcggctcactgcagtctccaactccctggttcaagcgattctcctgcctcagcctcccgagtagctgggattataggcacgtgccaccacacccagctaatttttgtatttttagtagagacagggtttcaccatgttggccaggatggtcttgatctcctgacctcataatccacccaccttggcctcccaaagtgctgggattacagatattaccaacatgattccagttcattaaagctgttctcgtggctgtgtttcatttttattaggacattagatagtttaattatatgacatccagtataatcaacttgagtaagatagtttgcaacgtatatattacattttataaaatggactaaaggcatatttggaaagatgagaacaccatatttatcaacaagtttttgcatctgcccagtgatataaagtaactcaggatcacaaagcaacaatatacataaattacagtaatcaaaatttatgttaagcacaggcagtgaattgtgtaagaataaagtatttttcatcagctgaacagttaccaagaatttagattcacagccttggctaaatgacccttccccacaggaagggttctgtggggttcctttattgccattcagtggtgcttgcttgagtagtttgaatctgcccatatgataggcaccttttttattgtataatgatcctggccaagtcatgcgattgggttgccaccttatgtctctagtaaagcaagacactaggatttgtgctgaaaggaaaagagatgcagaaagggcacactggaacttaaagattgctctgtgtgtgccagacacagacattgtaagggctgtggctttcccatcactcactatacttttccaatcaatatcgtcgtgaggtgactgcagtgatattatttcactgtgtcaaaaaatgaagtgacacctaataaaaatgcaaaggaaaaagctggaaaccaaaagaaaatggtttcatgcttcaaacacaggtagaatataataaaattatgggagatgatgtgtacttcaataaaagtttattaagctgaaagaaataatatggtgtagtataatttacttaattagcacctaattagtaagtaaatgtatttggttcttagatggtgaaccatctaggttcctgtaggataatgatggctgtcaaaatttgatctctccaaatatcctacagaaaaatcaacaaggagagtaaataaaactcttttcaagcaagcttacagaataactagcagaccaagaatactgcacattttaagatacttcttaatgggaaataagttacaggaaacctacacagccagttccaaagcccatgctggaaccagtgtaggcagagagagaagtgaaccagggagtgcagcaggattctcttggtggctgggcataaataagatcactcccaagagggagaagtactgagaacagctctggcagctggtggatgagaccactgtgtactagagaatcctaaggaagaatcttaaaggtatgcagagcagaagtgacagtcttgggtatgcactgcctcagcgggagattctcttagaggctgagaggtgaagggaataaaataagcagttggtagaaatttgaggtattaaagaaaggaatgagtatctgaaaatcatatgacttaccactccctttctggaaataatttttttaaatacattttattacaccgaaaaaacaaagttctattgacaacaacaacaataaaattcaaattcttctttcctagacagaccaattttcttgttattgaagaaaaccctcagataatttaaaataaatagaggaacatcaggctgtattcaaacaccattactataagaagaaaacaaaaagtaagtcttttttaatctgatgattatgattcccaaatacaacccacaactcagaagaaatattattaagcatttgcatatgtgaaagaacatttcagattgaaaatttaaaaactgaggagatgaattaaagaaaagctgaaggatgtggcataagagttgataaaatcaggaaattgaagagaaaggtacaccaaaagaggccaaagattttttttaaaatgaaagtaattggaaatcagctattaaaatatgaatctaaaaaaaagaagaaaaaagtgcaaaaacaaaacaaaagaaaaaaaacactaaaaaatttaaaaacataaaatgtgaatatataagaagaaattaataaccgtaatgttaagctgaattgcttgtaaatcatttaataagcataaaatattttgtagaatgacccacactttctccttcataaaaatataatggtctattatcagaggtgaggtacacatttgttttcagacagtacgacattcattaatgaattaaaaattgggaaatatttataaaatatttctttgatgatgtccagaaattgatcgtatacatattatgagggaaattattttgttgtaaatattttcattgcatgatatctgtccatacatatatatgtatatagatttttttttctccgaagactcaaatcttcttgagggaagactttgttctttatttatatttatatttccagaacatttcatgatgccacatgcatcctaggtgcacggttaaattaacatttgctgcctgaactgtagcatatatcaaccagctactacttaccttataactgcgatattcatatttttagtagagagaaacttgttattttattatgtcttgaaattcatggtgaacctggtgagtaagatcagagagggcgttgactgagcttggcagagaagcaagggggaagataggaaaagtgatgaaaagtcaagccctttgaaggctgtagtggtagggtatgagagaggagagggaaattttagagcttcttccatcaagcttagtaggagtcagcacatccatgtgggcacagagtgacagcaattcagaaaacaggcatggtggtggctgctcacactcagtttgtgacttccagatctgtaattaatataatgaattggacatagtctagttttatgacaatctatagcatgcatcttgtttcttgttacgagtttacaagttgtggctcagaattagtggttctactgtggaccatggggctttacctaggctgacaaggaggtaaagacatcttataccatgttaggcaccataatgacctgagatgtgcagcagctttctgttataggtgctgatgaactatgcttcaaaatggcttgaggctacataaccacattgctagtttttctcctcttgatgtatggtttgaccattccatggttagtaggtatacagaaaatgccttaaacattatgatgtttttattatagagaacagaagaaactctcaccaactgaacacttacatagcttataattcatccatggacaactcaaataaaacataacttgataaatataattgagtcccctcatgcattgaataaatttgggtcattttctaattctatcagaaccaggaaatgtaacaaaatccaactgtaatatgcttaagtagaaaaatatacctcagttaataatttaaaagagctgcatgtgtttatacaatgcctagccgttacatgtctcagaccattaaatctctatggcattatcacagtagttacctcatttccattgtacagatgaggaaactgagacataggttaatagcttactcaaaatcactcagatagtagctgccagggtttacattaagacagcgtggctcggtggggcgtggtggctcacgcctgtagtcctagcactttgggaggctgaggcgggcaggtcatctgagatcaggagttccagaccaccccagccaacatggtgaaatgctgtctctactaaaaatacaaaaattagccagacgtggtggtgtgtgcctgtaatctcagctacccaggaggatgaagcaggagaatcgctggaatctgggaggcagaggctactgtgaagccgagatcgcgccactgcactccagcctgggcacagagtgagactccatctcaaataaataaataaaaataaataaaaataaaaataaaagacagtctggctgtagtgtgtgtgccaaagtactgcagcacatttggtactttctacttaaaattgatttacacagtaaaagtgacagaccaacaatagaaagccaatgttttaattcattgtggaagaatcagtgatagcaatgactaaatttttaaatattatttgtcactgtttgacaatattattgtagacacactaaatttatatattttctaaaccagaattgagacaaatgagtaataaaaacttcccacagtctgtacatttagataaaacaggtaaaaaattaaaaagcaattatacttttgatgttattgttttttaaaaattaaataatgttttctagaaaattgttctatttaaaattctctttagctttgatccttccaaaattccaattaatgtcaattgaggtattgctgattttgaactcttcacttcttgagatctagaatatcgaaagtctggcctctttcttgcaatcagttctaatcagcagatatttattgaatgcctattaagtgcaacactgttactaagaaataaatatcttcaaataacatgcattcttgtagggaactttcattcttcaagatgatagaagaaatgtcacaaggtgaaatatgtgaattcatttccacatgaataaaacagacaggatgtactatggcatttctgaaggagaggggtctttatacttcagcattatggataaaaaaagttctcatggaaagaccaacttgaattaggcatttctaagaactttttaaccagtaactttaaaacactttccagctaagttgtagacttttgattttaacagacaggaatagaaaagatgtgataaaaagctcaaatttgagaatgaactatatcccagtaacagcattgagtgttgacaaaaagatgtgttcttttaaaaatcaaagcaatagatacacatagcttcagaataaaataatggcaataggtttataaacagagtcagcagacacctacctcattccctacctcccttggtattaacagggaaaaattctattaaatattaattttaatatttagctgtgtgtattaaaataatacagatatactgtcatttctaaatatatatacttatatatatttattttggacatgatctgttgattttttgttatagtacttactttgctcacttaaaaaaacatacacatacacacgtgtacatgagtgcctgtgcacacacacaagtacctcccctccatatatttctccaacaaattcattctgataagtttatggtgaggtgtattgtcagtattattgccgttattcccatgtgtctttttttctttctctatatagtctctgcttcctcctggtttgattatcctgcttgtttctattggactttctttttcatgttggaatacctgataatccctggttacgttctccattaagagtaaagcactgaaaagctctgtgtgcttggtgtggcggctggagaatgaagagagaaagtgataggctttccagctgctgagtgtgatcagtgaattggactaaaatctgtatggagggcctggcgcggtggctcatgcctgtaatcccagcactttgggaggctgaggcaggcagatcacgaggtcaagagttcaagaccagcctggctgatatggtgaaaccctatctctattaaaaatatgaaaaaactagccgggcttgggggtgcgtgcctgtagtcccagctactcaggaggctgaggcaggagaatcacttgaatccaggaagtggaggttgccatgaaccaagattgtgccactgcactccagcctggacaatagagggagactgtgtctcaaaaaaaaaaaaaaaaaaatctgtatggaggaggtcttacaaatattagtaaccacactttttgttttttttcttcaacttttcagttttggggtacatgtgcaggatatgcaagtgtgttacataggtaaacatgggccatggtggtttgttgcacagataaacccatcacctagacattaagcccagcatctactggttattcttcctgatgccctccttcctccctcccacacccccaacaggccctagtgtgtgttgttccccccatgtgtccatgtgttctcatcgttcagctcccacttacaagtgagaacatacagtgtttggatttctgtttttgcattagtttgctgaagataatggcttccagttccatccatgtccctgcaacagacacggtcttattccttttaatggctgcatagtattccatagtgcatatgtaccacattttctttatccagtctgtcattgttgggcatttgggttgattccatatttttgctattgtaaatagtgctgcagtatacatgtgtcattataatagaatgatttctattcatttgggtatatacccaataacagaattgctgtgtcagattggtatttctgcctctaaatctttgaggaattgctacagtgtcttccacaatggttgaactaatttacattcccaccaacagtgtaaaagcattcctatttcttcacaaccttgccagcacctgttgtttcttcagtttttaataattgtcattctgactgctgtgagatattttgattttgatttgcatttctctaatgatcagtgatgttgaggtttttttatatgtttgttggctgcatgaatgtcttcttttgagaagtatctgttcatgcgctttgcccactttttgatggggttgtttgttttttacttgtaaatttgtttaagttccttgttgactctggacattaggcttttttcagatggatttgatagattgcaaaaattttctcccattctgtaggttgtctgttcactcttaagatcatttcttttgctgtgcagaagctctttagtttaattagattccatttgtcaatttttgctcttgttacaattgcttttgacattttcatgatgaaatttttgcctgtgctatgttctgaatactgttgtctaagttttcttctagggttttcatagtcttgggttttacatttatgtctttaatccatcttgagttaacttttatataaggtgtaaggaaggggtccggtttcaattttatgcatatggctatccagttctcccagcaccatatattaaacagggaattctttccccattgctgaagatcagatggtttagatgtgaagtcttatttctgagttatctacctgttccattggtctatgtgtctgtttttgtaccaataccatgctgtttggttactgtagccttgtatagtttgaagttgggtagcatgatgcctccagcgtgtttttgttgttgttgttgttgtttcttatgattgacttggctatccaggctgtttttttgttctgtatgaatttgaaagtagttttttctaattctgtgaagaatgtcaatggtagtttaaagtgaataacattgaatctataaattacttagggcagtatggccattttagcaatattgatttttcctatccatgagcatggaatatttttccgtttgtttctgttctctctcacactttttttttttttttttttttgaggtctatcagtcagcttttcagagtggaacaatgtagttttcaatctgggaggtatgcatctctctactcatgttctggaagctagatgagaagaaacagcagagttaaatatgtagacatcagttaattactcactttcccaccctccatatgcatttattcatgttttaatttgcattgtgctttgctgtgccgagtttcctccaatccatgatctctcagattttctttttcaagagaatacccttctagctgggctggttagtcacagtgtagtggcatgaaagatcattacctggcttcacagagttggaatcttgcactataagttaggagtctgggaggatataagtcaggaggacatgcaccctctctttggcatttccctttgaagtcagacttagtcagttgctattattctaagacctttccatcaatgtaaatgaatataggtttcttacttgttcttgtctttctcctcttcattttttctatgtggcttagtaaattattttttttctttactaccatttagtggctttggggcaggggcaggagattaatcatgcatattcaattaaatagaagcaactatgtatcttattaatatgattaatatgattgctattccctataaattttccagtaatcctatgacattatcccatttagtggatgagtatattaagattcagctaaggttaagtgacttaccaaactgggtttgactcaaagatacagaaacataagaatacagaattcttaacattttaattaaggacaaaagtttagtattcttttcccttagataatatcttccaaataattttgatataccaagcaaacagtgtacatgaggttatacaacattccattatttccctttttacatttatctgaatacatcaccaaagtttctgaacaacctgagtagtcagaattgtaccacaggaaaagagtcttcttccttccagttttcaatgtcactttatgtcacatttctttaagctattctgaggtacaaaccattccactttttgcccactgtactgtcttacatctgctgcactatttctttttgtcaggacagcacctcatttccaggtcttagttgtctttgttgttaacccaattacctcaaaaactgcttcaaacaaaaatgatcatttattatctttcacattttgtggattacaaattcagacacatcacagtttctgtggatctgctgggagaatgaaaggtcaggagcttgaattatcagaggtttccttcacttatatctgaaggtggattcttgctgttagttgggacttgtgaagatggtgaagggtctgagattttgccagatatgtaaactatcatacatgctggcagaagacacaagattcctgagtcagagacaaaagactttattaattaaggcatagaagggagagtgattttcaagttcacgcaattacccttgttcttaagtcctacaaggggaacatggagtgactcaggtggatactgcacatatagtatatatgcttcatagatgagcaaccttgagcttggaaaatatcaatctttgcaatgggctggaagtgaacttccttgaactttgcactgaagggcaacatgatcctctgactggtcagtaaacaaatctacccttgctctagagagggacgctgtttctgtcttccagggttctctggtatgcaaaattctcggaaaggtaatctggaacaattgtctctgctagcaagatgtgcagaaacacaaaagactcattgagaagtttctcctcataaaatgaaaggaggacaatggactttaaacaataattggcagcttctgaagtgtcttttaggacagattcatatgaacaaataattttaccagattgtaaaaaatgtagaggaatttggactccttagattggtggtccaaatgaaaggctgataaattctgcttgggggccttgattcagagaagacttcaaatagaaaatgcttgaaaggagcaaattagataataaggaaatctttacatactctattgctgttcttattgttgttgtcattagctgtttaagcgtatgcatatgacttatcacatctaagatgcttgaatagttttggatagcatatattcataagaacatttgttaacattaaagtaaacttctagcctggagaagggtagactcaggggtatgcatgatagcatgtttaaataatctgaaggaatgctgtagggtgggtggagtgacaggtttaaactgctccagaatacagaatcaggatcaatgaataaaggttatgagaaggctgatttaccctcactacaaagaagaacctttcaataattaaagcacagcctgggaggaatcttaattgacaaagagaaagtgcagctttgaaagcaaatgcagagagagcttcacagaaaagagagcatggaaaaatcaagccctgaataatgtaatatcatgtgttggtattcagaagccaaaggaagatggtaaaatggtagcagtgacagtggtcctgggagagagatgttctttggataatttcataattgggtaattatgccaagaacacatgtgtacccccaagaggtagacaacagcaccagtgaagacagatggagctgacttagagtgagcttttcccttccttcctcaccctgcctcattctctctctttccttccctttattacttttcccccactttcacgatataaatatctactttgtgtcagacactatgctcagacctaaggctatagtagtgaatagaaactgtttttaccttcaagaaacttacaagttagtaagagaaacaaaacaaatatatgacaacaaatcataataatttgcaagggagattttcaaggaagaaacttacaagggacaaccaaattagattgaaagactagaaaagcttccctgaagaagtgatatttaagctgagatgtaattccaagtaagaattttccaggtatagaaagaagggattgctatggaaaatatgataggaaagaccttctcacaataagaaactgccagaaggccaatgtggttggaaaaaagcgcctgtggataaatgatctgagaagagactggagacttaagcaggatcctaaagcagaactgggcttctgcttagaggactgattggtgatgaggaggtgtatagagggctgaccctccaggaggctgttgccacagtccaggtgtggtatgtaccaaatacctggatgtggaggaggagagacatgggtggatgcttttccacaccaataagtaaaacaactgaccaatctccaagcaaaaaaaaagtgatcatccatcagtattattttctaattgccatcaaatgtctatgaccctcagaaagcatgatggttaacaatacagactttggagtgagattggctatgtccagatcctagcttttgtatttactagttgcatgaacttgtgcagtctggccttcagtgcatatacctgtaacataagctgcatagacatgtctgttttatagggttagtgaaattatccaaatggcgattatccaaatcacgatggtgatttatggaaagacatcacaggcaaagtatacaagtttctttaaagaagttaacaagaactgaactgggtagaaatggttgtacaaagccagaagctttccacattattcctattagaggagcaaatatcccatgccattcaagtatgtcaaatgtgccctagcatttattggaccattaggtttttcttggtgtttctttatcattcttctgtgatgtcttaaacccttttggtttgttttaatatttatgtatttcttaagaggtacatgtaactggtaggcacactgccaacacattactgaatttttctcaaggttaccataccaagtgtattatcctttagcaggccaaatattaggttttcttgaagtttattcctgcaagtttgtgcaacaatttaatgacacattttaaatttaaaaaaaaaaaagaaaaaaaaacttggtgcaaacctggaaatttgtaaatatagaataggacgcaggctttaattactagtgaattgttaaataaatctgtttggtttagttttggttattctaaattctattctaaaaagaatttcttgtattattttccaagagcttataataaagtaccccttcaagtgtaataatacagacacgtctaatcgaagtgagccagctcaccatctgctcacagttctgctacttaagcagtgataacactaaaaacagtctgccagagtttcagttatgcaaataaaataaatggtgggactcagactatcctagctttgcattaatttgtgtgtcttcagaatgacaccaaagtagaaacagttcttctgtgtattatgtcaaaggaatatattttataaaagctctctgtcaagtggaaaattagtttcaagatataaacagtttttgtgcttaagtttactaaactaataaattttaatcatgataattacaacaataatatacataaataaggtacgtacagcttattcctcctttaatttgcttaggggagggctttatgtacctgagaggaaaaaataggaggattaccaatttatatgcttggtaccaaaatatgtgattaaatttagttggctacatcaggccatcatgagatatctctttaggatgctcataaataaattggccaggtgtaggcttacagcctgaacaacatttcagggggcttatgggagtaaatagaagtaaagattagtcagtagtagtcctattcagcaactttatcaaacctggaccaaataatctcctgataggcaaacaatgccgtgtctttcccaagggatagcacttgatgtgtccctcttagtacacctaagagctctttgtggtcagaattcatacatcattaatgattgttctaatattgtttccacaaaatggtaacagcagtaatttgatgctgtcttttgttgcaaatatagtctgcttttgcgtaatccttagtcatcttgtattctccaccaaaactttctctcctgcttttagatttacattgtgaggctgtagatggagaaaacattcttcctctcactcttctttcttgttatctgttctgatgctattggacattttgggttgagaatctatcatattgaatgttggcatgaaatctgtgcattattcaaactcatatttaactcatatttatatgcttccaaaatgaaagcatataagtagcagcagtttcattttgtggaaggatttacattttccttttgagttacagaatataaggaagaaaatcaacaaagtcttcagagacttgatgttttaaaggtagcttgaaatacctcaaacataaattatccagcttgattatgtcaagaaaaaaagaaagaaatatcactttgtagtcatggttctctttttatatatttgtttattttgtagtcatggaacgagcatttcttgaacaaaagtagttattcattatgataaaagggtcaatattattttaaaaagaactgtgttggcaatattgaggcagcgtaaaacaatattggaattatttaaaatattgaaaaatacaaaggagatgatattcaagaaaccctaacgtcacaaaattgggtaaggaattaaaggaagattgcctggaacttgataaattaaattaaaaagttgttatttatgttgttcctttttcctactataatttcactgtatttagccaggcacagtcagctaacctgttagattgctgtaaaatttgcaagacaaaacttgtacaagagtttagataaatgtttagacctgacctatctgagttctacatcattgagaagaaaacatagtataaccctcatttaaaatctctcctttaagatagtccagcaacttatatccataagcaattaaaatttgtaactttatcaaaccatttttgaaataagtgattcttttaactttatttttacaattctacaattttaaaagccaaaacacaattacttgagggaagtgataaaggtgaatgaggaatcctatagtcttgaaactgaaaaatagttgagtacatattttctctgcactttatggaagactaaactgaattctagaaaatcagaagatgcctctagattgttttcaagccaagaccacatgggcatcttgatgtcttagagagtatatattctactgcactatactacatgtagaagattctaagtccattgaaaaaaattaccagggagagaaaatataaaataaataatagtacctggagttaatgtattgttaattttgagttcaaaggttttttttttcctatatgcacataaccaagctattaataataaaataacaagaagatataaaaaggtgatttttttttagtaagtaaagtattttgaaaaatgttccaaaatttataaaaatattggtatgggatttctaattttattcgtgtttcagattaatttattacaatatccagtgtcctgctttattaaacagctgagacaatacagaaaggaaaactagaaattaaattatctatttatgccttttaattttagggaaacagaggcttcatagcactcaaaaaatttattatggccgtcaaacagcggttcacaatagtgttctaaaatttaaaaaaatctttttgaacttcacattacaatgagcaactgagcagatggtactaagaaaagcttcaggtgtgtcttcctcttttatacatattttgtttaatttatattgaaatgcagtccagagatgttatgtttcgtttttattttattttatttttattttttttgagacagagttttgctcccattgcccaggctggagtgcagtggcatgatctcagctcactgcaacctctgcctcctgggttcaagcgattcttctgcctcagcctcctgagtagctgggattacaagtgtccaccacccagagacataatggccatttttgatattgttatggacaaaactttgattggtatattaattataggcaatttcaagatagaagtatagaattatgtgaatttttgcttagaagaaaatgaaagcaaataacacatacatgctgctgaattgcttcaaaaaattatatgcaaaaattgacgctgtagtcaatgctggttttccttagtatgaaaaaggtgacttttcagtctatcatgtactttcttggagacttttactaaagatttatctgcaaattaatggaaaaatagggtgtaatgaataaaaaaagagaaccaaacagccccattttcactccctcaacctttggctagaaagtaagtattctaaaagttatactttggaaccatatctcctgggttgatcttctactcagttttagcatgtcagttgatttttattccttcttgcacagttatttgttcccaattcttcaatattaaataggttcttaaaattcgaaaaggagtaatggtgaaacagtgtttccaaaacacaacatgacaggtaaggagttctaagaaacatttacaagttatttttgactgagaatgccttttttacttcctacactcttgtataaatgtagatggggaaggcattattattttctttacataattaagaaaaccgaagcagataacatattaaatgatggcttttgcagcatcaaggttgtgaaatgtagacctcagaggaggactcagaaattctgctgtccagatcaagtttccattctatttctgcaaagatactgtcttgggatacagaaacaaagttgttagtatatttattataaattttgataggaatttactttcattgtcaaatagtaaatatgctgactcttacataataaaattgtctccttgacaccacttttgaattacggtcattttctggcagtgcaaactgttattttttttttgaaagaagcaagttctatctaattttagagtctagagtctatttagactgatactaaacaaacacacccattaaaaaacattccactttgtctgaaattgatatatttgtccttgagtgtacatttcgccttacctttgtatgacattttcttttatggtgtttttgaaaactgcatatagttgatttttattcacaatctgaaaatatttgtattttaataagggcattaatccattgacttttactgtcacagctgataggctgttatatttgctgttttgattcgtgccttttgttttttgtgtgtattattacatttgtttttttcttttaatatgtggaatttattttcatttctttttttttctctaatgattggggggaagttttagaaagatttattttccttttcaaattctcctggtagttccattttagttttttgtttgtttgtttctttacttaatacttgaacctatatttctctattaatgttaatgaggatattatatcaacttaatgtatattaaatgggggaatctgtactctttacttcccctatgcccttaactcacttgtttcacaggttttgttgatatatccttatataacatggaaccgttatatttttatctttgagtccaaaatttttacaattacattttgtggtgcaccctatttgtgacaaacattgagagaaacctccgcattttcactgttttcaacatagtctaccaacacttaataaactaggtcttccctattactatcatttattttatttataggtagccagtgctcattttttgatatatttttcagagttacatgaagatattatatcagaaatcaaattattttgcttcagacacaaattaaatattaattagttataaaattctccataaactagaggttaaagaaaactcacaaacgcctacacggtacaagctggaaatgtaaattgtgaaatatgcctaatgtaagatcataggtaaagtctatagcatgatgcaaaggcgcagacctattctgaaggcattcatattcaactatgtatttttaagcttggatagaaaaaagaaatgacaacaggccatttagggtcacagatagctagcgttcctgtagacattgcttgcgtgatctttatcatttagtggtgaagagaagtctgaggcaagtgtgattcctggtgcacatgacctgcttttctctacctgacttttttcattatcctcaaagaactagaaaaaaatccctgaaataggcctaactgttgatggtttttaattaagttgatgtataattgataaccccttcagttttgaaggttagcattccaaataaattatttaatttttgaatgttgtgtctgtgccatgtgttctgctgttttctttaagaacatcaatatcctatgtttcatttgcttccacatagctttatttccttgcataatgtgagagtcttctcatttgtaatttatattgtaggtttagttttctacataaggactttgtgtatggcttctgattttgtttttgccattgtacttatgttgactaaaactacttctttaacagcctgtgccctttatttgatatatacatacctttcaaccaatattactgcccttcttataaatatgcgtttgtgtgtatgtgtctgtgtgtagttctgcagtttttttttttttttttttttttttttttttgagacagaatctcgctctgttgcccaggctggaatgcagtggtgcgatctcagctcacttcaacctccaccttccgggttcaagctattctcctgcctcagcttccctagtagctgagattataggtgtgtgccaccacgccaggctaatttttgtatttttttttttttttttagtagagatgggttttcaccatgttggccaggatggtctacatctcccaatctcgtgatccgcctgcctcagcctctcaaagtgctaggattacaggcgtgagccactgcacctggccctgtagtctcattttactttatttactgttgaatgaagaggactttccatgtctgttatttgaatagtaattgattgagaaaggttctaattgtcctgctcttcaacccccggggtgctgttacagttcttgtatcagaccttaaaatagaaaagaagttgacaggtaaacattcacatcatcctttttggatcttgtttttgcataggtataggtctcttgaattaggaaatctctcagttacctctgtctgtctaggtagagtagaatttatgcttggataatttaaaacagtatttcttcctctgacactgttgatacagaaaagcactctcacagtttttcattgcttcatccttgcctactgccaatctcttattccaacatgtgacatactattgcctctccacttcagctcaatccatattgtctatctggaaactggtgttgctgaatagctgaaaatattatttctcatatttttgtaaataggttgacaaatgcatcatgatatgttcagcactgtactggttttagcactgtaaatctcaagtcctggggaccgccacagttttaggcaaaccaaataattgtccactttataagcaaccataaaatataaacttcccagagattgtaacttctagtagaccatgttccttttacctcattactaacattatttgcctttttaatatcaacactagctaagttaattttatcttctgttgtatatatttttaaaaagcagtaaactattttttgctttaaagatataagattaaattataatattaaatgtacttgttcaaattgttggtaccactctaactgaagcaattctgaaacttggctagcctgccctcaaataatgtagtcagagaagtacaaatggaaggaaagtaaagatgaaattttgtctccttggctagctgttctataaaagtctgtgggatctgcaagccctgtgatcagtgaaacccttgtgcctttgacactgggacatgtcatggtaggaggggtgagtaaattttcctttacttggatttagcttgagtatctttcctgagggctccaattgcctttggcttgtgaaaattttcctgagttctacaaattaatatgtgggaatgccaaagtttgtgtgtgtgggagtgagggtggtgtcaaatggaatgaaaaagtgaagatgtaatagttcgttttcacactgctataaagaactacccaagactgggtaatttatgaaaaaaaaaaaaaagaggtttaattgactcacagctcaccatggctggggaagcttcaggaaacttagaatcatggctgaagacgaacggggaacaagggaccttcttcacaaggtggcaggaagaatgatgaatgcaggaggaactaccaaacaatcataaaaccatcagatgtcgtgagtgagctcttatgacaacacgaacagcatgggggaaactgcttccatgatccaattatctccacctcgtctctcccttgacatctgggcattatggggattatggggttacaatcaaaatgagattttgggttgggacacagccaaaccatatcagaagggtaagtcagtttcgtatcacaaaatgatatgtgcttaaactgaaagtcttaattatttaaaaaaacttatttcagtaaatatttgcagaataatttgtatatgtaagctactatgctagaatgtgtaggacataaaaatttagatatagactctgcctttacagaactttcttatagtaagagttaccaaacccactgcaaagtctgaaatgtcatgtaaaagtaatttgaaagtgctgaaaaaatatagattatttttgattggtgaagatcatggaaaaattagttaagataatattaaaagatatattgaatttaaattgacagaatttggggaaacatctcaaacccttagaataatatgtgaactgggtaagttcaggatgtatttggaaattcaaaagaacctgttttaactggtgcttcagatcattgatggaagttagtgcaaatttttctggaaagtttggtcaggaccagtgggtgcagagatttgaaatccagatttaagagtctgacattttttttaatcacttgaactttttcacggagaaactgtgccctgtttatctttctattcatcaaacattgccgcagaataaacactcaataaatatttgtgcaaaaataaattactaatgacataatagctgcacatctgaaatgactgtgtctgtgtttacatgcacttatgtagagttttccccggaaaatttatttacatttttcaaaaccaattatatggaaatgaatgaatgaatgagatattgcatataatttcactgtagactaaattagaagatattttttcccttttataaccaggagcataactaaggataccacttagcaaaattattatgattatgagtaaggtttcatttaaaaatattttgaaaggcatagacagagtatcatgaaataatctgggtgattgtaaaataaacaatttgcacaattacaggtccaccgaaggccagagctgcaaagggtatgtctgattgctggtgaagggtataattatctctgaggttgggaagggttatatgtgctggcttgtttgccaacatctgtcagctgtttctgtgtaccacattttctgttctagttttgagtcttaatataaagtcttcaaatattcctggcaagagtagagttatgtatatgcaaaaatatattcaggtttgtctcttaacatatgttcttacacagagaataacatttctactttctgaacaacatttttaattttctagcagaaacctgtattttgctacctattttcattaattcaagttgtgttcttatatcgaatagcaggtaaggggcttcctatgtaccaactgagagtgatttacattaaaagacattccagacataaaatcatttctgaaggttatacttcctgtcctgaggacttttagagtaattttggcactacttgatgtccttatcttggctgtatccttaaaatagtaggctctcatgcagctgtggtagagcaagtgaactggacttaggtaacagaaatttgtctgaatcagggcaatgttatttattgactttgtaactttcaacaaatgagttaacctctttgtgtctcaattcacttttcttattctaagggccttaaatgaattaacttatttaattctcagacaactctagggaatggtaccacaacggtcatgctcactttctaaattaggaaactgaagtagaaagaggttaagtaatttacccagacaggtgaatgcaagcataagaattgaatcgggcttctgtcccctgatccataactttacccacgttcttctgtgtctcgctaatattatctattttattattttgaggattaaatgagataatttctggccatggcagatatttattatattggtttaatatacttattaaacaaatataaccacgatataaatataatatattcattaaaccaatataaaatattaaaccaagattttatattggtttaataaatatactgataagatatttattattttggatatttattagtttttttactcttgagtataaactttggagaattcgagattttttttaaagttaatttttttacaacaaaaattattcttgataaacttgctgagaaaaagattgcgtgaatcatctggtcagtaaatgcaattagaaaatgttcaggtggttggtagagccccactttcagcatgaattgctttatagagcattaggtcacagattattgaatcttataattacagaagaaaatttatgcaggatttcattgtttttgactacttaaattccagttaccactggctatgcctggagttgaagggtcatacttaagagcaaagacactttgacaaaatgaagacccacttaattacttaatgggactgcaaaataccaggtgcagccataaaatgctaaaagttcatagcaggaaaaccttttggtgttacaaattttcatcaacatcgtcatggagatattaacatatgccttctaaaaccaggtcagaaattacatcatgcctggtttgtggccagttgttggcaggctaggagtaactctagagcgttaggcaacagacacttgtcatactcaaagcatcttttctctgtgtgattgcataagctatctaactggaaaggtacgactcctgaagctgcattggcttggttttcccagtgaaaatttaaaataggcaaaaatgtttgctacaaacatcagtttgtggatatttaaaacttatttgctatttaaagaacaaattattttgtgaaaaaaagaactgtcatttctagatgagactatttggataaaactgcctttaagcaagttggatagtaacaggaaaatatttcagggacaaatagaaataaaaaaggagttttggactactgaatttagagttcttgttgggtatctacacgaaaattctagaagatatctagacatacagttcttgaacttggaaacagcttatttggtgtctgaagcctgggggccgaagtagccacatgtacgtagtgttgtttatcaggtgttcaataaggtggaggattgtggtggtggggtttacttgtggtcctcttcctttatctgtttgtctcatcagtaatttagatgagcacagataacatgggtgagtttctcaggatttcaaatatcataaaaatgcgtggcataattaatatatgacaaaatcagaattcagtaaattttgactagaatcagtgtcaacaaagtgaaaatttaaaggaatagatattaaattctacatttacattgaaacagtaaatacagtcctgcagaaagattagtgaagccacactttaaagtgcttagttgaagatgaactaggtgttcttttgattacttttttttttctcacaagtggcttctacaactcctcctccttgcccaaataaacaagttgcagtatttgattgtatcaaaaaaaggcattctttctataatttatgtctgggactttgcatattgtttctaattctcattcttaagattgtaatacagtcagagaaattacagtagttttaatggttggaaagtagattatttgctgtaaagatgatatatagatgttttaagaatttttttaccagggtgatattgggtgcatataattcaacgattgttactgtattgcctttccccacagtcactttttaacattttcccgcaaactcattcacatcattgtctttgaaagttcaggtctagagatacctcctctgtgaggacttccttaatattcccaggtgtgaaccaatccctcttttgtgttctctttgtgtttctgttctatctttattgttttaggacttaccatattgaaagacattaatttattgatacttgcgtctgtctcctctagactgcaagggatgtgagaactcagacctcatcttactaacatgttatttatgtctgtggcctaagtcttagctcatttctgacaatatgcttttgtaccaaattgaactgggggcataatagaaatgttccatcgttctctggaggaaagaaatagggccagagggcagaagtgacaaggacacagattatttaagctcattactaataattagagctgtctgaaaatgaaatgacccgcctttacaatgtaggtcaagcacaaggtgaatgataatgcagaagaaatgttgcatagcctgacctctaaattcccctccaacttctgtattccatgccttacatttttctcttgtgttattaactaccctcacaggtagtcttcaaaagcactttcatatatgttatctcatttatttgaacaaatttcctgtgatgtatgtagggacaggtattatcattctaattgttcagtaaaatgaggcataaagaagttaagcgacttgaacagggatactcagcattaaatgtgagaccagaatacaatcttcctcatggcagtttagtaatttttttagatgaactatctgaaattatcaagtttgcacattttgggggacatagtgattcaaatattcattaaataatatgtttttcctgattatgcttgtatacagccttgtgtttttgtgatcaaactactgtttatctttttatcccacctttaattttcatacttactgatgattctcaacagccagaaaaacaacagaaaagtgtataatataaaacttagtgcctaaaaaaagcagtgataacatgctgtgtgtttcagcagtctggttgtgtgatggaagctcatgaatacacacactgcgttccctttcaggatccccaagaacggagaccaggctgttgcaatttgctcatctgatttagcagggatatctgagttcactgtattccctggaaaggctaaagatacagaagagtcattctggcttgcattaaaaactgactgtgtattttattttattatggtctatctgggtctggtctggcagctatacaagaaggattgcacttacaagttagatatttcctgaagaagagttaagaccatgtgagaaaagttaaccgattatttctgatacttttttctgtaaaagaaaccacattagccccagaaacatgcaatttacccatgaaacaaagctgcacatgtgcctccagaacctaaaataaaagttggaagaaaaaaatagaaactgccttaaaatttagtggcttaacacactggcaattattttttctcatgatgatgtgtatttattgttcctgtcccaggaacaagaccacttagagtggtctcaggtgtgatcgctcatgcagctacaagtcagctggtggtcgggctgtggtgtcagctgaagccccttagttctcctctatgtggcctgctcagacagctagtttgtgccaagttctcagagagagaacatggaagctgccagcctgattaaggctcagactctgaagtacaggaatgtcactttagtcacgttctcttgatcacagcaagtcaagtcactagcccagctcaaattaaagaggagaagttgccttttgaagagaggagcaatatgcatgaaagggataaggagaattgatggtggccactgttggtgaccatagttgcatgtagcctattaccatgacctactaggaaaacagtaacattcagaaagatgtgagttctggaatagcattgctaattttcaagatcatagaaccagttacctaaaaatcatatgaatggtgtttctcctctatatgttgattaaaagccctaaaacaccaaatttcttggagtaaaccaatttgtgattaattctgttgttacagttatgctttactatttatgtagcaatttttgtaattttgagtgtgataaacattttctgataagtggcagatgacaattttgggatcttgaatttttatgatctatatatttattgtttaaccgtttttgctgccttaagatacttaattatgtttaaatatggtttgtcccactaactttgtgtaactacagtagttatttacaggtttttttttttataatttactctttgattaattcctaagttttattcaggtggaattaatttttaagattcctttaaaaatatctgatttagttataaattatctcagcaaaatcatgaattgcatttgcttttaccacttcttatcaatattgatagagtttggctgtgtcgccacaaaaatctcatctttaattgtagttcccataatccccacgtgtggtggaagggaccaggtggagataatagaatcatgggggcggtttctcccatcctttcctccttatagtaagttctgaggagatctggtggttttacaatggacttctcccttttgcactgcacttctccttgcatctaccatatgaagaaggacatgtttgcttccccttctgccatgattatatgtttcctaaggcctccccagccctgcaaaaccgtgagtcaattaaacctctttccttacccagtctcaggccgttctttatagcagcatgagaatggactgatataaatatttaacaaatgttcagttttttttctatagaacactattttgaaatctgaatatatggctttcaatatgaatccaaatcatctgagcttgcttttattaattttaccttgatttattcattttctagacaatcaatgcatgcaaattttatttttaatatgttttattactttatttgtgatatggaattagaatagcaatcttagtgtttttaagatgtatatcttaaaaactttaagctgcatttttgaagttcatcacattaattcagatttcataatttaaaaaaataaaattcactattgctcaattgccttgcaatagacttcacataataaagacacttgacagaggaaattttgtgtcatcacttattaaactcaaagttatataaaaaatgttcttctacatcactaccatactcagaatattctcatggcaataaattcagctctgttctgttgatagaaatttgtatgacaccagtgaatgtggagtcatggttccagaacagggatttttgatatgttttctgttggtagatgttattaattttagtgtttaaagcctagtcctctgatttaacatttcattctggcaactgtgttatttcacgagtggaaaaatatagtgcactttttttaaaatcatggtttttatatgcataagagtgtttgttctgattcacaatggaaactcaaaataacatttcaagtttccttatgtgcaaagactatttacaaatctaaactgaaaacagacaatctttcaatgtgttatcaaaatgtttatagtttctttttctggagatgccaaatgataattattgaataaaattctaatctgttgagcatttctgtaaataaaaagtgaataaaactatgatttgttgttttttataaatgttttataatgaatgataatacatttacatataatttaacaaattgtcctatcctgttctgtaaaataactggcctgaattacttttatagacttttgatacatagaaataatgtttttacattcttaggtgaattatatagaatattctgcaactagagttgtccaacctgttggtgatctattaatgggtcatgaaatcaactttgttggttaaacttggcattaccaaaaaggaatcaaattgactaaaatagatcagagtgaagaatagtagaatacataggtgtgcagtaaagagtagattttatttcatgaagattttgtttcacttttatacatctatgtgtggttggtcactgtaaaatatgcctctagctaagggtaatggtcaaatcaattggaaaggtacctgttgagaagtgtctctagttttttaataacaagattaaatttcattattgaactaagtctagtgtttctagctgtaatttgatcagccacagactgttttaaaatatactatcctgacttctccaaaatgcaatatatcaatgtagcaaaattccacttataccttatgaatatatgcaaataaaataaagattagctattattaattgggaaaagtgtgaaattttggtcttcaaagttctaagtaaatatttgcctcctgtattaaatgctttctttgatactaaaatgcctgggactcatgtattgatttacctcaaatttctcagtttattactcataaccatagaacagttgtctgtcatacttgaagtattttgacagaaaacttcccatgtgtaagagttaatgtgttgacttacacaacaggaagtgttacaacattaaaaaatagcaagtttctattacttgtatgttgtgacatgacaagttactttcagaatgaggtgaagtataatgtataaaaaatctatatagtaaaaatgcaaattccctcattctgaatgcaatttaaataattattgtggttaaaaatctgtagttgttaaccaaaggttaatctattaggttagtattgaagacggattttttattttttatttttcatttttatttttagtgctggggtacatgtgcaggatgtgcaggtttgttacataggttaacgtgtgccataatggtttgctgcacctatgaacccatcacctcaggtattaagctcagcatctattagctatttctcctaatactctatccttccccgacctcaccccgacacaacaggcccaagtgtgggttgttcctctccctgtgtccatgtgatctcattgttcatctcccacttataagtgagaacatgtggtgtttggttttctattcctgcattagtttgttgaggataatggcttccagcttcatccatgtccctgcaaaggacatgatctcattcttttttatggttgcatagtattccatggtatatatgtaccacattttctttatccattctatcattgatgggcatttgggttgattccttgtccttgctattgtgaatagtgctgcagtgaacatatgcatgcatgtatctttgtaatagaatgatttatattcctttgggtatgtatccaataatggaattgctgggtcagatagtatttctggtgctaggtccttgaggaattgccacattatcttccaaaatggttgaactaatttacactcccactaacagtgtaaaagcattcctatttctccaccacctcaccagcatctgttgtttcttggctttttaataatggccattctgactggtgtgagatggtgtctcattgtggtttttatttgtatttctctaatgatcagtgatgttgagcttttttcatatgtttcgtggttgcatgaatgtcacttgagatgtgtctgtgtccgttgcccactttttaatggttttttttttttttttttgtaaatttgtttgagttccttgtagattctggatattaggcctttgttgcataaatagatttcaaagattttctcctactctgttagttgtctgttcactctgatgatagtttctttggctgtgcagaagctctttagtttaattagattttttaaattcttagtaattgatcagtcatataattgtaccttggtttagtatactgctgaaacaccaaaggtatgattctctcttcaagagactaacattttaattgaggagataaaattaaaactcatgcaatatgtgagctcttgaaatcaacaatgactgatgtttatatttataactcttatatcttcagtagtttctttaacaaaacctcagtattgttgaatgaatggattattgaatgaattgatttacatgatgtaggaaaactgtggtaatgtctaaaatttaacatgtagttagagaatgaaggagctaatatgatctcaagttgttagaaaaagtattaaaggcagtcagattagatctgaatgctaatgactagtctgatgtgttctagattagggggaactgcataagcaaaagtgctgtcatgagctagatgtgcttgtaaagcctgccctaatctgcctcttttctttttctagagaaagataatctttttcatagtccttgttggtgtacacatattaacagccccctaaagttgtctgtaccctaatcctcagaacctgtgaatgccaccttacatacaaaaggtaatttgaagatctgattaaggatatggacgttgagatgggtaaattatcctggactacacaggtgggctcagatgaatcacatgagtccttaatgtagataatctttccagttgtggccagaaagagatactatgacagagggaagaacaattccaactgtgagagatacccaacctgccgttactggctttctagatgcaggaaagggccctgaggcaaggaatggtgggtggcatctaaaagctgggacaggccctcagctgacagccaggaaggagacagggacctcagtgctacacccagatggaagtgaatcctaccagtaacctgatgattaaggaaagtggtgcttctctagagccacccgaaaggaacacagccatgtgaaactgattttagcctgatgaaaccaatgtcagactgtgatatacagaactgtaaaataaaaaacttggattgtttaaaacactaaatttgtggttaatttgcaatagcagcatataccccatcacagtgatggttcaggcagctgataactctgtgattggtttgatagtaccatcctttacctaatcgttcctgaatctgtcactcaccaccttctatacacaaacctataattttttatcaagatgagatattgcaatatttgagtagttccaattctcatattcatccctttctttcctttcctgtacccacagtcctaatcctgggctcatcacatcttgacttgctaagtacatgagcctccttttaaataaattttttaaaactccttttgaacttgttgcttcccaagtcaagaactttaaatgattccttgacgttaatagcctcctctgtggtatagctttcaaggtactctgcagcctggtttcaacttacatttattatgtctcatatctcagtatatttctacagaaatcatcttacctagccaacttggctccttcagaattccccaaatatacctcttggttttttgccagtgtgatttttttttttgcctgtctcattcctctcaccttcaatgtatttacttcctggcatactttgcgaattcaaaccctagttctcttttgtttagtgtctttcaaattagcaaaagttttgcccctggaatagattatgctcctattatcttaataacaatgaaaaggaaacttcagagctccaagagaatgagaccaatgaaatcatgtttcctttcttccctatgaaatgtaatgtcagatagtatttcgatttttccaaaatcattttcctgtttagtcctgaaggcaggaatctgcaaatatcaaactatcctagacttcacagctgggtcagacagatcaggctagccctctggcaaggggtgttttgaccctttgtttttcattacttttcctagacagagattgagagttcctggtgaaatcaaattacaacctcagtaggtaaatgccagtcctttaaattgatgtgagaatcacgcctgtaatcccagcactttgggaggccgaggcgggcggatcacgaggtcaggagatcgagaccatccgggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaattgatgtgagaaacaaagggatacctatctccctgatgagtattcagggacttatactgagagagcgtataaacatgaggacttaagcagcggatgtgctcattattcactcccagagcagatctgcaggaatcttaacaggaaagggcagagtgatcttgcttggcagtcttgctaaaggaaaatgaccaaaatctattcttttcctctttcaaataagaaagaaaaattatttcatagtgatctatgagttttaggatgcctttattttcctgagaatccctcaaaatatccacttcaaatattaaacattttgatcccgattgtaaactccagaagcctctaacacctgaagcatgcattgatgaacttaaccgtgaattggctgatgagactcatgatctttcattcttatttaaattatatattgtgttttaattattacctccttttgttacatttccttaagcaaattataagttctttgatggtaggaccttatccttattttttgctgtattcataacggtgcacacagaactatcactcaaataatgtttactaaatatttacctcaagtcaagcacgcttctgcctatgttacgccatgtcttgcctatgttaagttctttttctcctgcctggaataccatttaaaactatctgctaccaagaaagccacaccctttcagcagacccagagaactacagccaaaaaaacaaactgtttattagttgaatattttacagacgtctctgcgctggatccaataccttataaaatccttgattggtctaaaatagtttaaagtttgggcacaagaattgagaggtgtttttttgttgttgttgtttttaaagcagagtttatataaatcctatcactgcaattgaaatcaaagcagagagaattccaagaactttgactatgctagattcagtatcaggcagtctaggctaccctatcatttgttttattttactgaatgcttgctaaaatgactatcagtgttaaaacattaaacttgctccacttgttcaggtcattaaagaataggtaataaacaatatggttgatatgaagaatagaggaaaactactttgaatatccctgagaataaaataaacaatttgtgatggctgggagctgtacagctaatcctatatgacatgaagctatcagaaataggttacatcttttttagcaaatggcttcacaaggttgagactcaacgagacagtcagacacagtgagaggttcttgaaacagtttcagtcataaaccagtgacaacattccgtatatttataggggccatttagagggccattagctgacttctgcccttttcagtcatacctgcatacttgaaatcacctccatgagagacttcacttttaaaactcattggcaatttaatatgtaatatgtaggttcaattctagtgttttcaggaaatagagtaagctcagtctaaagtcaaatcaagtcaaatcacataataaatagtaatattaataagaaagagtaataattgcattattgtgtagtttattgtattacttggaatttctgtttcaccaaaacacagaaatacctcttttacaaattagttaagatacgcggaactacattatagtatagctaccattttcaatattaattggaggtacaaatggagacagaggtcattttagggttactcctttctactgagagtgattgttttatctagtccattcaagcaatttctataacaaagtattaatagctgccatgtgctgtagccttctgaagtaagtgagaaaactgcatgggtcttttggtatcccgtatttaataaatgttcattctttggaatataagttcccataaggcaagggaagcatatcatatatgagaaagaattttaaaagcttgaatgttatgcgataatctactagcatatacagtcaaattaagggtatttttaaaagtcactataacatgcccactactaaatatgatagatctagaagataaaagagtactgagtagtaagtactgagcataaatggtgaaatcacattgcatttacagatgtaataaacttctagtgttgcttcttttcaggtaatgagcttgtaattcattatttttctaaatattttaggtctttcaagagcaatacctcttattttacactattgaaattatataattaatatgggaaagaatgactccactgcataatgatactagaattatagtggtgaatatagattaaattaccaactaattaatttgaaatttatggactggtggccactagtgccatggcacactgaatgctttagtaagcaattgcattattcaacagaagtcttagtgggagtgattgacaaatgtgggatgcaggtctcctattatgaatacagattatgaatcagaggtagaatttttatcttgtgaatgattatatcttgtgaaatatattatttgttgtctgatttaaacctactttgttttggctctctgttctttcagtttcaattccattatctattttaagttctttaggaattataaaccacatgctgtcaatgacaggaaaacactgcccattaagtttaatgaatcattcagactgattttcaatggctgagaaatatcaaagtggcttcagtaatgtatgtaatgtgtagaaaatctaagtataattcttaagaaagatcatcaactctgagtgtttgtgatataatactgtatgtatggttaatattttttctgtttttataaatatttcctaggagaaataggttctaatattgtggatcataggaaaaaaatccaaatatattattagaaaatgtatttaaaactaatactatagaagtttagttgaaactcattatttgattattaatattttaaaattatagtagaaatgtttatctttaacatttccaaaattttaaagagtaaattagggtaaagaactagtttctgattgtataattttactgttggaatgcctcaattatagtagacatctccttattgttcataataacactgctgtggacaaaagccacaagcagaatgttggcatcatgtgagcagtactgcatgaaggtaggattgagtgctcaccagcaacggattaagtcattacagcccagttcttaacaaatccaaagaacaaattgtcttttacacctgcacataccaggaccacctctaagatgtgcattgtgatcaatgacaggaaagtaaaaacaagtcactctgtgggaaggaagaaggagcacaaataatggtcaagggacgtggtgatggtggaacgcattataagatacaagcttcaaaggtgctccttgaaaggtttttgataacacacacaagacaaaggcaaatatagattagaacagagtttaagatgcatttgtaaacaaagatcttcaaagtaattattcaggaaaaagggggagaatactgacagaagagctgtaaggagattcttatgtccaaaggagtgcaacatgaggaaacttctggcttgaggtttcgattaaccagtgacatgaaattcgtgtgtgtgtgtgtgtgtgtgtgtgtgtgtatgtatgtataattttcacatatctttctataaaacattattacacagtgtactgtcctaaggatgacactgtgacactataatatttatactgcatgttttattccacactttttattcctactttctaatattaaaaatgaggaagtgaaataaatttcttacacatttcttaaaattttgccaataggtaagtaaatgttaaaaatttaaaattaattttgttctgagtctaacaagttatagtgaatagatgaacttagtggtagattaagggatctcatgggatattccagtgtcagcataaatcattagaagtcagaggagtcaaatggaatcccatgtgcaataacatctaaaagacatgaattcaggaactaaaattatgaaattcttaaaacgtagagaatatttgtaatctgcaaattatggatttttttaaggacaagaaggtgtaaaaatggcaaatagaactttatcaaattaaaaatatttgctctttacaagataccaccaagaaaataaaaacaagctagagtgaaatgaaacattttcaaaatgtgtatctgataacagacatttaaaaaaaaaacaggtgaagaggaattgccactaaaatacaaaaagacaacacaatttaaaaatgggaaaaatatttgaatagacctaacaaaaatatacaaatggcaaacaagcacataaagtatactcaacatcattaggcattaggaaatacacatattaaattcacaatgagttacaactacaaacccatgaaaattgctaaaattgaataccaagtataggtgagtatgtggggaaactaggaccctcatgcagtattggggatagtttgcatctagtagccactttagaaaatagttgtgtgtgtgtgtgtgtgtgtgtgttttaacattctatccagcagttacatttctagtatctaggtaagataaatgaaaacacatgtgcacacaagcatcttataggtaaattgaataaacctaaatgaccatcatcttgtgaatgggtgaataaatatggtgtatccatatgatggactactacccagcagtaaatggaatgaatcactgacacatgcgacaacatgaatgatctcaaaagtattatgccaaacagaaggtgctagacacaaaagactacatagtacactattccacttacatggaagttttagaaaaggcaaagctatagggacagaaagcagatctgtgctgggaggaggagtggggaaaggctgcaaatgggcataatgcaatttggggagttatgaaataattttaaaattgcattgtgataattattgcacaactatataatggtactaaaattgaattgtgtgcttaaaatagatgaattttctggtagtaaattaccttagtagagctttaaacaattattaggctaccaccataatgagattctaagattattttctgtttttagtaggaaaagtgtgtacatgtttttttggttctttgttttgttttatttttgtttttttggagatggagtttcactattgttgcccaggctgtagtgcaatggcttgatctcagctcactgcaacctccacctcccaggttcaagcgattctcctgcctcagcctcctgagtagctgggaaaacaggcgcccaccactatgcccagctaattttttgtatttttagtagagatggggtttcatcatgttggccaggctggtctcgaactcctgacctcaggtgatccacccacctgagtctcccaaagtgctgggattacaggcgtaagccaccgcacctggccaagtgtgtacatgtttaattgaaagagagacattgaaaggaaaagcatccatctggagagaaaactagcaggctgctgctacctgcaagatttcagaaagtggcattttttaacttggtaaacttactgtgatggaatatctggctgagaaacttgactttgtcagcaggatgacaaatatcattgtcacatgggccaggatactagcatacatgtaataattttagtactgataacagaactatatagcaagtaaaatggcaatttcatttatcagtcataatgaaataccttggtatattttaggtaatagcaatggcaaagtcaagaatgtcagcctgtatgaatggctcataaaatacataaaaattagcactttgcttgataagttcagactcacaactagggcagttaattagaaaaagttgacattttctggaaccaggatacaataggatggtttcttcattccacagcaaggatagtgtttttccatgtctaaccatccccctcagagaaattatataaacatagacatagatacatgtatagagatgtagagatgtagacatagtgatatacatttgctagattgattccttttattctagcaattattcagcctacttagatggatttgcatttgtcagcactgaaaatttatgttgatcataacgttttatagtcagaggacaagtttactgctttttctattagttatctattactacacaatcaaagctcagcacttgaaaacaccaaccacttattgtcttacagtttctatagatcagacatccagagtctaagtgcttctaactcagggcctcttacaaggctgcaattaaatcatctcagggctctagtgggagagcatcaactgccaagctcacccatgtgtggctgttggcaggcctcaggtcctctctggctttgggccaggtactcgccacatgggcctctccgtagggaagctcactacatggcagctggtttccctcagagcaagtaaccagagaacaagtgaaggcacttagatggaagccacagtctttttgtaagttaaactcagaagtaaactgttacccctgccacatacttttcaacagagaagggtcattaaatccccattcagggatataggattacacaaggacatgatacaaggaggtggagtcatcataccatctcagccatcttcaaggatgcgtacatgtctgtctttatatgttttgggagaggcttcattttagctcttagtattacttgacatgtcatccctggtgaaaatacgtagttcctacaaagaaagtctgaattaaatatagatgtaagactccattgttaacaattgaagggcaagagcctttttattaaaaatcaggcaatataatgataaaggcaggaggaaatatattttgtctcaaggggaggaatgagaagtacagggttgcttgaatagcattaagaatcatgctcccgtgtaaattgttactgtctgttttctcacttagcatcaatctagatggagacagaagaaaactagaaaccatataaaacatgtattttatgcctcgcttgtccactgcgttcttcttttcttttttctcattttaaaactcatacccacttttaaattaaattggcaaaaaacacatttttttcattaaccttttgtgatgcccccaaactctggggtcatgattatatgcctagaataacattttacttgaatgtaaaagtgaaatgtgaactttaaaaaaccatagtacttaaatgtggtagcgctggtggtggtgatgcatatgtgtgcctcagtttaggaagctattgataaatgttacaagtctagcaaaatgcctttactttcatcccttaatatgtttctaatgtatttgatttactattatctttgttcttcttttccatttaatgacttttattaaacacaataatcaagagataaaatacactaatattcgctctggttaacttcaggaagctgagctgtgtattctgagtatagagtactcagcataatcagtacacagtgccctgaaactaagttattcattcttaggtaatgtacctaagaagaaagaataatgctttcatctttaaagtaaaagtagaagcacaaatttttgcgcctgagtcttttttgggcaataaagcaaatcaaaaacatttaaataaataccagaggtgacattaataaaactgttgctgacaccataagagactgctcctttggtgttggcatttttgtgtaattcaggaattgtatctctataagtcatgaaaatctaattcaaataagcacaggcaaaattgttgttttattgaaagtctcctatattacgaagagaagattaaaaactaaagctgtataaatgtctagaactctgccaaaactctgtcatctcttcttatggtagtttttttgccatatggcatctgaaagagacagtcttcaaagatctgtaacttagagctctaccatcagagtgaaaaaatcccagagttatattctgatttgtcaggtttgggtcacatttctactctggaaacaatcagctgaggccagagagtcaagatactgtgactgaccatatttgcatctggtgttcctcttgtaccaatcaactacagccagcatgtagtgcaatacacaaacatcaaagttacaaatcatcttcttttggtctctaagcttaatatattttccttattttttagactttttgatagagaattctattacaagtataacaaacacagactcagttctctgtgcttgcattagagccattgtcatctctaaacctctaatgtttttgaaatcttagcttgctattttttgagtattttgtgcatgtatattaaatgtaatctaacttgttggtatatttcataactgcactgagaagtaggaattatacatgaatttgctgccaatattaaattcggaattcatattacaagcaacttacatttgtaaaatcagtactaacttttttgttactgcatttttaaattgacagataaaattatgtattatgtacagcatgatgttttgaaatatatatatatatatatattatgaaatggctaaatctagctaatgcacatagttaccactttcatggtgagaacccaacatccactgatcatttttcaagacagtatattgttattatctatagtcataattttctgcaatagatccattgaatttattctttctatcaaatcgaaattcaatattctttgaccatcatcttctcaatatgccagcctgcccaacgcctggtaaccaacatgctactttctactcggtgagatcaactctattagactcagttgaatatttatttcttttacaaggatagcctttggaaagatgaaatagccaatctagtcagtatttaaaattttcttagcaagatctttacaaatgtcatgcttgaaatgagttaaccagaagtcagtagccttgagacattttttgtttttatattctataatgcaaaaattaaatttactttggcaaactaatttttaaaaaaaatatatcattcatctaaccagtctgcactcggtggcatataaaacatcacattgcttttttattatgcttttattcttaaaacataacatgttaactgtacttttgccatctatacatattattgatgtatgtattataacctctgaagtcaaactccattggtaatacattgttttattttttgtttgtttcttaataatctatggtgttttgaaaagaagagctttggagactgactgaatctgagctctgacacttattagctaatacgaatgtggtcatgattctactgtttttgaatcctaaattatcaaatactgaaatgtgttattgggaaggaaaagtgctctagcatctgtaaggcacctttatggacacctttatggaacctaatgtggctcagcaaatgggatttccctcccctgtctttactgaacctcacttccagtaatctttattattttgcattttacaaaacattttcttctaattcctgctttttgaaccatataacatcttcctgcggtaagaaagaaagctgttatctccattttgcaattaatcaaactgagaagcaaagttgaaaataggagacataaagtatacttctggaaagtttattgagaggcatcagaactaggcctgctatagtcatcctattgactcagtccttgtgtccttataagcagataacagtgagatgaaaaggaatttaagaagaatccctgagaacaaggaggagatgagtgctaaatgaggtttgatatttgacatttaagttggactaaatttggaattgctctagtcattcttcagggacaggaaagagttgtattgtgactgaagaataaaacaaaactaatatttgttaatctagaaaagtttagacttttcaatgaaacatttacaatgactaggttacaattttatgtgaaaacatattgtcatcattctgtcttcatgtcagggataatcaaaaaataaacagataattttttccctaagaaaagcaatgctgatgtaaggtgaagaaagcacgcagctgccattgcacaaggtttgatgctcatctctgtatatttttatatctctactgtgtctttgccttatacctttaatattaatgtagcatttactgtattagtctgttctcatgctgataataatgacatacctgaaactgggtaatttatgaaagaaagaggtttaatggtcttacagttccacatggcttgggaggcctcacagtcatggtggtaggcaaaggagaagcaaaggcacattgtggcaggcaacaggccttgtgcaggggagctcccatttataaaaccatcagatcttgtgagacttattcactaccatgagaacagtatgggggaaactgcccccatgattgaattatctccacctggtgcttcacacatggggcttattataattaaaggtgagatttgggtggggacacagccaaaccatatcattctgcccccagcccctcccaaatcttatatcctcacatttcaaaaccaatcatgccttcccaacagtcccccaaagtcttaactcatttcagcattaactcaaaagtccacagtccaaagtcacatctgagacaaggcaagtcccttctgcctatgagcctgtaaaattaaaaacaagttagttacttcctagattcagtgggggtacaggcattggataaatacacctattttaaatgggagaaattggccacaacacagggattacaggcctcatgccaagtcagaaatccagcagggcaatcaaatcttaaagatccaaaatgatctcctttgactgcatgtctcacatctagggcatgctgatgcaagaggtgcattcccacagcattgggcagctccacccctgtggccttgcaggatacagcctcgctcctggctgctttcatgggctggcattgagtgtctgtggcttttccaggtgcacagtgcaagctgccagtggatttacaattctggggtctggaggatggtggccatcttctcacagctccactaggcagtgccccagagggcaccctgttggagggctccaaccccacattccctttcacacggccctagcagaggttctccatgaagaccctgcccctgcagcaaacttctgcctagacatacaggagtttccatacatcctctgaaatctaggcagaggttcccaaacatcaattattgacttctgtgcacctgcaggctcaacaccatgtgtaaaccagggcttggggcttgcaccctctgagcaatggcctgagctgtacatcggccccttttagccacagctagagctgaagagtctggggtacagggtgccatgtcccaaagctgcatcaagtggggtccctgggcctggcccaataaaccatttttcctcctaggcctccaggcctgtgatgggaggagctgccatgaaggtctgtggagacatttcccccattatcttggtgcttaacatttggttcctcgttaattatgcaaatttctgcagctggcttgaatttctccctagaaaatgggtttttcctttctattgcattgtcaggtgcccagtttccaaaattccatgccttgctttctcttgaaggctttgccatgtagaaatttcttctaccagataccctaaatcgtctctctcaagttcaaagttccacaaacctctagggcaggggcaaaatgctgccagtccctttgcatagcaagagtggcttttacttgtcagtgtcagttcctaacaaattgttcatctccacctgagaccacctcaacctggacttcattgtccatatcactatcagcattttggtcaaagccattcaacaagtctctaggaagttacaaactttcccacatcttcctgtcctcttctgagccctccaagtggtttcaacctctgcctgttacccagttccaaagttatttccatgttttcaggtatctttatagtagcacctcactcctggtaccaatttactgtattagtctgtcctcaggctgttaataaagacacagacaagactgggtaatttataaaggaaagaggtttaatggactcacagtcccacatggctggggatggtggaaggcaaaggagaagcaaaagcatggcttacatggcagcaggcaagagagcatgtgcaggggaactccatttataaaaccgtcagatgtcatgagaacttactaccacaagaacagtatgggggaaactgtccccatgactcaattaacatcacctggcaacacccttgacatgtagggattattacaattcaaggtgagatttgggtggggacacagccgaaccatatcacttactatgtttgggatgttcctccaagttctgtggtttctgcagccaacaagataggtaagtttgatgtccatattaaagagtttttattcaaaattggacagatatatttatgagattcagaaagcaggaaatttcaggtagaggtaagtgttatgaaagaaaataaaaatgaagtgtattaatcttctattgctattactggctcaaagtttctaatagaaagtttctagtaaaagttctaatattagaacaaattcattatcttacatttctggagtccagaagtctaaagtcaaggtgttagtagagctatgttatttgtggaggctttggaggagcatccactttcttgctttttttcagattctagaggccctcccctcaattttttggtttatagctttttcctagtatcactacaacctcttatttctgtcaccatatctttttaccactgatttttaccttcttgcctccctcttacagggactcttgtgcttatacttgtggcccactcagctaatccaggataatttcctacctcattctcataagaatcctaaatctcatttgcagtgtatatttcactaaacaagataacatatttacaggttcttggggtgaggatgtggatatcttagttgggcagagtttttcagcctactgagtgaatatagataacagaataatcttgagtggacagggcattgtcagattggatgttcatggttggtttatttgaagtagtaacagttcagctgaggtagaaatgctgaaagaactgctataatggctttctctgaaaagaattatcagtacctatgagatgatacagtctactgattccatgtgactataccattaaaatcatgtctcaattatgaatatacagtggtatatttcaatttgcccttgaaagcttttgacagcaaaatacttacattaaatttcagcaacttgtgatatctttaaagtatctagatgagaactctagaagtttctcataggttagaaaacaatataccaaaatttctacatggaaaaatattaatttacagatatttttaaaatttcattgaaagggaagatataatatatccacctactttcctaaaacgactaaataaacagtatgttaccaatttttattttatttacaaagtttaaacaaaattagtttatatttctaatttagggagttgaaaaatttcagacagaggtattattagaaacttagtaatatatttttatttctggatttaacaccacacacagagtacatcaccataccataataaaggtcaacaaaaaactcaaagaccctgactttatctttgcagcaattattttgccttaagtacatcatagcttagctttgaattcatagtacccaacaaagtacatatatgtctctacatatacatatataacacatatataaatatatataatatacatatatatgtatacatattttaactggaagatggttaaactcttcccacccattaatgattagtccgtgtgaaaatacatttttgggtaggagataatattttttattattccatgaagtaaaaatatgaagagtattcaaactgactctcttgcttatttattttccacatttaaaactctgtgatgttgtgagcctgtgttttcacacttcagtttgcatagggaggaggtgcattatcaccaggatagatgcttgtgtgaatgagcagtccaagctgatagctatgcagcactttcattagcactggaaagtggtgttagcatgactatacagaggtttttctttggcttgactcctagcttgctttttgattttgattctggattgaagactcaatttgtggtgggacatctaagtggagcaatttcctaaaatcacttgggatactggaatatctctggatgcctaaatatctctgggtaattttagatacatgaacaaacatgaggttatttttaatgttgattttattatatcagttttgctaagtatcatcacttggaaggaaaattgagatggagtattttatatctcctcacttatcaacactaagatgctttgttcgaattttttttctcaaaatggataaaagatgtaaggttttacaacatatgaatgaaagaatttaatgctggaagctaaatataactacacagagtgtcctctcttgagcatatggcactgttcattcacctgactcttgccctaccctcctttccagaattatcttcttctaattccagtatgtgaattattaaacatgtttgggaaaactcagcagaagctagtcttccccagatatccatccccaaacttttctttttccttctttaatctactcacctgaaagtaataagaaaaattgtatgtgtatgtgtgtgtgcacgcatgtatatatgtaatctccaagtgtatgtgtgtgtgcacccatgtatatatgtaatctctaagtgtatgtgtgtgtgtgtatatatatatttacacacacatacacatatatacacatgcacacatactctttcccttcacggccaatgactccccatttcattttgaacttatgcctgaattctaccatgatctaatccctgcctgcttttcacacttcatgttgatgctactcttctatttgtactctatgatttagccattaatgtgccctttcagttatctgagcatgtgaagtttgctgctgcctaaagaaatagtacatgatagtctctgtggaaatctcttgcccctcctctgtatttgcctgtcctgttgtccatgagtctttgccttaagatgtacaagctcaaagagacttttctgtcctgggaattttctctaagtgacttccttcttttattctctatcactataggtattatctgacatatatttacatgtagcgttgaaaaattataattttgtgtatgtatttgtttagttaattatagtccctctttctcactagattgtaagttccaccaggtcaggggtccttattacttttgttctccagtatttatccagtgcttagtggtatggctggcacatagtaattgctaaaggatatttggatgaatttttgagtaaataaaacaatatttctatttttatttctctctgttctatattgtcattcctttcaaagtgtgaaccttctgaactactgggagtaaaaaggcaggaggaggtagggatgaggggtggttcataattttaaggctctttctttagctgcacaaagacccagccaaaattttgcaaggtcctgtttattcatttgttctgcccttttgttgaggttttgggattattcagaggagaatgctatgttgataattgaggagcagatatctaagcaagaattaaaacgtgtgtacatatatatgtgtgtatatatatgtatctatatatgtgtatgcgtgtgtgtgtgtgtgtgtgtgtgtgtgtgtgtatacatatatataatttagatctataaaatcagttgagtatatatgtataggtcacccagtctttttgggctagaccaaaccaaatgttggaacttgacaaaatagaagagcgcgttcaactaagtggattgtctgtatctttcctggttggaatacaagtaggacactgctcctccctgttttaatggcattatgataagataatccacatggaaatatagtaaacaataattagaataattataataattagaaatgtagtcattccagctagctcctttttaagaaaagaacaaagtataatgaaggaatttgaaaagcatttgtaccataaagaataacataatgatatgtgaaacttaagtgatgtataagagttgttatgtataaatgttgagttatgtataatgttgagttatgtataaaagaattatgtgtaaaagagttaacctgagtttgctattgcataggcttcctgggcattgctgacctgttgtctttcttttgctttagtcaagtcattgtgggcaaaaatcatatgtttgcacatccatggagtctttctgctctgtttctcagcatcactacctagaaagagccatcaaaggaaaaaaggcaaaagctctctttcacattaaaagatagtcccatgaggagaaaatgatttcccttgttccctctttcttcctgtgatgctggttttaggctataatcctggagaggtagcatccatctggggaccgtcatgtaattaacatggggaagaaatcccaacatgatgctgtaattaagtaaaagagactaggtccttatttagtcactgaaggaatcccagaaccaaacaccattttagtgatcaaaaacattcctatggttctggccacatttagttgggttttctattatttgcacccaaaataatcttttacagattttttgcctttaatatcacccaatagattggcttacccaagagaaattgcaggaggggcagtcagggtgggaaggtagcatatctaagggattcagaattttctgggaggtggagacttggaatatatttatcacataattctcacagtcagtgaaatggctgattcccagaagtgaatacatatcctagtggaattataaaaggtattggttatatgtattaaatggaaccttacattagaccagtaaaaaaaaatgaaagctattgtagaacagtaaattaaggaaataaattaaaataggatactgactataatacaaactataattttgttgtaaagactaaagaaaagatagagcaacaaatcaaataggcggacatagttgaaatagttgacaaagtagtctttagagaattattcctgtattatgataaactctggacaaagaaaatattgcgatgagatgcggtctcattcaatgacagacatactgcatttccttaccccagattacaaggtgtgaaaatatttagtaacactgttttctttcaattttccattatatagaaggttagttattttcagaaagtcaagcagtaatgcagaaaattgctcggtttgaaagactgttttttagcttcaaaagtcatctgtagttcagcattagagaaatgtatgatgttaggctatataaaattcatttttattctcataatagtgacattggtgttttgttaaacaaactagcacacttctagctaagtaatgaaatctttagattctgaaataagtcacttagaaacacataaggaccagttatgtagctttcaattttttcttgtttacaaatgttttcaccacttcataacagggttgttcaaggaaagagcagttttcactggaaaggattcatagaccattggcagtgctttaaccttatcacagtcaggctgggcatctcctagagatttttggattaaaggaactcatgaagtcattaattggaaagagacacaggttaaaattcatttggcagtgatacttcatatactcagtaatagcagaagatggttagggccaagctctttctaactagtattttttccattatcttaaaatatgtactttgaattatattaattacagtgaaggatataataactaggaaacctaaaattagtgtcatttctaatgctgaaagcatattaaacatgaggtctgcttggatgtctatttaaactacaatattcaagtgaatttctttctgtggaaaaaatgtgaaatgaaaaggaggggtgagttgaagagaggacaagaagggagaaatgagaggagagaattatgattgtatatgatgttggaaggccaaggcctaataagttcatttttttcattcaagcacattaatgcagtcctcatgagattatggatgctgcgctaatgccaaacacggctccgtgtcatcactcttataagctagtagctctaacaaaacctgtaatacttaaaataactataaagatgcatttcagtgctacaatcccaaaatattcttactagagttcaaagatctaaaaagtcatttaagtatatattctagagtatagaaaatatattttgacatttgagagttatcactcaagtaaaaataagtaatatatagagggctaattattagtgataattgttagtaagatatgcacatcttccaattttttaagatactaagcctaaggacaaacatattaatgggagaagaataattttaaaattatatagtgtgatggatggttataaatgctatggaacatggaagggggatcaggagtacagggatggtggagcgggggcattatcgttctaaataaggttgtgacttagccaataacatttgataaaggtttggaggaggtgagagaagagttatagggatatcttgggaagaagatacttcgctcaaggaatagcaagtgtaaaggttctggggtaaaagcatgcctaacatgttggaggaatagaaaggaggttggtgtaactaatgaggagtaagcaagggagaacagccaaaggaagtgaggtcagactgaacaatacagaaaattgtagtcagtagtgaggactttgccttttactaagtgagagtggaagtcattggaggattttgagtagaggaataacatgatttgatttatagtttagaaggacctctgggtgttttgttgatggacgccttagggagatcactgaggaggctattatagtaagaaacgtgagaaattttggtggtttagatcacccagatcacagtgacagcagagggtggtgacaaatgatcagattgtagatacacattgacagtttaactggtggggtttgctgatgattgagtttatggtatgagagaaagagtgaagccaaggatgacttgaatgttttttttgagacctcgtgatctgcccgcctcggcctcccaaagtgctgggattacaggcatgagccactgcgcctggccgaatgtttttaatttacacaactgaaagatgcatcagttggtacagctatgtctttttctctggtcatgtttggtttgtgcaagcggaaataagaatatggtgagagttagatgtaaccaagattgatcttttattcatgtgggtacaatgaggcaagagaatgttagggagtggagtatatatgcaaagagctatcatttttgttaccgaactgaacttgggtccatttgtctggtgcagcaaagctaaacattcacatgaggattgcagcaagagaaagtgtgacatttattgcagagcacctcgcaaggagaatctgggagctcgtgcttaaaacccaaattcttggatggcttgtagataaggaggtttaaaggcaggaaggcagaggttataggtaaagtcataaatcaatacatggagactatatattggtatgatctagaaaggtgggacatcttgaagccagagcccacaggtcataagtggattaaaagattttctgatttgtgatttgttaaggaagcaaagctttttctaaaacgttgagattgacagaaaaaaatgttagttctggcctctgggtgtgacttcctcaggcccttcagaagaggccatttagagcaaagaatggcagtcagggttcagtcatcagatcctccttatctgaggtctacatgccaacaaatccatttggtgggggtcccggtttctggaaaacaacttagggatgtaaattaagatgttatctttagctttgatagaggaccaaacttcttgtgactctgactttcttggctactgttttaagctactgttactttcttgcttatcagtactttcttgctcatttacttctcaggaccagtgaggtgcctggaatttcctttggaggaactcaagattttattttattttatttccatgcttgggagtaggggtcagggagtaggcctctaagagggatctccattccatctcattatgataggctaaacaatttaatttggataataaaatggtgagggtgagttgaggatagtagtggatgagatatggaaactaagtgctcaggaaactactgggctaggttattaggaagatcattgaaatcgtcaaaatcacaaaaagttacagttgggctaggttattaggaagatcattgaaatcgtcaaaatcacaaaaagttacagttagtttgggaaagaatgaagtcatgatctgaaatcctcaaggaaggaggggaattgagtggcagttggtagaagaataaaatgaagaagggtcatgggtggcatcttgtttgttacatgagaatcgaaagaggagagtgtagggagaatagaaggaaatggtctggaagtggcaaacagaaacaacccattgtttcgaaggccatgggggaaaaaaaagccccttaatagggctataagaaaaccattatcctctgtggacacatgggagtaagatgatgatagaaatattcaaagagagtgtgtaaaataattttgctgataatttgatgattaattctagaagatccaatcgtttcaggaattggagaatggttagaaatggggtcatttgggggatgtagaaagatataaaatattttcattgaggttgagatataactttggagtctagggcactcttgatggctgaagaacaaacaatcctcatttgtcctggttctgtgattactgagatcaaagcatgttactatcaaatctcagtcatcacagagctgtgcaaagaaagaactataagtattctgaaataaatggaatgagattgatccagctctagtgaataaataaagcccacaggctgagtgtcaggctggaagtcaggccagtgtggaaacagagctgagcatcggaggacttatgcagaggaccaggagtattggttacagaggtggttctcctgtttttttttgttttgtttttgtttttgttttgttttttttctgtgccttagaaatgtctggttgctttcaaaaatcccgacacccaggccacatccgcaggaatcagcattttaaaaaattccctaagttgattccaatgggcagccaatttgagtgccactgtgctacagtatctcttaatcctatcatatgcaaatcattgaaaatatctgtcatgtcatcattgccgattttctcttcttcagttgtatctattcaaactgtgacagggcctcatttttcaatggcttagcttgttatttaagtagttgcagaacatcacattcatcaattacatgaaattctgtgtggaaagtttttaatgtcatgttgtatcttttttctgcatttttagttgcatcttttttctgcatttttagttgcatattattgttctattaaattgtattgcccagtttgaaataataattcactaacagatgttaaccccatgaatgagaagagatgcaagatattttcatcttacagtttctttgcttttctacctaaaaacctgtatgtagagatttgtaaaaggaaagatatattttttctctgtacattttatttgctttacaatatttatactttaagtaattagtataattagatatttaaaaattcttttttgctatcgtaaataatgcattaatgaatacaataatatataccgttttatgctgtagaagtacatattgcactgaacaaagttgaatggcaaagaagattttatttaaagctatcacaataggagagagaaagaccaaaatgtagtctgaacttgactgtgccaaaacaaagggtgggaagacttttaagcgctggggtgagctggagaccagaggccatcagtgtttgctaattagcttcacccaaaggaaaaataaatgttctcttattgttgtgacaggaggtagtttcataattaaagcaaggctccagcagaagttaggcttccagcatcccacaaaattgggaaacagcagcactatctcccttgatgtttacatttgaaagagatggctgccaggtccttgagaaagagattcctgggttgtaaaactggcaagaggcttttaaaaatatttacataagggcataggaaaaatttactattgcaagttttttaaagtaaagaaaaaaatgctgtaagaaaagggaaatcagggcctagtcagaaggaagcaggtacggagtttttccaagctgaggagaaccctaaggtctttttgatcaatgcttatttctcattatataagaggagttgtaaatggctaggtgagtgcaagaatgttttaaaaccagttgatttgtattgggaaattgcgttcagaatattttttttttatttatctcccactagtagagtatgaggatttccattttgctatgtgtgtgccaacatgagattgttaaagaaactctttccagattttatgtttatttggacaaatgtttaaatgaagaatgaaatatctcacttccaattaccagtgaaattaaactttaaaagatatattttttgttcttttgtaattctttttccaggacttgccattttgtaaagttttctacatttttttatactgtttatattatttttaaagacaactgtagtattattctgcttactggttcagaaacaagagaaaatctgtattgtaccaagagctaatgaaacctgggtatttgttttttccctggaaatttcacacttttgtttccactagattccttagttttgaataaaagcaactggggtaggagactgtctggtttgaggatgttttcttattttggcttcaggccaaaggaattgctatatcttagtttaataaaatattagacgctgataccactgttgcatagagacaatcactgcttgttggagaaaggaaagtaaatattttactgtatacatcaaatgataagcaaaactatcatgaaggaaagacaaaacttctttcatgtggcatcccagcctctctcccagcaacaaccacccacctacaacacagcacaccaaggtccatatcttccatgttttaattgttacattaaatattcttggttgtggcactttgatagtcacctcttgttttcatgcgcgtctgtgtgaagagaccaccaaacaggctttgtgtgagcaacatggctgtttatttcacctgggtgcaggcgggctgagtccgaaaatagagtcagcaaagggagataagggtggggccgttttataggatttgggtaggtaaaggaaaattacagtcaaagggggtttgttctctggcgggcaggagtggggggtcacaaggtgctcagtgggggtgctttttgagccaggatgagccaggaaaaggactttcacaaggtaatgtcatcagttaaggcaaggaccgcccatttacacttcttttgtggtggaatgtcatcagttaaggtggggcagggcatattcacttcttttgtgattcttcagttacttcaggccatctgggcgtatacctgcaagtcacaggggatgccatggcttggcttgggctcagaggcctgacacttgtttacatactttggcctttttaagtccccctatctttatatgttcattaaattctgaaagcttcagtgtttctcagtaacaaccataaatcattggagaaaagtagtatattgaaattactgtaatacttttgatatgtataatacttttgatatctttcagatctctaatacttttgatatctttctataatacttttgatatctttcagatctcttttccatatctattacttttatctcttttcaagtaatgaattgattgcgtattctaaaataaacactattctatactgttgaaatactgaaatgaaaccctacaagctcattgtaagggaacaagcttaaaagtatgtaatttcagtgaagtatattggaacataggcttcataaaaggtataaaaagaagtaagggaaaagaggacggtgagactaaagtttactgagtgatttctaactgccaagccctgagagaaatccagtcttatttaaaaaagaagcactattggctgaaagacttgtgagaaacactgttttgtttttagttttgcccacttagaatttgccataggatctggcacataatgcttagtaaaaaggtacagaagttgggaaagctagtgacatttgatctagttttaaaagatgtgtagaataaatgggcatttagaaaatcttaaaaattctttgtacaatatatgttgtcaataattttatggttatcaaaaatatcagttgaattatattttctctaggaaatattaatggtcaaaagtttaacttttaaaacattgcttaaaaacttaagccaacatattaatgactggtgagtaccatgactttattcctgatgagaataattaaagctagttaaatattatgtatattgattataaaaatgtgcttactatagatataattgtcatccagtttcaagagagcttattgtttgaatgggaggtcttgtattttttaaaaaagactgttttgatcttgaattataaccaataaaatggcattacgttcatgcagagcctcaatgaagataattaagaataaatagtggtttctgataaactgttagtgaagagaagatatctcacatttcccattgttcaaatttaagaagctaaataataaaaaataatatattcatatatataatctaaatatacaaagattatatatattatataatacatgcattaggaatatatattagctatatatggaatctatatgtggaacatacatatatatgtactactcagaaaaataatgttacaggttgttttggtataaaaagtcaggcttgctgaaacaagaaaaatagataactgaattttggatataataaaatgtggagaaacaaataagaagaagaaggtgaagcagtgagaaaagtttcaatgcttggagaatagtttgtgaatcttaacctttatcataaaaggtgaggaggtaggtatgtgcaatagatatccatttatattcttagcagtttgcaatctgatttaccccaaacctgcaaattccagttacaagtgcatactattctattctcctcatatttctgtgttgaaatttttgtctcacagattttctttaacctacgttagattattaacagagtacacacagatcacttataaaagggaggggagaaatgccaggggcgtgtgaaccagagcaactccctcttaaataggagtggggtaaaatgaggctgaaacctactgggctgcattcccagatggttaaggtattctaagtcacaggatgagataggaggtcaacacaaaatacaggtcataaagaccttgctggataaaacaagttgcagtaaagaagctggccaaaacccaccaaaaccaaactggcgacgagagtgaccgctggtcatcctcactgctacactctcaccagcgccatgacagtttacaaatgccatagcaatgtcagaaagttactttatatggtctaaaaaggggagacatgaataatcctccccttgtttagcatatcatcaataaataaccataaaaatgggcagccagcaaacctcagaactgctctgtctatggagtagccattcttttattcctttactttcttaataaacttgctttcactttgcactgcgtacttgccctgaattctttctcacatcacatttcttttggtctcaatctccagtgaaataactcctcacacatttcttactttccacatcatgcttccaccttctgaatataggtagtgctaatgaattccttttaaacattacttcagtattacatttgaatatgtaacattcaaattacataatatggtaatggaaaacgtggatggcagaaatgaaaaggaactactactaagtttaactacttttttaagtttaaaactcaaagcagagaataactaaataccaacagactgagcaataggggaaatttttcaaaataggaagaaaaagagagcgagagaaagaacaactccaattgttagtcctattaattaacgttcatatgactacaatggtagaaccatcgatcccttagatgttggttgcctagatgttcccaaatcctctggtcctgagggattattcttctttaataaataagtaaaattcatgttggtttccatcctaatgattatagaaaagccagcatttccctcacatcatctataggaacacttgggatctacatttctacacatcacctcttggcctgatttcacatggtcattgaaattctctcctgtggcctgttttctgtattctgtgttgatataaacacctacatattttttctttgatactccaaacccattgtgataacaaagctcttgaatttagcatagtctttctaaatcattttgagtagcacagcgtagaaaacactaacaaattgaatactagactattcttattagtagaatattattcttaacagtctttctttcattcacactgttggaatccctcacaggctgtcatttgtcatcaaacatccatgtcctcatctcctcaccttttaggataagtgttgggattcacaaacaacactctccaagcacgaaactttccttactacttcttcttcctcttgtttctccacattttcttatgtatgaaattcagttttctatttttcttcttgcagcagtccttttacttgtgataccaaaacaacctgtaacattatttttctgagtaatcatccaccctggagaaaaattatgtgcctctcttagaaggcatattatttgttttgtcttcattctgcatgaagaactgtagggttttccctctccactctatgtaagaaaaatgataattttataatcctttatattctactttttaatttattttggtgcctggttaaaaaaagtacatacttagaaatgtggttggcatgtaagaagggtttaaaagataataaaatcgacaatttaggattgttgtaagtggtgctgaagtagaaaaaaatgaattgtgcttatctaagtacatgataactagatgtggaattagaggatgcaaattgagagatgtagaaaagttatttttttaaaaagaggcatgatttgaggatgatttttatacatggattggattaaattgttcagcaatgcttgcttattggtatcttcagtttcatatgaggataatagtagtatctaaaactcagctgtccctgaaactcttggctgggcagggagtttactaattcctgttaaaagcttgactggaaaattaataattctgaaaaacatgctatcaattcattattctaaaagcttctcctgtatttttcaagtcctgtcaaaagctggctctcatagaaagcaaggaaggtcgccaaaatgagagcaaatagaggccactcaatcagaccttgttataacaaaggtcaccgaccttcacttgtgtgactcacagaagtcacacttgtggcagagactcaaaggtagacagagaagtgggttaactttgtactaaaaaaaaaaagaatctgggaagacctcagttttgctctgattggaggttgttggcatggggaagctgtaggtgggcaacctagaatgggaggcatcttttatgtttggctagggaacataattgactttctctggggttggccctgcattcaaagcagggcaaaaattggggaagctgacagtccttgaccaagtcctaattctcctgcattgattgctgcagaggttgtgcatcagagttctattgtcacgtatgatctctcactccccagatattacctacagaacctgttggttagacaaacctgaaattgtttcttatctgggtaagagagaatgcaatctcacaaagatatgacagtggattggggtggggagagtaaaagtcagtttgttgagaattggaagtttgatttaaggcaagtctttcaaacagagaaaatttgattagagttgggtaaggataaggatacaactaagaccgtttgaagcagcaagataaggattttgtggtgagtgagtcaatgcctgttgatgtttgtcattgaggagatctttaaggaagttcctatagtgaacaatcaaaccattttgcttgggcaggagactcctgcaaaaagagtcatgctattgacaaaataagagcaaactcatgtttatagagacagtgaggaatggttttattttatttaattatttatattttcatttttatagagatggagtcttgctatgttgcccaggctcttcccaaactcctgtgctctagtgatcctcctgtcttggcctcccaaagtgctgaaattataggcatgagccacccacccagcctgaagtgtggtgttccttttcagtatatagaccaactgtgggagtagacagtttttgctctctttttacttggaccatatcttctttcttccccttagataacactgtcctgtattgaagcttgcacaatatatgaaatagtcatgtcaaattcataatcacattttatgtgaggaaatctctcagaattttgcactgcattctatttcctagtattattctctacaaatactgtttattcttcctaaaggtgttctctatgggtctaagaatccttgcattatttggaacttgaacttgtttgcttttgctgactgtggaagggacactaccaggacactttgagctaatggggaaaagctactgagttggggaagcagtgctacttctggtgaatagtataatgtagtagcttggtgcaaaagtaattgtggtttttgctgtttaaaagtaatggcaaaaacacagctatttctgcaccatcctaataggtattgtccctgaggaggattaaggatgggtggcactagaatgtctatgtagtagaagattttttaaagaagtgatatgtctatgagaaacatgcactctatattgctgtatttgtctttcaagtaacttcagggtgtataaccactaaagccataacttggcatctgctactggctgaatgcagatttgctcaaaggtagtaattattcaagatgtggaaattttcctaatgaaagacttagatcagagaattcaagactaaaaggttcccaagaaaccagaaaattatcttagtgagcagtactttcagatcacatacatatatcccaggacacatctttcctaggtctgtgacatcttaccctgttcaccatgttcatctttcctttcctttgaaaatgccccaggctccttatgttaattattccatccagtttgcagagctctgcatgcaaagatgtgacatgccgagtcacaagaaaggcctgttttacctattccctagagcaggagacatctttctctctcttgcatttttttttttttttttttttttttttgactgagaggtgtatctctcaaggaacatgtaggaaaagttaaatctgctccaaggttacttggttttgcacaaatctagagtaattacttgtttcttttgcttaaaaatgatcaatcaataaatggagtaggaagcatctggtggggacatgcatacactacttcacaagtaaatgaatatgtaatgctgatcagctgaatattatactttgatttgttgcctaaagagtcttagaaatattggcatttttttaatgaggtaaatgtacgtatgagagagagctgaataagcaccttaaattctatatgtgacagatgagttggtcctggaagaaactgaaagactttgaagaataacgtgttgtatgattagaattaagacagtacaggcatttcttcatttacaaaaaaaaaaaatttagggtcagggtttcatgtgcaggttatataggtaaactgcatgccacaggagtatggtttacagactgattatttcatcacccagatgatgagcatagtacctgataggtagtttttccttcctctccctcctcccactgtctaccctcaagtaggccctggtgtctgttgtcccttctttgtatccatatgtactcaatatttggttcccacttataagtgagaatatgtggtatttagttttctgttcctgtgttagttcacttaagataatggcctccacctccatccatgttgctgcaaaagacatgatctcattcatttttatggctgcatagtattctatggtgtatatgtaccacattttctttattcagtctactcttgatgggcattaaggttgattctattactttgctttcatgagtggtgctgtaatgaacatgcacatgcatctgtctgtgtggtagcataatttatatttttggaggtatatacccaataatgggattgataggtcgaatggtagtttaagttctttgagaaatctcaaaactgctttctacagtggttgaattaatttacattctaatcaacagtggataagcatttctttttctctgcagccttgccagcatcttttgtcccctgactttttaataatggccattctgactggtgtgaaatatctcattgtggttttgatttgcatttctctaatgattagtgttattgagcattttttcatatcttgttgtttgcgtgtatgtcttcttttaagaagtgactgtttatgcactctgcccacttttctaatggtgttgtttgtttaactgtttaagttccttatagactcttgatagccctttgtcagatgcctagtttgcaaatattttctcccattctgcaggttgtcagcttattctgttgatactttcttatgctctgcaggtgctctttagttttattaggtcctatttgttgatttttatttttgttgcaattgcttttggcatcttcatcatgaaatctttgccagagcctatgttcagagtggtatttcctagttttcttctggggtttgtatagttttaggttttacatctaagcctttaatccatcttgagttgatttttgtggatggtgaaaggaaaggatacaatttcaatctcttacacaaggctagccagttatcccagcaccatttattgaacatagagtcctttcctcattgcttgtttttgctgactttgttgatgatcagatggttttaggtgtgtgaccttatttctgcactttctattcggttccattgtctattgtgtttgtatttgtgccattgtctattgtgtttgtatttgtgccatgctgttttggttactgtagccttggagtatagtttgaagttgggtaatgtgatgcctccagctttgttctttttgcttaggattactttggctatttgggctcttttttggtctcacatgcattttagaatagtcttttctaattcagtgaaaaatgtcattggtgggtttgttaggaatagcattgaatctgtaagttgctttgggcagtatgtccattttagcagtattgattctttctgttcataagcatgaaatatttttccatttgtttgtatcatctttgatttatttcagcacagttttgtagttctccttgtagagatctttcgcctccctggttagctgttttcctagctttgtgtgtgtgtgtgaatgggactattgtgaatgggatttcattcttgatttggatctcatttgaatgttactggtgtatagaaatactactgtattttgtacattggtttcgtatcctgaaactttgcccaagttgtgtaacagatctaggagcttttgcgaagagactatagagttttctaggtataaaaccataataatctgcaggcagacagtttgacttctctgtttctatttggatgccttttatttctcttgcatgattgttctggctaggacttgcagtactatgttgaataggagtggtgagagtgagcattcctgtattgttgtgattcttaagagaagtgtttctagcttttcctcatttagtatgatgttatctgtggattttattgaaagccttttctgcatctattaagatgaccatgaggtttttggttttaattctgcttatgtgatgaatcacatttattcattcctatgtgttgaaccaaacttgcatcctagaaatgaagcctacttgatcgtggtggactagctttttgatgtgctgctggattcagtttgccagtattttgttgaaaatttttgcatctttgtatataaaggatattggcctgaagttttatttttttgttgtgtctctgcttgtttcggtatcaggatgatactggcctcatagaatgagttaaggaggagtcccttctcttcaattttttggaacagtttcagtaggaatggtaccagttcttctgtgtaattccggtagaattcaactgtgaatctgtgtggtccagggctttccctggttggtcggcttttaattattgattcaactttggaattcattattgctctgattagaatttcaatttcctgctgatttaaacttgggagtttgtatattgccaggaattatccatttattgtagatattctaatttgtgtgcatagaagagtttgaaatggtttctgcagggttttttgtgtttctgagacatcagtggtaatgtcccctttgtgatggtgtttatttggatcttctctctttttcttctttattagtctcactagctgtcgatcacatttattctttcaaagaaccaacttctggtttcattcatctttggaatggatttttgtgtctcaattacattcagttcagttctgattttggtttggggttgattttgcttttattttttgagttcctctaagagtgatattaggttgttaatttgagatctttctaaatttttgatgtggacatttagtgctataaactttcctcttagcactgctttagatgtattccagagattctagtatgttgtattattgttttaattagtttcacagaatgtcttgatttctgccttaattttattatttatcaaaaagtcattcaggatcaggttgtttaatttccatgtaattgtatggttttaagcaatcttcatagtactgacttctatttttgttgcactgtagtctgagagtgtgattggtatgatttcagttgtttttttttaatttactcagaattgtattatggctgattatgtggtttttagagtatgtgccatttacaaataataggaatgtatattttgttgtttttgattggagagttttatagatttctgttaggtccatttggtcaagtgtcaagtataggtcctgaatatctttgttagatttctgcgttggggatctaataatactgttagtagggtgttgaactcttttactattattgtggggttatctatgtctctttgtaggtctctaagaacttgctttattaatctgggtgctcctgtgtttggtacatatatatttagcatagtttaattgagcactttaccattatgtaatgcctttctttgtcttttgtatcattgtttgaaagtctgttttgtttgaaattagaataacaacccctgctttttggttttgcttggtttggttttatctttgctttgaccctatgagtgtcttgaagacagcatacagttgggtcttgtccctttattcaacttgccagcataccttttaagtgggggcatttgtcctatttatattcaaggttaatattgatatatgtggatttgaccctgtcatcctgatgttagctggttattattcagacttgattgtgtaattactttatagtgtaaatgatctatgtatgtaagtgtgtttttggtggctggtaatggcctgtttctatatttaacccctgtgtaaggtacctcttatgaggcaggtctggtggtaacaaatttccttagcatttgcttttctgaaaaggcttttatttctcctttttaaatgaagcttaatttggctgtataagaaatcatggttggaatttcttttctttaagaatgctgaatataggcccatgatttcttctcacttgtaggattcctgatgaaaggtcgactgttggcccaatggggttccctttgtaggtgacctgacccttctttctagctgccttaaaaaaaatttttttttacatgttgaccttggagaatatgatgactatatttcttgggaaagtcatcttttatagcatcacacaggaggtctctgcatttcctgagtttgaatgttggcctatgtagtgagattggggaaattttcatggacaatatcttcaaacatcttatccaacttgcttgctttctctcccatttcttacttttaacgatagtgcgaggccataaaaatgactgtatgttgaaactcacaacgtgatcttaataatcaatgggagaattatgattgctctgtgacctttaaatttttgtcaaagtatttaaaactcttttgctctaaattgtacatccataggggaaaataatagtaaaacttccatttgagggctctagttatcttataaagtaactagataattttactagtaaactaatattatttagtgcattataatttaaacattagaaacattgagaaagtgttttttatatataatttaattaatcctaattatcaattttgtataaaaattaagtacttatctttttcttctccttatataacttatatctaatgagcatcctttctacccattggaagcaatttggaaaatgtgtcttttgctaatagaggattttcatttcttcaatttaaaaagtcatagtttgggtaaggggaattaaaaattatctgcaccttaattacaaatcaagtctttacagaattatcatttagccttttggagtattaaccaatgcaataatagttgaaatgtggagcaattgctgggctgtatcaaagattatcatacaactgagacatataagggatgtggagtcacttaccccatcttttcctcaatgtagggattatctttttaaaatttgtgaacattctgatacttttgaaagttgttccttaagagagcttcacatcatatctaatacagtgatcactgaaaaatttattcttgttaagtcaaagacttctcattacctttccttggtcccttattcttttctctagatcttaagaactaagcccacttgttgaacaggatactcgctaaacattcagacagctttcctgctcacgtccctcttttctctaagctgtagtttattctagtgccttctgatttctgaaaacctcataggatacttagttccaccctctttactctttttatagtgcttatccccaagagagtttattaatttggaaattttatccttttggtaatcctgattgctgtagtgccgaagagcaaggtcgtacatcttgggagatggaatcttgatttgatcctcaagtcagtggaaagccatttacgggttatatgtagtaggcagaggagtgagataaacagatttgcatttttatgaagatacctgcgcagcattttggaaaaaggaatggagtcgatgagggacagtgggatctgcaggggagtttaattatgaattgatcagggtgagtctttcaagtacctttctgtcaatgagcatttataaggtctctccaattatttctgggagtctttctatttctgctctggcagagtaaaatagatgattagttaagatcttacgttagacacccaaaggacttgcagaaatagttggcgagactttgagatggagaatcttaagtcttgtagttatgtaggtaggagtttgtgtactagagaattttaatattgatgttaatatactttaatttttaccaatatgctgttgaggttaggacacattcagggtacattttcacttataataaattattcttcatatgtgtctatctctcactagactatttattgtctgactgatgtttgagagactgacatgttagtgtttatgtctttgtaaatagcagagcatctggaacatattagaaaaaatatgaatgaatgaatgatagacataatgtgtagttgttattgaaattatgtatttcggtgagttggataaaatttgtctgttatttaccttgtttaaaaataaattgatgtgagttaaaatttagtaatgaagagcagcattgtaaatactacaaaaaacatttccagataatatttaatagctttacaagtgtgtctttaatgaacttaagatataccttcccctgtaattgctgacaactgtgttgttgtaggttggagatcacacgtgcttatcagaggtactattgacttatacttgttctgcttattgattacttaattagttttctaagatagctaatcagagagagatgtaggtatttaggagtctttcattaaaacatgctaagaaatttaaaacagaaatgtgtgacctgaaaggaaagctcagtaaaggcagagttcttgaggaccttggatataatgtaatgtcctactgtaggtaaaactggtataatttaatttctattttcttcttcagaataatgatatatttttttgttccattggttagggaaatatatcacatgcatgcctctatgatttatgggtatttccatttccatctgaattgtagattagcagaagtaagtgcacatttctacgacctatatattaaacacacttaacttttgacactttctctttttattggaattctattgataaaatataaaactaatgggaactttctctttttattggacttctattgataaaatataaaactaatgggaactttccctttttattggaattctactgataaaatataaaaataatgggaactttctctttttattggaattctattgataaaatataaaactcatatttcattattttttaaagttttgtttgtttatttatttatttatttttagatggagtctcattctgttgcccaggctggagtgcagtggcgcgatctcagctcactgcgacctccacctcccgggttcacgccattgtcctgcctcagcctcccgattagctgggactacaggcgcccgccaccaagcccagctaattttttgtatttttagtagagatgaggtttcaccgtgttagtcagggtggtctcgatctcctgacctcgtgatctgcccgtctctgcctccctaaaggtttattttttaatccaaatccgttttgtgtttctgttcaaatactaactaatataatatgggatattagtgaagtccttcatctaacaattctttaacttcaattatcttctttagaaaatgagttgttctcatcttcttatttaaattaattaataaacactagcacttttacatcatatcctgtgttttatgtaaaataaactctcataaagtttacactattttttttaaaagaagtgacttctaatgttatactttcctcacaatcagagtttttaaagaaaagtcataggaatattttgctctttctacatatctgtacattttattagttggtttgctgtcatgctttttcttaatattaaagttgaccaaaacaaaacagaataggtaaaactgtgcagtaatgaaagctgatcattaatgacatgtccttaaattgagctttgagatatgtacattgagataagaatatttattctggagaattctagatgctgcacttaacggtaaatttgctaaatagttctgatcttggaatttttacatactagtgtggaaagcttttattgttcagttatatcattattttattaaaactgtttattcatatgacttttgggaaacattacagagctggtttgtcacaagttctttgtacctaacagaatgagaaatgagatgataaaatagaatacagttttatttttctgttttaagcttaatacctaaaagatgtatgaactattaagtaaaaaaacactcaattattcattctttcatccaagtatataaccaatttattaagcatatatgtgctcatgtgaaaattgaataagagctttttgtttcagagcaattttttatttaaaaattcttaacataaagtaatacaagactcatctatacctctagctttcactgattccttgctttaatcattcgtctagtaattcaactgatatttattcagcaacagctgctcatttacataaaataagaaacaatatgttcaggaattggaggatattaaaaaacagttatcttaagcttaagtttggaaaaataacgtatatagaggattacttaaaaatttgtatagatttaattgtgtaaaatgtgagaaaagggaacaaattgcaaatgaaacaaatgaagaaaaagtacatgttttccatctttcttcaattgctgttttttgttgtttgtacataatttagaggcatagattggattagtagtatatcacttttcatatagtttatttgaaaacttgtattccctcttccggtctcatcccctatcttcccctactaatggtaaggaaaacaagttggttggtaattgaatataatagcattcatcccagcaggttgcatagtctccgctactgcaatagttcaaaaccagtgggatgatttggattagaaaattgaaggtaaaatgaactattaatgtaaatgaaggaaggcactgtgatttgttgaggaagaaaacaaagagtatgtaattccagtgtcctaagaggcagagagacttttagaaagccccacccctatcatgaggtcaggagatcaagaccatcctggccaacatagtgaaaccccatctctactaaaaatacaaaaaattagccaggcatggtggcgggcacctgtagtcctagctattcgggaggctgaggcaggagaatggcgtgaacctgggaggcggagctttcagtgagctgagattgcgccactgcaccccagcctgggtgacagagcgagactccgtctaaaaaaaaaaaaaacgaaaaccccacctctttcagtggcaaagcttattctaatagtgttcaaaataagtctcaggtacctatgactataacaaattgggttcttaggaaaatatttttgctacaattagttttttgggggatgcttgtacatgataaaaaggaggaggagtatttctgaagtgatattttgggtgggtctgctaactatatagattctggaaccatgtctatcaggcgaagtgtttttaaaccatcttttgataagtataggtcagactttggtgttatcatggattcattggcacacctccctgatccctcttcagggccaatacacccatccataattacctacagtgcctgatgcgcctcacttcaacttcaggaaagtgcctgggacaaggttatacctctcaggggacagcctacaaccactgacaaactcatgcatggacacaaatgttgggcccccttgtctcacttcaggacagctctgcaggagctgacactgcttgacaatgaagatcctttcagaagtggccactcagcccaaagatgtgaggataaagggatttgaacaaagatgaggattaaaaacttcccataactctgggtaatttattctacaaaggcagaatcttcatcctgaagaggtcaagttgaattgctagggttctgtatcctggtgtttagatcaggattaagaaaatggcacaagcattctaaactacctggagggaacttttcccagtcttagcatgtgcattatatggcatgggcttaaccagcaaaagctctcaaattccttctacttggagtggatgtggggggaatgacaagttctaccacacagagtatgtgaacaaggcaggcttatataactcctttaggatcaacaagtgaggcttgagggttccagtggttgattcacactgtcagctaaggtgatgttttacattaagtacacagggaggaatagtgatcttcctatgagttaggaagagaagagaaaccccattcagatattcctctgtgtatttatatggagagtagacttgcctttattccttctctttttattcagccatttatgggcacacttcaccctggttcatagcataatcaatctcaaaacctatcttggcagatatatttgctgtaacacctcagaaaacacaaacaatggatcttttatgaatatcatgaatcagggcttaagttaaaggttagcccagatgaaacagaaaattagagattaaatagtttgccctctcttgtcaattccagcttatatcttgtcactctttatagccaaatgaagaaaaaaaagcacaaccacgtatattttaaattatttcattgattaaagtagtatcaattcaaaatggcatcaaaaccaaaaatttcctctttgccattctgaaatttactcaaggccagaaggagaatagaacatagacctttaatatttttggtgacaagaagtttgaagggctgctaaacaaaagaaggagcaggggcgaatggggaagaaagaggagcaaggaccgccccagttacacatctgagaaaaccaatccagttcacttttcaaagatgcagggcacaaattgagacacaggactacatcttttatttgcagagatcagaatggggttattagcttgaatcaggaactttctagactatagtttgtttctcacaaaaaaagggctcagataaataaggaatgttcaccaaagctgtaatttcaggaagtagctggaagtccttgagttgtgtaaagcaagttagtttcctatttccattagctgttaagaagtaaaggctaattgagctgccgctcaaaaccgtaggtcagaaaaaaaaaaaaatccctctcagaccataactctgattctttctaaacaaaagccacatataaatagatcaccaagaaaaaaattaggaacataaaggctaaataatcaaaagggaaccaacaaagattctacacggaaaaaaaaaggaacataaaagacaaagagcagagaagaaaaatacttacaaaaataataaaatgtagccatgtagcagataaaaataaaccatcttgacaaaaatttaaagatcgtatgcctctgtgaagcacataccagagtgaaacaagtgctcatagagaatatggagacataagagacttattatatatcttaattaaaaaaaaaattatttaaaacagtctcaactcccaagttttctcatgccattgatttgttggatgctggcactttctaggtctcttcctcaagtagttaataacaaataaccaaatgacccacaaacagatttttgaccacagatatccagtcatgccaccttgaataacattgaggtcacttcactttttagatagttaatgcatgctagggagtgaagttgtaataacttccagtagtcaaaagcaattgtaaaacactgaaaattgtattaccccatggattttaatagtacatcccaatttcagagttgttaaaagtgtgataaaatgtgtatttttaaatttaaagaatagattaaaatgtactgtcagaactaagacaaacatctgtaatacaaataaataaaaatgggttgaatttaactattgaaagaaaaatgtgttatatttaatcacatatcaaagtccaattttgttctttcaacaacaaatatttctaaaataaggcattcttatagattgataaaaacatgggcaaagatataaaaataaaatgctaataaacaaatatcaagggtcatgataattatatcaccatatgttgaattaaggcaataattactaattgacataaaattatagtgctaaagtatatactatacaattatgtatagcaattatactaaatttgcatgcaagcaatatatcaacatccatagaagcaaaaaccataggaaaaaatattaaatagaacaaaatcacattcttattataagtaaaaaactttaatttgcctgtcttagaccatgatagatttaaacaaacaaaatttaaaaatataaattatataattaattaggtgcattaatgttgtataatgctataacctgaaaagaacaaatacatattatttttcatatcaatggaaaattcacaggaattgataacatcttagattgtaaaaacagtcttaattaagcaaatcagaagtagtatagaaaacattgctgtactgaaggtatactaataatgcactgaaaaatatattaataacaaaattaaaaagtaagattcctaccactttgatattaaaagataaaaatcctctctataacacttttattaaaaagtaattctaaaataaaacattgtagtaattatagaaaattaacataatgaaaatgctgaatatccagattagtgaaatagaggtagcagtgctcagaaatatattcatagaccaaaactatcttctattagtaaaaaagaagttaaacgaaataagcatataatttatggaaacatggacctatgaaaaccaaacattaataaaggtaacactggaaaaaggtgaatcaaaaaaataaaaagcaaaacagtaaaaaacttcataagaaaagaaatctcagagctaagtgggtgtttgtttgtttttgtttttgagatggagtctcccattgtcactcagtctggagtgcagtggcgccatctcagctcactgcaacccccgccaccacgaccggctaatttctgtatttttagtagagacaggctttcactcttttgagcaggcttgtccagaactcctgacctcaggtgatatccacctgccttgggctcccaaagtgctgaaattacaggcgtgagccacagcacctagctgctaagtgttttcttttttctttttttttttctttttcttgagacagagtctcgctctgtcacacaggctggagtgcaatggcatgatagctcactgcaagctctgcctccctggttgaaatgattctgcctcagcctcccaagtacctggggttacaggcacataccactactcctggctaatttttgtatttttgtagagatgggtttcaccatgttgtcctggctggtcttgaactcctgacctcgtgatccacctgcctcagccttccaaagtgctgggattacaggcatgagccaccatgcctggcatatgtgtttttttaaagaaaaaaaaaattggctaacccaacagagaaaaattgaatatatgttaatttaatagtggtaatcatcacacaatgtctatgtatatcaaataaaagatgaaaaagcaaaaagaaaaatggaaaacggcaataaatccgaaaagaaagaaaatggaaggaaggaagggaagggaaatgaacgaaagggattaaaggcaggaaggaaggaagggacgaagggacaagagcaaaataatataaacaaggatgaaaatggcacaaattatgttcaatcatataaaaataaatgtgaaatatgaatttgaggagaaaacatagttatctgtggattgtcataacagcatttgatagaattttttgtaaggcagaagtaaatggctaattctaatgtatgattaaaatgtatattaggccgggtgcggtggctcacgcctgtaatcccagcactttgggaggccgaggcgggtggatcatgaggtcaggagatcgagaccgtcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaaaaaaaaaaaatgtatattaatgtatagtataaatatgtgaaacatatataatatggttattatgtataatcaactgtaaaaagaatgtatcaactcctaaactaaaattatgcttaatgtaaaaaacctttaaaaagtcccattgaattcagaattaaagcaaggctattcattatcaccactactgtttaataaaaagtcagttaaagaagacattgaaacaataagtataaaattgagaatgttttccaggcatataagcattatcttatccaataatgatgaattgtctgaaaaataaagaaaataaacagaaaatctactataaacaaaataattcagcaaattaataactttttctattcataaatgacaatgtttaaacatagaatgggagagaagactcattttttactatggtagcaaaaaatactataaataaacttgaagtaatgtgcaaaagctatataaagctctatggacatggaagactgaactcttatcctaaagagaattggttacctgtaaattaatctctggaattcataggatcccaataaaataccatagagattattttagtaccttatgtcatgatttctggataagaaaaaagaataaataactaaaatcatctgaaaatgaagagtaatgaagggaagctagccatgctggatattgaaatttattacaatatttcaatcatttaagaagcatggtactgtacatatacttagaaaaagagtcagagcaacaataccaaaaacaataacagaaatagaacaaatacatcaaggaatttagtaaaagagtgataatcaaatcagagattatacaataaacagtgttggaacagtcttgtgtttatgagtgtattagtccattctcacactgctgtaaacatactacctgataatggataatttataagaaaggtttaattgactcacaattctgcatggctgggggaggcctcaggaaacttgcaatcatggtggaaggtgaaggggaagcaaggaccttcttcataaggtggcaggagagagatagcaagggcaggggaaatgcctgacatgtaccaaacaagcagatcctgcaagaattccctcactatcaagagaacagcataggggagactgcccccataatccagtcacctcccaccaggtcctttcctgaacacatggggattacaattcaagatgagatttaggtggggacacagagcaaaaccatattattccaccttggctcctctcaaatctcatgttcttttcacatttcaaaaccagtcatgccttcccaacagtcccccaacatcttaactcattccagcattaactcaaaagtccaagtccacaatttcatctgggacaaggcaagtcccttccacttatgagcctgtaaaatcaaaagcaagttagttacttcctagatacagtgggggtacaggcattgggtaccaaataggagaaaattggccaaaacaaggcacaggacctatgcacatccaaaacatggtgggggcagtcattaaatcttaaagctctgaaatgatctctttggaccccgtgtctcacacccagggcatgctgatgcaaagggtgggctcccatggccttgggcaggtctgcccctgtggctccagagtgtaaagccctggtggctgcctttcctttccagatggcattgagtgtctgtggcttttccaagcacatggtgcaagctgtcagaggatctaccattctggggtctggaggacagtggcccttttctcacagctccactaggctctactagtgccccagtggggatcctgtgtggggactccaaccccacattcccctctttattgctcaagtagagtttcaacatgagggctctgcccctgcagcaggcttctgcatggacatccaggcatttccatacatcctctgaaatttacgtggaggctgccaagcctcacctcttgtcttctgcacacctgcagtcccaacatcacatggaaaccaccaaggctttggacttgggctcccctgaatcaacagcccgagctgtaccttggcctcctttagccatggctggaggtggagcatctggacacagggcactaagtcctcaggctacacagaggaatggagccctagacctggcccacgaaaccattttttcctcctaggcctctaggcctgtgatgggaggggctgtctcaaagatctctgacatgccctgagacatgttcttcattgtcttggctattaaatttggctcctcattacttatgcaaatttctgcacccagctcgaacttctccccagaaagtggggttttctatcacggtcagtctgcaaatcttccaaaccattatgatctgcttcctttttaaacataagttccaatttcaaatcatctctttgtgaacacatataaccatacactttcaggaaaagctagatcacttcttgaatactttgctgcttggaaatttcttctgcgagataccctaagtcatcactctgaagttcaaatttgcatagatctctaggtaaggtgcaaaatgctgccagtctctttgctaaagcatagcaagagtcacctttgcttcacttcccaagaagtccctcatctccatctgagaccacctcagtctggacttcattgtccgtattactatcagcattttggtcaaaaccattcaacaagtctctagaaagttccaaattttccctcatttttctatcttcttctgatccctccaaactgttccaaagtcttcctgttacccatttccacagttgcttccacattttcaagttatctttgtagcagtatcccactatcctggtaccaagtctctgtattagttcattctcacactgccataaacatactacctgaaactgggtaatttataagaaagagggattaattgcctcacagttctgcatggctgggggagggctcaggaaacttccaatcatggtggaaggtcaaggggaagcaagtaccttcttcacaaggcagcaggagagagagcgcaagtgcagggtaaacactggacacttatcaaacaaccagatcctatcagaactccctcattatcaagggtacaacatggggaaagccactgccatgatccagtcacctcccaccagatccctcccttgacacgtagggattataatttgagatgagatttgggtggagatacagagcaacaccatatcaataaggaaaaataaataaattttacattatatataataccttaagccctcagtattttaaattgagcaaataaaaagaagagaaaagataagaaatggaaaatattaaaagaagataatgactataaatatacaagtatatatgtatatttatgtataaaaatatgtgtattatatatataaatgtcataccaaaaaagatcttctcaataaatatatgtgaaaccaaaaccgaattgaagaagataatatgtaaacacataaaaaaatagttgagcattgtggcacatgcctatagtcccagctattcaggaagctgaggcaggaggatcacctgagccctagagtttgaggctacagtgagctatgaggctggagttactgcactccagcctgggcaacaacaaagtgagaccccatcgttaatcagtcaatcagttttaaagacagcatcaccataagcgaaatataacaaaatgacagattttgatatgtattttcttaagatatttataaagagcttttgaaaaatataaattgatatgaaaaagaacagttcaatagaaaaataggctggagatctgaccaaactgttcacagaaaataaatagctcttaaacatatcagataacctcaaagtcactctttggtgcataactttggagagacaggtgttccatgaatagatgaaaagtggtttgacaactgttattgaaattaccatgcgcatctgaaaatttttctgtgggtacattcctatatgtacaagaggatatagataaaactttacacaatattatttgtgataacaaaacattggaaataaaccaaatgtgcttcaataagccagaggttaaataaattacaacccatatacacaatccatgtaagatatattatatatgcatattcccatatatataagtgaacactgattaaataatttatattcatccacattatagaatcaaaagcagctttcaaaaggattgatgaagtctctatgtactgatgggagataatcccccaattatactaaatgatttgccaagagtatgtttactttaatttttaaaactatttgtatataaaagaacaaagaacatttgtacatatttgttgaatatgcaacattatatatctacatacaagagactgataacaatttgcaacttttaggaaaaggaattgcaggtctaggggagaattgtaggttaggaaactttcactgagtaactttgatacgcttcctgaattttgaaccattcacaaattattaatttcggaagcatccaacatctatcaaaattggttgaataaactaccaaatttcttgttaatgtaagctcagttaagtagattttatatattgaagtacaatgagaattcatgtagcctttacaagcatgtagcccaagtgcataggaaaatccattagctgcataatttatagccaatttaaaatatttaatttgagcaagaagttgacactctgctatcccactgcctgaaaaaaaaaaaaaactttctgaatcaaggacacaaatattaaaattgtattgaacatcttattgaatttttagcctaaatgaaaattacaggttgctttggtaataacaaccaaataaaatctggggtaggatgaagctttaagcacaactgatgctatttagtccaattacttgactgaaatacaaagaatgtaacactttgtaaaattatctttactttggggtaaaagtgtcttccactttttattaacttagattcagataattttatatttggaaagtccttaaagctcacgtttccatcaggattttacaaagccatctttactctgatttcccagaaataacaactataactttgtttgctaacgatttactctttagcatctctacccaaagtcagcctaaatccctcatttgcaatttacatttatttccagacgttctggatgagaaagacatggaaaattttgtactggtggtatttctttctataacaacctttcatatattctaaatcatttattatacttttctcaaagtatttctataatatcaggtttaaaaatgaggaagctaaattatatttccataagtgaagtcatcattagtacttacattagaatgttttattagatgacataaaaaattacgcagaaaattggaaaaggtacttttctttgttgttacatgtacattctagtaggtatgattaaatctgagtgatttattattttggtttatatgctttctactgtttgcttaaacgttgttcatctgtagttgttttcctggcagatctatttcttttttattaaagcatgttcaaatgtttgttctcattctgcatccgcaaattcaatgtttaaacttagcaccttcttagaatttgaatttagaaggctacctttctttacatccatgatttttatcagtctctattctgaccgagtaagaaatagacacatatgggaggttttctattttagcagaaaaatggtatactaaatcttttaaaaaataaaacatcatttgaagtcagtagagagctactgcttctttttatgtgtctgatcatttgcttagcactgttttagttatgtatctgattaattttgaatagcacacattaattaaaatttaataacacttcatttaattaggttaggtattctcaaaagcactccagagctagatttcatgattcataggagcaaaaatacccacttcttactcaacataatgatcccatgtttaaaaggaatatagtcagagcagcagggatgaagcacataaaaacttgcactacatattattttgtgatattttagttataatcctttgtttctaaattaactcatctttcatagtatgagatacagcaaagagattgaaaacattatgttagatgctggagggcaaaacaaagaatgaaacagtgtctgaccttaaggatattaaatctaaaccaaaggacttttattattgtactttcaaatttctgaatagatgatcagaggctgggtaattcagcaactgcatacagatttttaccatcttgctgccctgttatcctgagcttgtttccttctgcatgatgtcaagatagctgcctcaattctaatgtcatgtggcaagctcaagtggaaaagggtaggaaaagagactagatgtgtctctttagcaatgagagaatcttttcaggaacccttaaacagacttttcatccgtcagaattgccgcataccactgtttctaaagcaataaccaacagagggaatgtgtttgccatgattagcttagttaagcacatggccctgtaaaaacaagttttgacagaacaaaattgggcttttgctaaccaggatggaagagagaagggatgtatattctgtaagcaactatcagtgtctgctatataattgaaaatttttgaagagggaagtgtcatgatcaatctgtgcttttttgtcttggcaattaaaatgtacgttgacctacttggaaaatcacagtcctaggtttcacggaaactggctattttatgcttctttttattctctctttctaccttttttctttctcttcttattatcttaattattatttcaattattaagtttttatgtctatcaccaatattttctgtttttcctcttaaatgccattaccttctatattcaccttagtctgttcacattatttcttttgtagacaacgaaaatagccataaaacatgtctaccttaatttactattatgcctctatggtaggactggctacatcatttgtagggtctactgtaaaaataagatgtggggcttctgttaaagacgtattaagaacttcagcgtggcaacagtagagtatcaaattcaagcatgggaccctgtgggactgcacaagctgcatgcctgtgaggctgggccctgctttccaacttgtcctccacccagtgccctcaaatatcttttctgttgctctcagaatgaggatctacatctttaatatgaactaaatgttatcagcttaattatcttatctgcatctacaacataccagcccctgttcttacttctgtgctctagccatggtaatctttcactgactctcttttatcatcataccactagacatttgcaaattctgtttctctcacaacattcattacatcctctttcaaccttcactgacttcataaatttggcaaattatcgtgtgatgttttttgtagccattgtaatataaattacaatatttttgctcactaattttctttttccttcttgttattggccatttactcaggaagttcaaatttatttatttatacattaaaaccttactgcctagtacagggccaggcctgtacaagagtctcaaaaatactcatcaattgaatggcagtataggagtgataaaagagttgagagtaggacaaatgtagtttttgtcatcataatgtttacaatataggaaaactagcaggtaattctatgaagcatgtccattagtttcaatatctgtaaaatatttgaaattaaatcaatgaaagattatttattaatattttcctcctcataaaagtcttacaggctttatttgtggagaatagaatggcctgccaacacatgctgtgtttgacatggataacactgctttgcctaggaatggacattaacagagttacgtgaatttaagtatttaacatacttttttcattgatactcaacgaagagctattttcctaaataaatttgaaatatacatatggcttacccatgtgactgattatcagccaactatacattggcatcaggaactggaatgaacttggtgggtgtcttgaagaaggttcatctcccttcaatagtcatagaataaatagcttggttacatttatacttaaaacaacagaattattgtacttattcataatgctaagtgttttaagtggtctagaaagcatttattaatgttatgttctgtcttcttagtgactatagatggtaaaatttttcaaagaaaagtttcactcttctaaagggtccttggattttgtccttggtttgaaagtagttttaatagatctatttaaaacaacctaaagtgcatgtattttgtgaatagatgaccaatttcataaccttctctcctatcaaaaagaagactagttgttctttttcattgatgtgatattcagacagaggaaggcttctttaagttcttgttaaagttattgcagataccagatgatacgctcaaagaactttgcttgttgtctttttaactttccacttctttaatcatagctaggtgacaagtctttaaaaagtcttaatatttgctaagtgtaagtaaagctttcattaatgattcttgagttattggtgcacagaagaggcttagaaaaggtgaagcaatttgaggtgaagaaagcaatactttttctctccatcattccatcacttaaatatattagaatatgtttctgttacccttccaaggaagatgtatcttctgaactgtagtcataattttttttcaaaaaatataaattctttaaggtaatttgtaagacagaattcaaatatgtaactagttctgttttcttctatagcttatatttatgtataaaactcttgcattacacttaaaatacataaatggtgtcagtgtgtataaattcctaaataaaatatttattgtaaaatataagctgggtaaatgctttctccacgtttgaattccagtctctatagttggaattctaattttctgccatagtagtaattttacagtaaagcacacatatctatcaaagtcagaatagttgatgtcagattcagatttaccatattttgcttaggcttttcatgaagcatataataacaaccattgttctgtgttgtctgcgctagagtcatatgaaatataagtgagtacatgatgagggttctaagcttgacatttccattatgcattcatcttcctattccccttctaccttctcttgctctctttctctcaccatatatatatatgtatatctttctcactatatatctatacacatatatacacttgtgcatatatgtgtgtatgtgtatatacatgcacatacacacacttatgtctcattctctatttttattaaaaaattcattgtaataaagctgtactctatagttatagatttatataaaagtatgtcttatatgttggctacataacacaattaaatgcaaataccaaagatacagaatttaaatgttagttgttggcttttgaagctaaaatgaaattatttattcattcatgaagcaaatggttacttaatatctgttatgtattagagtacaataaatgaccttcttcctatttctaggcctctattcccccaatgcctttttggggtactttattaatttttctggttcatgcaaataaagtagagttagagaactaaaaactaaaatatagttttagattcttcatgaatccagccaagatagattatcagatttttttttctctttctacagtgcctctgaggctaacttaggaccatctaggcataaaagaaaagctgatttcctgtcatgaaagtaattcctacttggacttaatgacttaccatagcaccattcttcaaccttttcattttttggcatattgcaaaatatctaaattttctagggaaatgtcaggggttaggggagacttctatttgtatggtagtgaaaagctttttcttagtatcgtaatagaaagaagaagagactagatggaaacggaagtgaatagaagaaaagcagtttaaaagacaggaatggtaaattagatatgtgtattttaccaccattataaaacaaaatgcacgagtgggacttacagtctttgcttcaacatgtgaagaagttggaagtcataattcctgactttaccataacaaaaagctgaataaactgaaaatcaatgacattttttaggcacataagagaaatgatatcttggggcagactgccatgctgaaatctagagagatgggctaatccagagagccacatcaaagatctgcttacttgaagcagaagccactggagccatacctggtagagacacaaggtaattttaataagttgctagagcctatggaataacacaaaagtgagaaacttattggggctacattgttggtggggaggtcattgtatttgtataggttttacatcctgtggaactgagaaatattctctcatagatatggaagggggatttcccccacgacagcccactctatcttttctttgtcacctaagctgggagaagggagaagctaagaaaaacttgggacataaccagggacacagagccacgaaaagactgagatttaaccataaggtagtagaatctttcccattctccacaccttaccacacatcaacaaagctctagtataataataaattacagctgaaagagctttaagacagacttaaagtaaagaaatggtgacaaatatgccatggtcaaaagaaagctgaagtatctattatgattttagagaaaacagacataagaacaaggaaaattatcagaaataggagagacactgcttaataataaagggatcaattctccaagaagacccaaaaaccctaaacatgcatgtacctaacaacagatatcaaaatatgtgacaaaaaacctgatagaactgaaaggagaaacagacaaaatcactattataattcgagtctttaatactcctccctcagtaactgatacataaagcagacaaaaactcattagcaatataattgacccaaatagcagtataaatcaacttcatctaactgatctttatagaatataaaacagcagagtacacattattctcaagctcacatgaagtatccaccaaagtagatcatattctgtgcccataacagaccagaacagaatgtagaaagggaaagtgatagaggagaagatttatctcaaaataattttggcagaaaaaaattataggtaggaggaacaaagaataaagctaggaaaacagtaaaagtaaataatagctaccacctcttactgagcttttactgtatataggtgggttctgttcccagcacattatatacatgacttgatttaatcatcttccactttcatctgggcttttgtcatcatttgcagatgaggaaactgagactcgaagaatatgagcaatttgtaagtgacagagccgagatttaaagccagagacctaaccttaaccaagacttgactttgttgactctttaaatatggagtcaaggtaccttttgtgaagctgggttggatggcttaaatctaaaactgattcattcatgagtaagagttttagagagtgaccagtgcctggtagagtatttgcatttttctcaggtcctatttctcatcagtctcaagcttccctacttccggccagctattcttggctctcatattcctaccagtaaatcttgttttcctctgcaggtcaagttattgctgctaggatactttcatcaaatatcccacgttgatcacttcatattatttaaaatatgtatgtgaaaagactattggtgactttgcaaatagaagtcacaagtatatattattcttgggtaatgggatgaagattgagatacaagtaagataaagaagattgttaaaatcagacagcatctttttctctcctaaattgtgaaataatgtttttcacagaaaatatatattgtggtacattcatgcttcataagggcaaggactataacttattcagcttcgtttcctccagcttgggtcttcataaatagaagttgttttaataaatgttaaatgaattgtaatccttaataattattttaaatagtaaaacatgcctcaagttttaggaaaagctcataaatatattgcatataaaattaagtatattttatacaaaggaatgaagtatgctgtacatagagaacataaataatataactctaatgtatcataaatttggtctaaagctaacaagctagctataaaaagcatttccaatttcttgtgcctttaaatttaaaagagcttgttagaagggttaggatgaactaagtttctataaaaggctgaccttggaactttgaattatactttcctttgatctcagtatatgtcccttaacaaacaaaaaatcatttcatttcttggtctagagctgagctcttcagaataaacagtctagtttattctgtgcatttcaatgcacagtgttaaactggtaaaccagcacatcagtaggtaaaggcacttgaaatgttcttctagattaaatatcttcagataaaccaaatgaagaaaattatggatatcctatatgaccacacatattaaattccagggtgttactatgaaagcaactttttcttggattctgatttccatccttcatgatcaaacaagtattttgtcagttaaaaatttaaatatgccatcttacaatggatgagtgctacaatatgactcagtgcagaaattgttctttaatcacagggttgaaatactagcatgtgttaaaatatattggaacgtcactacagcagttatataattatcctttaaatgttttctttttgagtctcttgtattattatagttggatcatgtaatatagttattagtgtatgtgaaacaatagaactgtgctgtactaaattttaaagtatgcacgtgtgtgtttgtgatagtgtgtgggctgtgaataatattttgtctaagatacaagtattctaatgtatcttagaaggtctctttattttcactaattggtttcagaacgtgtggtttgagctattcaactaaatagactggttatttgactttgagtatcttgattgttttcctgttgtatcaaccaactgttttgattccacatacagttaatttcttttttttccttccttccttccttcatctttatgactgaggataacattactcactgtctttacttcaaacaaaatgaactttgagtggttgtatagcttagagtcatttactagtgacctttttaaatcattccatgcttcagtttcctcatttagaaccaacctcgtggagttcttttgaagaatgcattaaacatattaaagttctcaatatattgagaacccattcaaaggagtttcattacgaggaatatattcctttaggaatctttcagttccctgtttatattttttcagtaaatagttgtgtttttttttgtaaacttttccaggttttatttttttaaaaaattaatttctggttgcggagtgatgcttttgttttacattatttaatagtactattatggaattattactgcttcccaaaatcctgctcccttcccactcccacagattagtgaaggtaaacttttggaagatttatcacttgacgaatcaggtttcagctactgtacctcctagctggattatgaaggtattaaattcataattctgttactaatgcttccctccttcataaccataataatgtgctttcatcaggaagcatcttaaaatatatcatgtaaaggcccttgttactctatacctcccacactgtcacttccttggtacccttaattctttgaagcttgaatcatactgtgtatatatacttcatccatgtccagccttttaataatctttctcattgtggcataaagattgttgtactagtagaaaagaagttccatttcccttaaagtttcctatgtccacaattctatgaaacttttcagtggaggtcaccaagtccacttttacagattttctgttatggggagagggcacctcacaacttgctctcagatactgtattcaaaatttcattatcgtcaggaaatatatctcctttaaatcaccaaaccgttcagttgcagttgttctcaatagcctagtcaatttcattcactgaattatagatttccctgattcttaataaatttactaattatactttcctcctaacaccctctgctatgactgtaaaatcactatttataactgataaaatttgccaaactcagtttcctgatgtactcaacgcctctggattttgacatttcttcattttagccacccagtggcaatgccaattcttcaaaagtgtcaactctcagaaattctccacctctgatttgacagtctcaaagatagacaaggactgcctctccacttttttgacaagtgacaaacactgaactgacaactgataaatttgtacctgaatctggtcctcctgtatattctttatttgtccacttctgttgctaggttagagatgaagataatttgtttccacgctgcccagttagtatctgagatggcctgactcttagcattcaaaagtatcactttgctaacaccattctacgtggctagcagataacttttggtctgtgtctcttgtggaaaatccacagaacaagaatagttgtgtcacttatttattaaaaaataggctgggtgcagtggctcatgcctgtaattcttacactttgggaggctgaggcggttggatctcttgagctcaagagtttgagaccagccccgtctctaccagaaatataaaaacttagctgggtgtggtggcccatgcctgtggtctcagctacttgggaggctgaggcaggagaatcccttgaacctgggaggcggaggttgcagtgagctgagatcctgccactgtactccagcctgggccacagagcaagacactgtctcaaaacaaagcaaaacaataagtagtaagcacttactacaaactactagatttattcactattaacaataaaatatacatatatgagtatgcacattatagtgtcatatgtaatgtgtatgaattacaatgccaaaaatttaatgaacattccacttatttattcctctaatccttatactgttttagataatatgtctcttatggtccattttaagctgtttcagattccagcctttgttgattgcttctttgctaatgaccacttactgtcccaattgaactgttcactgcttctctaggagataaaattagagtattttctctttgcatttagctaacagcttaactttcctgaattgaagtaatccctacaatgggtagacagttgaaatattattcgcttagttgatgcctcaaacatgttagctatttttcttttaaaataatatcataacgaaaaggaatatttttaaataacattataccagcccaataaatacatacgtttatatttctgcagcaacatgtttcaagatcaaaacataaacattaaatatatttatgaattactacattaagtatatttttatataactaaggtaaaatgcaattatatgtgacagatatcaaaattaaaatggtttaaaaagacaacttattttcccatataaaaatccatgtctttttaagggtaatactcagaattttcatgtagtatttgtgtctcaatctcatgggacaaaacttatcagcaaatcagattttaaatgtagactttattctaggcatccatgtacttgtcttgaaataggaagttctatgaggaaggactaaagtgttaatggagaatggggggcaactagctgtctctgcctctgatattcatgagatttctgtggtcctattccaaaaacacttggttgacatgctaccacatgtttgatccagaggatataaaaattaatgaaatatggcctttacctggaagattataagcaatttattgtgaaagggggtggtagagcctaggaatgtagtgcagtgaaaactcaggaatggaaatgattaactcagtttggggtggggaggggaaacaaagcatttcagagaagatcaggcacttgtaaatgattttgagtttaattaggaatttttcaggtgaagtatagggtaagatattctaggtggtctgatacacaagaaaacaagctctattatggaatggcacaatctagagaacaggcacaattccacagtggcagcctgtggagtctgcagagggaatgtgggaggagataggtctatagaggcagcttgtggtgtgatgtaaagggccatgtatgtttgaatttcaacgtatggaccagcgtcttgcaacctagggtccataggccatatctggcctgctacctctttttggaaatagttttgttggaacacaatcacatccagttgtttaccttatgtatctatggctgcgttcctgctgcaatggcagacttgagtggttgtgacggaggtggtatgacccacaaagcccaaaatcctttctatctggcccttcacagaaaaaaaaaaaaattgccattcccctcatctgtctcatcaattgttcttggaagctttaaagcagtaggaattcattaatgggagttcttttaaaaaagtgtggagtaacagctcatttattttgaagatcttcatagttttttctgttttgctcttttttaaatctttaatatagactatgcttagaaattagaatgcaaaagaatcagaagaatatacactataaatagtttatttaccaccagtatagaaagctaactaaaaaatgattaaagaatttgccaaaaaggtattaaagaatttgcttaaggagggaaaggaggaccacactttcacagtgaaagcatggatgggctttgcctgctattttaattagtttttgaggctgtctttcatagtctttcacttagaacttattacggtaacattaattattgggaattatattggctgtattcattgtcatgtcaacacaataggaagtgctacagtacacaagtctgggccatgacaactactgaacaactgcagagaacatctgggttagctcaccgtttctagacccagaaatttgtcagttttaagaatgacttcttttcacagccaagtcttcctaggttgtcttaaacttgaagccttttaagtgctcttcatgaagttgtcatacagtatgaatacacaataagcgtcattcattaactctacattaatctgacagacattgtacttcacataattactgcctgctgcattacctttgtcctttgtaagctttaatttcacatgtcaacagcaatcactttagagtgttatatttgtagatacagaaaaaggcttgccatggcaaatatgtacttgaaaggtaagccataaactcttgcacttttgtttgcctcccagcttattatagagttttaatttaattttattttttataatttcaacttttagacttgggggtacatgtgctggtttattacatgagtatattgcaggatgctaaggtttgggatacaaaagatcctgtcacccagtgagcatagtacccaacagttagtcaacctttgtccacctctctccctccccactctgggagtccccagtgtctatcattatcaactttatgtccatgaatgcccagtgtttaggtcctacttacaagtgagaacatggagtatttggttttctgttcctgcattgattcgattaggatgatggcctctagctgcatctatgttgctgcaaaggacgtgatttcattcgttttaaggttacattgtattccacggtgtatgtgtaccacattttatttatccagtctaccggtgatggacacctaggttgattccatgcctttgttactgggaatagagctgtgatgaagatacgagtgcatttatctttttggtggaatgatttattttttggggatatatactcagtaatgggattgttgggtcaaatgggagttctgttttaagttctttgagaaatctccaaacagctttccacagtagctgacctaatttacattcccaccaacagtatgtaagcatttctttttctccacagcctcgccagcatctgttgtttttaactttttaataatagccattctgactgttgtgagatggtatctcattgtggttttgattagcatttctctgatgattagtgatgtagaatattttgtcatgtttattggccacttgtatgtcttctttagagaaatatctgttcatgctctttgcccactttttatgggattatgtgttttgtgctttttgaactgtttaaattttttatacattctggttattagacctttgttagatgcatagtttgcaaatattttctcccattctgtaggttgtctgtttgctctattgatagtttcttttgctgtgcaaaagctccttagtttaattaggtattatagggtcctgcaagcttgagttttacttgtataatttttcctgttatattgttgtaaataagactatttgctattttattaatgaaatataaagcactgtgatctgttattaaataagcagattctattagaacttctatatttttcacaataatttcctatcaattccttaggttttaaatgacagccatactatagaactatttattttgcatattgaagatgtaagctaatttgatgccttcagatgcaggcctgagtctgttttcagtggaactctgttttattaaaaatcatattgaataaatcccttcaagacttactttaaaagcactaccttatagttaaaacatgaaagacaaactggaaaatcagaaaaggggatattattatgaatatgtaaagaattcataaatatattaaataaaaatgtgtatctcaattgaaattaaacaaaaacgtggacattcaatccacaatgtagatataagtagctaataaatatgtgtagagatgcataacttctctggaataaaagaaatacaaattaaaagcacagtgtcgtatttatatttttacttacttgattgtaaaggtgagtgaaacatattagctacagtagtagctagggcacataaaaacataaacactctactgtttataagagcataattcttagtctttctgaaggagtgtttgacaatatatactacatcttaaatgttatactatttacaaacttattttagtaattttgcaggaatttatgctaaggaaatggtagatcaagggcataaagattcatgcataaatttgctcatcatagcattgttgatactgtgaatactagaaacaaccaaagttattatctgctgggaggtggcaaaatgctgtaggatacactcataaaatggatattattcagctactataaatgacaaataaaagtaaaacgtagtttccttttcaagtactcttccctttccttccatcacagcatactttgggttttcttctaatgcctctagattttgcttatctttgaaggcctgttatcccctaactggcattgaaatttggcatttcacaaaattctacccgactcacttcctttgtccagctttctccttcaatcatactttttcaaactgtgggttttgatagaatcttgagacattaaatcaatacagtgggtaataatcaaaattttagaaatgtattaaaaagaaaatagcatgagcaagggtggtgtatttgaagaatttcatgaacttctagaaaactgcattatgttcatttgcacacattctaggacttgagcctggcaggaaaagtaatggagagcattgtatgctgtgagaaatggatagcatttggtcttggaaatgatgaagaaacactgatattttaaggtgaattttattgaagaatgtaatgtactcaatctctttataagcaggaagaacagtgaatattctgcttattggaaatgtatataagacattctaacatatccttagcctaaggtgatatcccagctcatcaatcatctccacaaagactgaacttatgtcagtagtctatcagggcctattagagtagttagccaccataatattgatctttgcacttttagagttgttgcattgataacaattatctttgtctttactatcaaggcaatatccaagagcatgtgtgtctgagtcacagagaagtataaggctcatcttatgttgtacaattataatgtgtaacactggagccacagcatcaaattactataataatcctcatgtctttgggattcaataaaatctgatgttaccttttaaaataattactatcttagactgcttacagtctctgaacttggatgccacatctttcttgaagctgtcttcagaaatcccatgaaagttagtatttcattatgcatccagaagtgttggtctatgctcatagccaaggtccactgcagggatgaggaaagcattctgaatttaaaaacaaaaacttatctgaaaggtctatataaattagttttttcccaagatatttttcatagaagtaaatttagctatgactaagcagtgcataaagcaggtcagtatataattgtcttattttctcataaaaatgacagtgtttccataaattctgaaatgcattaaacacatgctgacttattaagcataatattctgtaatcaaacacataccttctacctattcttgatggttcagagtaaatattgtagtcatgcaaatcataataattccttaaatctctgtaatgtattatagtaaacaggcatatattatttgaatattgtgcaattatatgtttatgttacgaggttcttaaaatagctgaagttatatgacctgacatttaacaaccccatcctgccaacattttgtggtcccgaatcctctttttaattttttctctgcctttcacatcttacaggattttaattttctcttactgctgcaggcaacgtggctccctcaaataatgctctttttcttgtaagaaaaagatcatgacttgtgtgtgtagaagagaagggcattttactaacgtgtcagtctgaagtgtcatctgactcttctttcagccttattggtctgattgcctctcacattacctttctttgttttggaggtatccagagcttggttcttaagaatcagcagaaaaaagaaagtacagaggacaggaaagaatccatagactgagaaagggaaatgtaaagattatacacagtttgacccaattgattattgttttattatatatgcatatacaagttctgactgaaaagacagaggacaaaggggcaggggaattctcggagcatgagaaatggaaataggaggattatacaaggttggatcctttaaaaagtcaatcttacagaaaacgagaaaccagtcaatgaaggaacaaggtaataaagagaaatcttatctccatttatattttgtgaagaccattattaataatatttccccttttttatgtgtacaagtttataatttttaaactcctacctattttccttttattgcctgctgccagtgcctgtcttcctagtgacctttacaagaggatccatgagcagagaaagactaatggaagtatgcccagatagtggcagcaaagatgagcctctggaggccattctttggattcagagaaaaagagctggaggggaggtgacctggaaactaaactaagatccagaagtgaacccagacaattaaatctcacagtgatccctgggtgatttccctaaaaacgtatcagcagcgctgttatttcaagccacttaagcaggaaagcaggccttactctagtacattcctacgctaacgaagagaatttccagtatacaagaatgcagaaatactcaaacattttacagaagagtcatgatagctactttagaatccatttacatttggttatgtcctacttgttattttgtttttgttttttattttccctaccaagagaatggtctcaagtttaatgttgaattaacacttggaataaccattgcatgttcttaccttattgtgctaatgttggacacctcactatatcattttagttgtttgttcagtctcaccataaatatcattgagataatgatgaaagtgcctataaaacacctgagatgcactaggtgttctttaatattagtgatctgcttgcaaataaaacacactgtgttaggcacagtgaaaactattaagatcaattaaaatatagtctatcccttagaaacatctcagtctaatcgggaaaataatataggcatgtagtcatagttaaaatggaaaaatattagataaaactctgatacagtctttttgctttgattttgaaatgaccacccattgctcactcccagttccctcatagcagcccaaaggaatttaccttatcttctttatctggccgggtcaacttctaatacaggtgacttggcctagaaagcctgctgactctcaattttcagatattctgacatgttcccatttggatcagatgagcttggctttctataattgagtcacacagcttaggtgagagttggagactgtaatcccagtttttggaaaagtcaattgttgcatatttccagatgtagataatcctcttgagtatatacctcaatagtaaattaattaatttatttattttagaatttgaacagcaggggtgggggcagcttgaaagagtcttattttaacttgtttttttccccccttgggacacggtctcactgtgttgcccaggttggagggcagtggggcgatctctgtttcactgcaacctccatctcctgggatcaagggattctcccacctcagcctcctgggtagctgggactatgggtgcatgctaccacacagctaaatttgtattttttgtagagatggggtttagccatgttgcccaggctggtctcaaactcctgggctcaagtgatccacccacctcagcctccccaagtgctgggattataggtgtgagccacctcaccaggccatgttttaataccaggccgtctttttaaaaaatcagttttagcacttttatctcaccatattcagtactttaaatcagtcatgtatttgatcatcaggaaatgtactgacaggtaaaaagttgataattaaattttatatcaaattatactacataacaattttatcaattatgtataataattttatgtaagctatataaatgaatttatatagagaaataaatttagagcaaattacaaacatgttcttttatacataaatgcttcagtatgtatttcctaagaacaagaacatccttttacataattcttaaattataaatatcataaaatatataattaaataattacatattaaagtaaattaaaattgtaacttaacatttaatattatgtgtaattaaactatgtaattataaaaatcaagaagtttaacctacagtgtttatataaattttattggttttccctgtaatgtgttttgtaactgttttcttcctaatccacaatccaatccagaatcatttattgcatttagatatcaattctctttattttaccttagtctggaacataacctcagctttctagacctttacattttttgcattatgaagaattataaaatatttgatattttgttccattagcacaatctctagtccagtcccatttagagtcagaattccaaacatcttctaaattaaccctgtcctcttatccatctcaagcctactttggactggatgcctatcatggtaaaggaagaggaagacaacgtcagatagttttctgttctttccctctattgtactttatccttcccctcactgctgtttctttgtcgactaactcttgtttctgacctccttagggttggcagaggggagaggcaggagggagggtgagctacacatcactgttgttgcagtggctggcattgctcatctctgggtttactaagttcaaagaatactctagtggaacatctccacagccttcagagattcctcacaagagcttctggttgcagcagtctctctcctcttgctggcctcttacgacatattctcagcttctgaatgtgatgggtgcatatccatcttctctctgctgatgtttccttgctcccagatgaagctgtctcagtccatcagcatactgcatggccagtattcactcggtccatgggaaacaagcatcttttgctttgttgtctttgaaagcacagttgccttctaatatggctgtttcttttccctcaacagctaagcaggcagttccattaaggttgtcttagaatctttggggactatgagtcaggaacctattgtgcaaactgtgggggacacaaatcaaattttctgaattttgtattgaatcgtctctcttacctgattggaggggaaggaaagcaatcttctcccctccactcccgcaagaagatcagaaaaaaaataccatgccatcattttgactacctcaaagagtggtttaatatttctaatatatgtgttttcttacctttttttttttttttttttccaagacctgattttgccaaatcatttgctcatcttacttggtgggcaaacatttccgttgggaatgtaagagcatgtgccctgctattttggtttctgctttttgggccttctgccaaaactgagacagaggcccttgaaacatccaggatagtgattaaatctagcaagtgcaattaagtaaacatttccagctcctgtcctcctttagagaaaaacaaatgaagaaaaagtttaatttctagagggagattttgtgcatgagcaggactaaatctaataatcccaatagtctggcatatggcatacgtggatattcagtgagaatgtaaaatcatcctgcaagcttttctgtatttatttttggggattgattacaatctctatagtacagtgacttctctacatggattacaggagactgttgtctcagtccacagttcttggaatagtcatatttctgagcaactgattttttttaaccttatggacactgaattgattgtttttcacttgtgataactgctagatctactggagctgagacggtttttcacttctagaaaatgtgcaaaactgcaagacacatgtttggtttacaatttcaacccaggcttttttattttactttttttcatttttctttcttccaatgtcctcacttttttcttgacatgtagacttgtatttaaaaaatgatgtttgggaaaaaagtaatgtatgagtaaataactttattggaaggatagctattaacactttcttttgtatcagagaaggacctcattcccagtttctacatgccttagggatagaatgggatatttttaaagtatgtaaaaggataagtattcttatatatccctttatagtggttggggaatcatttaaaaataaagcaacacaaattggtaattgttaggggattgtcatgtgtttgttttttaagatgagaagttccaaagaaacaagccttatttccttttcgtggtattaaacagctactgccaacagtttatacagagccacaaccatcactgcagctgaccctgaaaacagaaagtgagggccatccattaagaggtccacgactgcactgagtctatgatgcgcaatgtagtggagcagaaatgatgcttgctgcacatttagttgagcctaggagagcagggccctccatagacactagtttgaacattgctaggtttaaaatggtttaaatataagatggaaatctgcacactactagtgtttgtattcatattttttatttggaataacctgtctgtgtatctatgtatctagttgctttagtcttctcatagaattagtataacagttggttatgtataataattatggaaaagggttaatcaaattattacatttttacttgaagcctacatcacagcattacaatggaaagctagactgttactattttgttttcacaagtgtttggtgcatatttgattcatttcagtattgttagaaaattaaactggcattatttttctgatgatgtctcacattgtcgtcactatagaaatgaggctaataatgccagctcattcgaggaatatagcttcaggaatgaattgttttttttttttctttatattgaaatggtagttttttaatagagatactgaatggtgtatttcagatatctttaaaggaacacttaattcagaattgagtgcaaaaaagctgcagaagatcattcatccatgtagatacaattatattgtggtggataatggatttgtgttattcttaatgtctatacatggctacagtaagactgaagttgtttttataacttttcagtacattgaatgaaagaaagtatgacagcagaaaacatctgataaattaaatgtgacatgttttttattcatataaaatggtttctgagcagctggtaattgtgaatatttcagcagtcatttttgatgtggaatacttcttctgtggtaaacactaatgagttgtgagttgtacttcatcaaattgacagtttccttacttttgtaaataggcatttgatacaccttgtaaaagctggtaaaagacactcaactcaccttttaaatgcatagaattttccccttattctctttctacattgtgccatccacttttcctataaggaagataatgcaaagaaaggctaccattcactgggagcttaaaaaattcccagaatcattctgggtaccataatatacactatccattcataattcttacagctcaaattagctcaaaggaaaaactaagactgtacattggctgggagagtaaacgagtgcaccaagaaattacccgtactcaggttttgtaaagtgtcttaatgtgaaatagttgtgtttcttgttattttaaatactaggtatttttagagaatgagataccttacattcctccatcttaaaaaaaaaactttatttataataatcctgtaaaataggaatttgatgtactattctcattttataggtaagagaaattacatagagatgaatgttagtcacagagtgggaccatagtgcagactcctgttctttaatatattgtattgtttttacttagagaaataaattaattgtactagggacatgaaagaacatagaataagaattgtccgaagagaactaaagatgttaagattaattaatcaggaagtatattttaacaaatctaagaggataaaattagctgtggtactgcaattaaaaaaaaaaaaaaacctcttgaaacagattgagtattattaacaagattaacccaactcattctttggggagggaacattatatattaagagctctcttaaaacatgaataatgctacatattttgagtggaagtgtaacttagtgctcaactagcacagctgaattagtacagctgctgctagactttcaaatcaaacagccctctttggtcttttttataccttggtattgtatataatatttctgtgagtaaagagttctgatactaacacattgtctgacatagtcatccatattttaatgtaaattacactgataataatttagaataccactaatagacatgatagtgatagcatcttatgcttttacagaatattattattttccaaaagagttttattttgatggttctgccaatatgtcaaaatcagtaacctgcaatcccttcaaaaacaagtgtatagaaattttaaaaatataacaaacctattttataaaggcataaataagttcacaaaatataagaggtatcctcagaaaccaaatacgaacaagtcaccaaaagtcagggtggcgcagacatgatctgacgatggggttaactagagctaaggggattggggtcaatgttctcagtccagaggtttgtgatgtcccatttgtacacatgagcaaatttacatcttagttttttgcataaattggaaccaccaagagactgcatgtaacctagatgtactagaacaggggtccacaatgccctggccatgaaccagtaccagtttgtggcctgttgggaaccaggctgcacagtgggagatgagtaacaggcaaaccagtgaagcttcatctgtatttgcagccactcccaattcctcgcattaccacctgagctctgcctcctgtcagattaatggcaggattagattctcataggagcatgaatcctattgtaggttgtgcactccttatgaaaatctaatgcctgatgttctgtcattgtctcccagatgggaccatctagttgcaggaaaacaagctgtgggctcccactgattctacattatggtgaattgtagaactattttattatatattacaatgtaataataatagaaataaagtgtacaacacatgtaatgttcttgaattatcctgaaagcaccccaccccccagtttgtggaaaaatggtcttctgcaaaaccagtccctgttacaaaaaagcttagggactgctggactcgaaaacatttcccccgtaagcatagggatgtgacagaaaaatttgcagtaagctgaaatcgacctatgcctcttcctagttctgctcacaagacaacttagtacgaaatctagtgcttcctccatgagttgttctttcattttatgaggacagttatgtgatatggtttggctgtgtccccacccaaatctcatcttgaagtgtagcttctataatccccacatgtcatgggagggacccaatggaaggtaatttaatcatggggatgggtttttcccatgctgttcccgtgatagtgaataattctcatgagatctgatggttttataaaggacagttctcttgcacatgctctcttgcctgccatcatgcaggacagggctttgctcctcctttgcctttcaccgtgattgtgagacctccccagccatgtgaaactgtgtgtccattaaacctctttttctttattaaattacctagtctcaggtatttcttcatagcagtatgaaaatggactaatacatcaggtctttgctaggtcttgccttttctaaactaaacttaaaaaaagtagtaagaacacagtgtaagatctactcacttgatttttaagtgtaaaatacagtgttattaactgtgggtacagtgttgtacagcagatctctggaacttaatcatcttacataactgaaacaccatatccattgaactgcaactccccatttcccttcctgctaacccttggtaaccactattctactctttatttaaaagactttgactattttagatacttcatgtaagtggaaccatgcagtatctattcttctgttactgacttattttacttggcataatgtcctccaggttcatccatgtcatcacatttggcaggattcccctcctttttaaggctgaataaattccatcactattcaagtcactattttaagacgaaaaaatcaattgcttgtatataatacattttttaaattcattcatcagtgggtagttaaggtgtttccatatcttggctgttttaaatgatgctgcaatgtgcatgggagtgcagatatctcttctagaccctgatttcaaatctttcagatatatatccagaagtagaattgctgaattatattgtaattctatttttaagtcttttggaattgctatactgtttgtatacaggccacaccattttacattcctaccaatactgtataatggttccagtttttccataattttgcaagtatttgttgttatttttggtaataatagccattctaacaggtgtgagatgatatctcattgtggttttgatttacgtttccctaatgattagtggtatggagcatcttttcatatgcttgttgaccatttgtatgtcatctttggagaaatgtctattccagttcttcctgttttctaaccaggtgattttttttttttttttttgccattgatttgtaggagttttataattttggctattaactatttatcagataagtggtttgccaatgagagactaaatattaccattttatttaaatattatgtgcacagtcattagtattacaatattatattccccttgctcttaactgggtgaagcgtgcaggttaacatgtgaaattctgtgctcaaattctagttctttgaatctagtttccctgattttaaaattgagaggattgctacctgagacataaacaagattaggaagcatgtaaccccttagcccctgatacatagtaaatacttaacaatttccttcttaaaatgattatttttctataatgtatcggtatcgcatttatatatctacaattctgttataacataccatttgtttacaaactaatttaaattgcccttgaaaaagttaaccatatataaataagttaattcagaagaatgactgcttgttttatttaaaatttaaaacattcctaataatagaaatacatcattcttgaaaatatgcccatagaacccatagaagcttcttatgtaaggattttgtttgaaaatatcaatgtgaaccagctgtaaagataaccattgtacagatacatttcacccatctagaagtcactattcaagtcactattccaaagtaatcaatatctatcatttgagagttatggagaatttcccatatgtagaatgtaatagacaaaagtagctcatacctcataaaattgtgataaggaggatttaattaggttgcacatgataacctagtgtaactaacacagaggatagcccatagtaaagattagatgcattattatcatttgcattatgataaaataggcaagaaaaaatattgttaataagactggactgacaagataaatgaaatatgaacacacacatacactaaagttgatgaaattcatttatgggagaaccaaacctttacttagggaactgtaattcagaaaataaaaaggacaaaaagagcagaatctattaatgtcagtcaagttcacagcagcaaaaattgttaacaatgccttaacagtgagtgagggtacagagcatcgttcaatatatatatatatatataaaactcaaaaagtgtggtcctcccaaatcatttaatatgagaacagccaggcctacacacattaatcgtctgtgaaggcatcagcacagtccaccatagggccaaattgatgtctatggtttttattttctgggataacagaggaatatataatacactgaacagaaaatgaaaattgagcaaaccaaaagctttggtgcttgaagaagcgaatttctattatctagaaaaatcactgaagtaggtgtttctttccaaatgatgatggataagccaagcatttctataattgcatactgaacagataaatgtttgacctaggcttcatatgccaattactcctagatgtggtacagtgggatccagctagccaaggtaatgcagattaatatcatgtcacttctgcatgcctgggtaatatgttgtttcatcagatggtgctttaccttggcttcctttggtgtatgaacatattacagcagaagaaaatggtctgggtgggaaaatctgatgaagcaggtgatgtaaactgtctgtaatcactaaatataatgagtggacaagtagaactcctgttaggcctctagcttttcctactgtttggaacttgaatcaaaagtcataatagaattatgccaatctttcctatttttaaagtgcacagaaattctgcaaagtaatatgatacttagacactgaccatttggtaggcagcacagaagtaaagaagtcactcttcattcaaagtggatcacagcattaacagctgtgattcttgctattaaagaataatttttatcaaaggagtatattttaaagatttagttctataggttacttctctatgaaaatttaaagaaaatccttccacagagaggtatggaggatatttactgtcaataggtttatactattaatgagttatattcatagtggtatgaaatattagttatgtcagcttcttacaattcatgggacttttgcagaccttcagaaatgcagataagcattgctctgctcactttgaatatcggatacatcctccttgcactttgaaaagcaaatagaatacatacatttatcaatgctgacattgatacctttctacatagctcagcaaagaatcatccaaataatacaaaattgaaaaactggaaggctaaacaaaataagccgtcttatattttacagttgaaatacttagatgtaagtgaattaagtaattctacccctatataaagtgatattttttcctcctcttaattctttctttcaggaagaagcacagataaacagaaggctaacacaatatgatttatttatttatttatttattttatttcatttttttaagaaaaggtctcactctgccacccagactggagtacagtggtgcaatcatggctcactgcaacctcaacctccagggctgaaccattcctcctgcctcagcctcccaagtagctgggactatcagcatgagccaccacactgggctaatttttgttgtttttgtaaagatgaggtttaatcatgtttcccaggttggtcttgaactcctgagctcaagagtttttttgtttgtttgtttgtttttttttttaacaattgaaaacgaaacagaaataacttatataaaagtttaaagataactggatatgacctgcggtgatatatggcaattgttttactgattatgtttagaaaaatccccaacgtgttcaatttcatattaaaatgcctagtatttatggtttataattatcatttttagtgcaatcttgcgcaacaggaatttcattttttataaagttatttgtcacagtgggaggatttgttttctctttagtttatattttataacaattgcaacccatgatttcacagaggagactatgattaggtataatacagattaacctattaagaaatacttgtaaatcttacaattgatcaagattattttgttatgcaaaaaaatagaaaattttattattattgaaagtgctatcatcatacctttaaactttataattgtatgtatttttcctttattcaaggaagattatttaaagtagtgtaacatacctacatactttcaggagctgggcagcgacataagtgaataaatgagtctgttggggaaggtgtaggatgattgcattaacctgcttttagtttgacatagtaacacctacctcattatatttactttcttattctgggggtgtgtttgtttcgatttaatttaattttttgtaatttattgtgactaattgtggggtacagagttatgatatatgtatgcagtgtggaataattaaatcacactaacatatctatcatcttaaatattaattatttaatctctcaattgcaactttccaccctttgataacattatcccatcccaattcccatccccttaccaccaatctaccctctgctactatgagttcaacttttttagattcctcatatcagtgagatgagtggtatttgtctttatgtccttggcttatttcactcaacataatgtcttccaggttcattcatgttgttgcaaattatagaatttccttcttttttcaaggctgagtaatattacattgagcttacaaaccacattttctttatccattcatccactgatggacacaggttgatttcagatagtggcttttgtaaataatgctggagtgaacatgggagtagatatctttttaattcctcatgatatatacaccaaagtgggattgctggatcatatgataattctagtttcagtttttctttctttctctttttttttttttttaggaacttccatacagtttcccataatggccatactattttacactctcaccaacagtgtgcaagggttccctttctttacattgttacacatctgggagacaaacagaacatgtttatggggtgtagtgggcctcagaaagtcaccaactatagcctcctctattacgttactcagtaagatagatgctcccagggagatgttaggtcaatggtatctgccaacttttcattagaaagtattaccctcccctcacaaaggcagtttagaaatacttcatcatggaagtgaaataaaatgctgtcataatttctctactatgacatatctacctcagtctcttcctgttcaatccatatacacattacccttgccccagggttatctttagatacatgagtctttttatgtattctgtaagtagttaatggatttaattcaatgaaatgatatcaccttcaaaagaaaatctaaactcttagactattactaaagcagcctttgggaagaccctccagcatctccctctcattttcatttctccctgtctaccttccttcacgccctaatatatagaaacacatctcattcacttccccactaatgtaaattgagcaccacaaagaagtcaggcactatgctagatacaagtgttaaatatgagtgaacgagaaagacttcatcctactcttggggagcttcacagaggctagtggggttgacagatattaatcaaataattatgatgcatgccgtggaaaagtttaggtaccatggactgtgcatcagttttccaagttgctttttactattttactcatacctgccctttccatctgtgaaaccttcactcaaccctccaatcctcgttgatttacctccttgggacaattattataacttgtatgcatttctcttattcaaaattatcctaatgaaatgggttgcttggttgcttatatgttttcacatgagcaattgctctattttctcttcctttgcagatatagcccttggcgaggtgcctggctccatagtaagtgttcaacaaatgtttgaataaaatattgcattgttgaattttaaatgtatttaagcaaattgataaccaacatctgaccagatttcccaaatttagatgcaatgtcagatgcttcttttaatggtgtcagagattggctgacaggcttgcctgtctttaaagtaatttattacccatgttggttttttggtataaatggttactgtttgtcattggagtatgtttgtattcatggtagagattaaatacatatgtattgcatgaattaacaaatggttatgctagttgtaggaaagattgataagtgaaagtttctaatgctctttttttgagatggagtctcactctgtcacccaggctggagtgcagtggtgctatcttggccaattgcaaccttcgcctcctgggttcaagtgattcttgtgcctcagcctcccaagtagatagaagtacaggtgtgtgccaccatgtccagctaatttttgtagttttagtagagacagggtttcgccatgttggccaggctggtctcaaactcctaatttcaggtgatctgcccatcttagcctcccaaagtctaatgttctttacaggcctatgagtattttatgccagaatattgattttattggagaactaaaaattgatacaatccatagcttgaaagtaaaaatgtcaaaatacttaagaccatacacaaataagtattctaaaataaggaattgatatttataaaatatttttaagaaataaggacatttggccaggcacggtggttcacacctgtaatctcagcactttggaaggctgaggcaggtgcatcataaggtcaggagttcaagacctgcccggccaatgtggtgaaacctcgtccctactaaaaatacaaaaaaacttagccaggcttggtaacaggtgcctgtaaacccagctacctgggaggctgaggcaggagaatcacttgaacctgggaggcagaggttgcagtgagctgagatcatgccactgcactccagcctgggtgacagagcaatttaaaaaaaaagaaataaacacatttaccattacagtattttttagccccccaatcttgttattattaataacaataataaaataataagcccttgacttctttactttgctgtccttttcatttattttgcatttcttcattttccttgtgcagattttatactctgctatcctcagccaccctatccgtatcatttctatggtatctctgacctcaactatgtttagatttctccgtcttcccctaattactggcatcttccttttttatgtgcttctgctttctctgattttgggcattagatccttcctaatctgccctctctaaggttaatatcctgttcttcttggttagttaggatctcttcccatttagttttaatctaatatatccttcttctcgtctctcaaactagttttgcccattgcttcaccttggttctaatccagggaaggacataagtccctaatgtctattttctgagcagacaaaataaaatatgcataaactgtatctgaacattttagtcctctaattatttgtgctgtttcactgcaactgaaatgaaaaactccagcctctgcacaggattagcatcagcagctttgcctcttaggctctattaaaagaaaatctgtagacaaattaaattcagcaaagcttgctatttgagtaaagaacaattcatgagttgggcagcacactgagcctgtagaggttcagagagctctccccagtagtagatagtatttatagacagaaagggaattgatgaaaaaaacccagcttgataggttaaagtttagcatttgctttttttgggcatggtgggacaagacatttgccttatatggacctaacctgatcagttggcagcctgtgatggctggagtttggctgctgtgattggctgagacttagctatttgttggaggaatatactattaagttagattacagtttatttgcatactaagtaaggttgcaatttgctacatatataggcagctttaagacaaatttaatttaacagctctattgccaaaatcacttctgaggaagtaactcactatttggtatctttgcaccaggctatactgtcaaaaggtatggattttcagagacagagtttgctgactgagtaatgactgagctgaaagttggcttgcatgcactttttctgtattttctacttacattgttgcatttcacttaccttgcaagagctcactgcatgtcccactgacattcattcctcccaggctattttgcacccccattcccatcagcatcactttacaaagtgggttattttacccagccagttgtccatttaatgtacagaagggtctgtataaagggtctgatcaaatcattgcacaatgcccaggcaattacaccaccaggaacaattactgctttatcgaccgtaaacatttttctgaagttaaaaataacaagaaaaccatattccagcagtttctcaaaaggtattcaatttaaaaatttaatccaatactacaaatatttatttagaaccaacttttacaagttctgagcctataatagaaaattgtgagggaaaaggattatggtgtatgtatgttcgggtggtgtatgtgtgtaaattatcataagatgcatggaaagttttgacatttctgggccagggttagggttaggtgagttaaccataggttaactatgattaactaacctgtgattaactcacctatggttagagttgccctcaattgtaggctaagttattcaggcaaccctgaaacaggctgggtagggaagagaagcctaacaccactggtttagatttgctgcttaaggcttgggacaagtgtgcctgagatcaacctatggatagtccgaggtccagggaacagccattcagaggcaatttttcttggctttccctggatttaccttcctatttaagttttatcatatgtccagaccacacttagaactagaaccaacatttaaaacccagtttatttggctaggattccaggtactctatttaacacttaccacccatccctctccagggctaggtctacaaattagatgattcattcagaaaaatgctattgcacctttcttatctttataacagcaacttgtattgtgaattttcatgagtacttcacgtagattatacccagttctcacaggaacattaggtattacagtttaagaaactgaacaaggggaagagctgaaatccaaacacacatcagtctttgactaaattttggttatcataagttcctgagaactactgctgtcccctgcctaccacactggacatctttggttagtaggtcatccttatgcagttacttgagcttcaaattctggagtctgccttgatattttctctccccccacctacccttatattcagtcattatcagtcattgttcttaattgcaatcaacagatgcaaacacttaagtatcaaatgtgttcattataatatgcttattagaatacagaattgacaagagttctgggaagccaagtttgaggctacatcttcaagagatatgcttagaagcatatcacaaggctggccttatatgaacatgagcctagtaactaccatgcaatgagatggaggaatcacccatcaccttaatgaggttaggcctgagccaagaacttgaccttgcatcattttggtcatcattgtctctgctgctgtcaccaagtatatccagacaccactgcacaactcccaatcccccagcaaaaatataaacaacttcttcccattactcccatttgaatacaagtgtctcttgatttttgcatttgatttctggagcctaggtcatatgtctgtatcacaacagcaaaggaatctgcttatttcaagttgagcttctgaactggaaaggtagaattcacagtttgaaaatatattcaggtaccaaatggcttttcgtaagacactgggcagccccatgtatgaccaatatccaccacagttggctaggcctatagctttattcccccacataccctgacactcccaatatcttctgcagtcaaccagttcacagggatctaaaatgcacatcaggctccaaatgtgaatgcttataacagtttgctatactgcaaaactgcagaaatagttgctgttgagtgctgtttttcaagtgtttttgtaaaatgaagaatttttttaaatatttgcctatgaatttagtttgctttatttttcttgttttataatgttcatttgaaatctgtattgtccctggtcgagacagtactacactggtctgcttgtgggttccagaatgaaataaataagtctgtaagaaaataagcaactaagtaaattagtaagtaaaaacaagccatgcatgtattacctcagaaccagggcactagtaaacttcacaaagccacgttaatcagagtgctacaccatttacagtgacaagaggccccttctcattattattgggacaatactgccaaataagcaaaacacaaataaaactgtccagtggaaattggctaagagtaattaggggcaagtagttttatgtagactaaaatactataattagaagggaggatttggagcactatttgaaggagagaaatcaatagaagagttgctttctatgctccgaagagctttgccagctatctttgttcagtggtaaaatagaattattttacagtaggaaataaacctgggcactaaggatctctgttggggagatacctgggactgccttggataaggagggggtgagcggattgtggcatgacattgtttttcataacatgttaatagcaaaacaaaataccaaaaataataatgatgaataatttattcctgtttgttctcggttaactcttctttagaactttaaatatcaatatcgaacagtgttacattaaagtaaaatgtttatttataacagacaaaaccagttctatactaaataataacttaatgtcatcttgaatctgattaagtagttattttgttaagaatgttctaaactgatcaataagaggaaaactttaagtattctcatatattacttttctgaaactgtcatgatattaatattatgtacttatagttgtggtttgttcctcaaactattacttaatgtgatttattttaaatgtgaattttgcctttagacattcattttaaaaaatagcctattctttattatttttacttagaatttacagaatcctgtggtacagagggacttttccagctcccaggggtgcataaatttcctttttctgtattactggctagttgatgattgacttgcctctgaattatccctaccatgtggccaactagatacccttcaatatggcccattttatctttggacagttctgatagtctcccatattgttaattcgattttttttctcttggcagcttcattttatttgtccttgttaggtctcttaagactaccttgttttttatttttatttgttttgcaaggatggggtgcacaatcagtggtacagtatggttgttccataactttattaaaaggcatataaagtacttgatgctacagagtatctagaaatatgcgttgtgcttattcatttgtgacaataggtattttggcatttttaatacattcattacatttgcaatttaagaagcaaatgaattaagttcatgatgactgaatgggatgggagttagagtttgtaaggtgacctggagaggttaatttcacagcgtgcagtaattgtgaatttttagatggaaatatatgtgtgtaaacctgaatcttaccccacattggagacgaagctgcagagaaagttgttcttttgaccttaaagcaagttaaatttggagagctgcccaattaagaaatttttatccacaatatatttttaatttaattcttactttgtggggatattaaagactttttttcccctccaatttgctatttcagtgctagtaatataaatccattgctaaatccagaggaaaagatttcccatgctttggattttacccggttagttctccagttatactcttaagtaatttagaacctctgaaaaaactgaggttaataaggaataagaaattaataatggaaactaataaacaagagatatggaaattaaaaatactcaaaagaaacaaatccttgaaaatcccaacatacagggttcaaataaaattaggatatttgaagggccatttaggatatttgttatgcttttgtaatattcctgagagtgtataccacttttgttcctattttacaaatgaggaaactgaatgtcagacaacttaataactttcccaaagccacacaactaacaggaggtcaagactgaatagtcagactaaatctggaattaggccgtttttagaaactattaatgaaatggaaggggaactgagatccatcaaatgcaaaaatgaaaactatatcataagtaatctgctggcatttgatgcttatttatttctcattacaatcctgtgggttagctattgttatcttcctttttcacataatgaaacacacgtttggaaaggttaaactatttccccatgttggccatggggaactgatagtcagtagacctagcatttgaacattgagctctggactgcaaatcttatgtcgtttttttactctgcaaaaaattgtaaactctttttagtaagaaaatactgtatttgaataatctatttcatagaaacccaagttaggtaaggtgccaattgccgcgacccctgttggaccacccctagacgtttccaggacacctgcggacttgaaagtgcccatgctaccatgctgcctaaagtcattctagttttttgaaactataattacaaataatttcccagatacaatcatattaacatatacatacacagtccctcccatgttactgtcattgattcaacatatgtttattgagcaccctctatgtcccggactgtttcgaggtgctggggaatataaagatcaaattctggcccttcatagaacttgcatggtttttactcccatcgtttagcccactccagtgagtcattcactgtactgtcttggtgatatctgtaaactttccatctcctactagcttttaagcccccgtggtacagaaagtgttttattcatttttgtgtctcccacagatcacctgccacagcaatattcccagtgcatctcttcttttacactattttcaatcacaagactataacatgcagcttcgtaaaattcatcccttcacctaaatagattccagctgtgacaatgtttataatttccctgtagcttgaaattttcatcaaatttctacttttagatatgcaaatttacgattaatcaatgagtcactgagaaagtatgaatcattttttgttcacagcacgtcaagatatgttacaaggtgcaagacttaacattaactgcctttctaacttatgaaaaaaacattttaaccacctaaaaagggtgttttggtgagcatttgttagaggactgggagttgtttctctgagcagggttaatagagctgagtaattttttacttataaagtcctctaaaaatataaatatttttgtctttatttgatagtgtcataaatgtctttgttcctctttgaaagccattatataacaaaaggatcattttgagtaagagatttttgactttaaagcatatagttatttgttattggatatcccaggatatcttttgaaagtctggagttgttgtcaatgactcacagtgacaaagtgcttttgtgtgtctttatttgcatgcctgagggaatcactatttttaaaaaatagattttttttttttcacacagccctttaaaagaaagtgtattgtggctactgaagaaattcccagagcaatgttaagaattacaatttgcataataataatttttcctttgcctcaactcagtgaaagccaccctgattaaaaacagtttgctggaagttgctagttactagaaggcacttgaactaaatgtatttggcaaatttgtaacccaattctgggatgcaactctttttttccctaaggcccatctcagcataattctcccttaaagtaaaatataaaatcaactctagacagctcttaggagtttttactggatgcttttggtgtgtgatgggattgggattagacaccatacaccacaaagtaaaacttctgaagaaattctcttccagctttatctggagtcagatccttcaagacaactctccacagctctatttccctgatttctcctcagtcactttttgaaaattctagctgtagcttcaggactttctcattccaagttggcccccttctcctacattctgaattattctttttctatggcatgtgattcattcttatataatttaagttaacctcttaagacttctagtgtttctctacattaaatatctaagtcaatacaacggaatcctgggagccaagctgagcaaaggaagagtcctccttagaagacaggggtagctaaaagcttatgtctatttatactttgggatttttatgtttattacactgagagcttaaggtttcagttttcttttggttaatggttctttagaaaagccgcacaattaggacctcacaaaatagctctacctgggtaaatgtaccaccttcctgcgagaaaccctcagctttgtaatgaatcctgcatttttgtcagcataccaagagtgcttctatctcatgcgcatcacaaatatacaaccaggatgtaaaatcacagtaataatttactttggaaattatgacttttgagaggacaagactctgtgtttgatatgtctacttcatttcctccatgaagaagacgtaaggagagagccaaattttactctaggaaagttatttgatatatctagaatcataccaaggggtcttaaaagttcattcttccattgtttctatcactgcaaattcagtacttaatctgagacaaggactctgccgggaactaggactataatgatgaatatgtcacatcagctgccccatatcgcatagtttagtggcagaaacagtattaaattaagaactcaaactaattcagaaggaagaacagtgttcagtaagagtggataacttgtggctttccaaatatatgggttaggaaaagcttttccaaggaagtggaaagtgagtttgtatgtagtttgtatgtaggaatggagacaacatagctcatgcatagatcatgggattgatcttatgtaccagcataagagtttaaaattttgtttttgagcaaaaggaatttatctttttctaagaggaccaatatggtcaaatttgtattttaaaatggtaagtatgcgatataaagagaatgtggtagagggtgaaggagattcagtaccattaggagatgatagcaggaagtgcagatagcatgggatggtcactaggcttatgaggatggaagtggaaagtgagaaatctagatggatttcttcatttatgtgcagtcaaatcaagagcacttagtatctgattagaagttggaggtgaagaggtagtgataaaggtgactctgaggtttttggcattaacagctaggtgaatggtggtatgaaatatagaatgatatggtttggatttgtgtccctgcccaaattgcatgttgaattggaggaggggcctaatgggaggtgattggatcatgggggtggatttccctgcctgctgttctcatgatagtgagtgagttcttgggagatctgatggtttaaaagtgtgtggcacttccccccttcactctgtctctctcctgccaccttgtgaagaaggtgcttccttccctttcatcttctgccataactgtaagtttcctgaggtctcccagtcatgcttcctgttaagtctgtgtaaatgtgagtcaattaaacctcttttcttcataaattacccagtcttgggtggttctttatagcaatgtgagaactgactaatacataggtaataaccaggtttgaaggtaggatattaaattcagttttgtatcagttgcaattgatttaggctgcataaacttaaaacagtaatagttgttgaaaccatacaaactccccttctttcacatatcaagaagatcaagagggtagttccaagacgatacactggttcaggcccttttattccatgcctattgcctcattgctacattgctacaaaatggctacaacagacatcatgttatcattaaaggcagaaggatggaacaggaaagtattaacatgctctcctcttgttcttatcccttttataataagcaaattttttacctccaagactccagaagattcatttataggtctacccagccatggcctctctaaactgcaaaggatgtggactgtttagaaaaggggaaagagatcatcacaattagcttagaacagttgttctcaactctattagacaccaactcttttgattagtaatctgaaatgaaatttacagatgtaatttacctacacacataacctaacaagaaaaaatgttatgctctctttgtcataacacagtaaaataaaagaatatgtaaacatttgggccagattcaaattgaggtaattggattcttgcaaatatatatatagaataatagagtaaatagtgtttgcagcaatatatggaatcacaacaaacacagcagcagtgatgcagactgatatatttttgctgtaagggcgtcacaaacataatgagtccagttactgttgctttctctaaaatactggacaactcttggtaacattccgattaagacaatgtataatgtttcctgattaatattttacttgcaatcctgctgcacattggaaagtggtaggaaatgcagaacaattatttgataacacacttatgtcccttcacattgtaggatgacacttcttagacctcgctaacaaatgccagtaatatccccaatcattgtgacaagcaaatttccaggaaaaaaaggtataatttacatactatacatcagaatagaaatgtaagatcaactgaaagcaaagaaagattgatttccttgattttgagtggcatctcatgcattcccacttactgcctatagctgttacagacattcattacaaagttaaattaaaggttactctgtaataatttctcattatatgccaagccctaaaagaatctaatgaattctgtctaggataacactaattgtaaggttaaagtttcctggggaaatcttgcctggtaccttaggcactggggaaatgtatgctagtgatttcaaagtgaattaagaaacaagtttttaatccgtcttttcaagaattttaatgaaatacctagtttgtatctttagaattctagaaaagtacctcatcattttagactgtttccttttaaatcattggcatctataggctaccatcctcttgaactagatagattttaacctttttccttattcattctaatttagcttgtcgtatatatataaatatatatatttatatatttatatatattttgatagtggctatttgctcattaaaaatcaaaagttaaaagtaattaatctcaaaaaatggttaactggcttacctgagaaaaaataaatttagttggtaaaggctgatttaattaaagtttatatgttttacatttcctttgctccatgatggaaataagtatttttctttatgatgtggttcgccatctacatgaacattttaataagagaaagcaaaataattttgaagaatacattagtatttgtaggagccattcatactgctttctgcatttaaggtaaattagaattattcactaagtcaaataatgtcaagtagaaaacagaaatagatgttgatgaatgaattaaatatgattaggcatattttattcattgtttttttcattttgaactttttaatgaagtcattgaaataccaagtcatggtcataaaatttcttaattcctcttaaaaaattaatttaataataaacagtcatttaattagtttataaagcaaaattgaaacactttgagtataggacttaatagtggaatttagagagttccccagaactcttcttagcttttaggctcttagaagataaaattgtgtgtctgtgtgtgtgcacatgcaataaaacaataaaatggcctactaggaatacatgaaacgatgttgtttattgttgtgatgtttcagataagggaatataaagtaagattgattagtaaaagatgaaagaagagattagtgaatgatggattagtaaatgatgagcgtggttttgagcaggggcttgaagaaatgatgggtatgtgaagcctagaatactgatatgaaattacatgctgagaagaatatggagaaaataaggcactcctgaagtgcatatgtgagaagaatggcttaactgcactggtgaaactgtgttaatgaggaattgaaaattgcttagttagaaatagaaatgttgagagaatgaagaggttgttgatttaatgtcttagatgtggataacaaaaatgaaagactcttgcagagattctttaggccctagcattataagaactatatgtgaggtagtatttgtagtagcttattggagaagtgcagagttggaaggatccagaacatatgtaaaattgctgagtactttacgcattaggtgatgaagaactagatgattaaattgatggcaaatacttaaatataaatatgtatacataaatatagaaatatatttatgaacctggtaatgacaaattgaaaagtatacacacatgcaccacaaagtatttaaccatatgaatccattttactaaaattgaattaaagaaaatattatttctccccattatttcacagtatgtaaccctaattttattttctttgggaacagggtgggggtttggagggactttgaactataggtatttaaattattttgagagcttttttttttttaaagaacaaacaaaaattttcattattgaatgctattatcttttaggtttctactgaattagcataaaccacttttgttaagttaaccatctatccttgtgaagtgactagaatgaagggttaatgatatacttgcagggtcaaagataaatttgttgtaagaaagtaagacaatattctgtttataatatatttgtatatatagatttaatatttaaaccattaatatccttagctatcttcagtaatgctttctttcacttttaaaaaagaagtattttagtcatgtctaataatcatatctgtacatgttctttgtctaatcactttgaaaatacctatttaactaaaatcactgtagaataaaacaaagatcagactttcctcgtttgtatataataaattaatgcttttaaaatctgaattaactcctgcagtaacaaggcatgctctgagaggaaaatgaaaagtccttaattctaaatttaataatttgcaaatataatctctactaaacaattttgcatgtatacctactagacctgccctgtgttattcaatagccactagccacacatggctttttatatttaaattaatgaaaatgaaatacaattaaaaatatcatgttttttttttttttcttttaactttttttcttttgagacagaatctcactctgttgcccaggctggagtgcagtggtgtaatcttggctcactacaaatctcatgcctcagcctcccaagtagctagaactacaggcatgcaccagcacgcctggctaatttttgtatttttagtaaagatggggttttgccatgttgcccaggctggtcttgaattcatggccttaagtcatccgcccacattggccttccaaagtgctgggattacaggcatgagccaccatacctggccatgcgttcatttcttgctgtggagcacaaagtgttacttgagtatcctttgaactttttagagattactttttgcagctaatgctagaattttgaaaccccagacctttgtcaaccatcaagaaatatagttgatgctaagtaagcacttgtgctggacaataaatgtgaacattttgtattaacccaataaatgttgtcttgaatcttacaagagatgtatccacttacaaacttcttacttataaatgacattgaagtgtttaagaactttacttctagtgagaaagacactgaaaagttcaagaaagttctaatgtgttattcattccaatgaatatcgaagattaatgaataaggcaattaagtaagcattccttcttaatcttgactacaggtaagacaagaggaagcagggggcacaaggatactgtagaaaaggaaattttacttagatatgaagaaatgtttcctggtgtggaaaggaattgcacattggaaggatttattgagtgaggttgtaggatttggggaaatccttaaaaatagaatacatttcaatctctctagggaggtatgtgatatgcctgcaggcattgagtgtggggatgaattagattcattgtcatggttttctcacaccaacaattctatgaatctatagaggacaataaaattggataattctcactgtgttcttcagggagtcaggtttccagactgatttttctagcagtgaatcaggcccaaaatattaccttacattcaacaacttttcaaatgcagtaaagaaaaaaaaaaaaaaagaaaaataagaaatgccagcactttgccattttaagaatcagtgtttcttgagatggattagtatttcctcttctttagtaagaatgaaatgatttgggtctgagtgtaagcactactattggaaggaaaatcttaaattcctattatatagctgagtttaagggaaaatgaatttagtgtgatttgaaaatacatatgaaataatgaattttgcctttaatctgaacagtaaaattagtttcacatgtgataagctctagttgccattttgagaatgttccattagaattacacaagtttggtgtttcagcctcctggaatttgttccagcactccaatattcaagcccttggctgtgctggaaatgaggcagcaggcactcaggtcagagctgcaggcaaccagggatttgggaagtggcccaaatgcactcactggagaggcattggaagaaattgtacagagaagaaactgggacaacagacctgagcatgctgctgtggaggatggggtggctacatcagagttgcagtgaatctagtcacatattatttacatcaaagaagaaatcctaagccataattcatctgaaaagccaatggctgaagtttttgtttttaatctagtgatgtaattcttcgccaggtttaaaatggaaagcagaagcaggtcaagctgagtcatacacacaaggccaaatgtggggaaagcaggaatcaaaggctggaggtaggggaaattctaaatctgcagagcaccatctttgagaaaaagaaaaagaataaaaacctatactggaaggagaacaatcacgaagagaactggtgggtgaagaagttgagataaattgtgcaagccttcactagagataatgtccttttgataggccggttggtgtagtagaagaagcccctgttttagagtgagaagtttattttcacatgctggctgtgagactttgagcaaaatactgaatctctgctccttcatctgtaaaattcccataataattcttattttccaggttgctgtatttcaaaactgagcagccactgtacctgatatgcagtagaaaattaataactagtagtcactgttattttgttgacttttcagtgggtagtggagtgttcttagcatttattcattcttcattcattcagtaaacatttattaaatatacacagaataccagagagtactagaaacagaccacaatcaggagtagttcattagttcttaaattgccttaccatggttaaactatctttagaatatggatcactagcagcagagtatcagcattatactagcaatagagagggaggcaccaagattgaagtgaattgaagagaggaattgcatctgagttgggcaatttttcttatgggatcataggggtttcagatatctcagcatctgatgtgtccctctagagcaggggtcctcaacctctgggctgcagacccatatcagttcctggcctgttaggaactgggtggcacagcaggaggcaagcgagcattacccactgagctctgcctcgtgtgagatcagtggcattagattctcacagaagcgtgaaccctgttgtgaactgcacatgcgagggatccaggttgcacactccttatgagaatctaactaatgcctgattagttaatgatcatctgaggtgaaacacttttatcccaaaaatcatctccccaacccctagtccatagaaaaattgtctttcaggaaaccagtccctggtgtaaaaaatttggagaccactgctctggagggatttctttatctttgggaacagcaccttggctagtcccacaggatttgagaatatattgaaggctttcttatttaaaaaaattataatttgagtagaaaaatagaagaaccacaatgtgtggtttagactaagggatttatgattgggattaaaccttatacaattgcaggacacagtggggaaataagtgtctgaaagggggagattgaaggatcagaaacacacacacacacatacacacatgaacttaaggatcatgaagaggaacttatgaagaattatggaaagctgtcaccacgcttttggtgatgggcatgaagttattgtaggtgctctgggcagctggatataagacaaggcaaagacaaacttggacccatgaggacaaactgggactgatgagcacaaacaagaaaccttgagaaaatactcaaagcccctacaacaaactggaagccatgtctgtgtctcatttcttctaatcgcagtgatgttggccacctgcagaaaaatctggtctcttcatcagggatctgcataggcacatgacccaggactcagaaacagaagggagatggggaaaaggggagtttggattaactaccagtttggctgctttgtcacaccaatgaggtaaaccttcagatgagtgacaatgtgagtgatgtgcgatgggtaatgccttatctctgccttccataaacagtgcatatttctttatgatcaacaacctaataccacacaggaaagggagttctggagaatttgcctaatttactttttagcttagctatgttgacactgcaaaatcactcccaagaagagagaagagatttgatattattcttataagggagcattggcctttgatctaactctttctgctttggcaattctcagagaggtatgaggaggggttgggaagcgtaaaaacggatgaataaggaaggcatcccaggatcatgctggggacattttccagctgatcacctctattctgttgcttcatctccctgaaccctgcaattttgattacagtttctttagaggatgaatacacaccccgctgctgctgaagaatcatagcatagcaagtcaccaatactggtgtaaaagcagtcattcccttaggtgtatctatgtgcaataaagctgagaaccactgatttatatactgtagtagcttttgtatgtttgtttttaccaatgtattcttgactccttaaagacaggcatgcctacctattgttctacaactcaagttacctatagtcttgttatgcagtatctctcagtttgcaaacttaggtatccccaagggccagacataaaccacaaatgttagaccaaaaaagatggtgggattgaggattacatctggagcatgcattgcctaacctaatgccattcaaatgagagaagagaggcatcaaccatcgcttctgacaaaatgagggaggctgccattttcatataaatagctcgcttttcttactagtaatataagattcacttggtataattctattaaggaatcaattataaattatactgtgaccggcaaatggtgttcataaacaatgcagatatttatctgctttgacaataaccctctgatagaaactaaaaacattttaatatttcaatgaagtagcaaatgacctactaaaaatgttctttattgaaatttattggcataagttggaagaaagaaaagaggtatattagcttattcttattcttagcttattctttcacctaaaattataaaatataaaaagtttaataacatgaaaagtatgaccatgatttaatataaaacatctactgctatgattgaattactgaaagagaaaataatactgaattatgtgtgtaaaagttgtgtatattatgataaaaactcatgattcattaacactaagttataaatcatcacatagcattttttaaaattttacaaacagtactgtttaggagagtatattctacactagtttttcagttcaacatcttttcataattgttcagcttaagcttttcaattgttgctaatgtgttacatcacaaaattagttgaacacattttaagagaaaggaatatatgatttagaaaagtttaccttcaatgaggtatagaagtttagagatagttattttcagcttcaaataaatagttttgaatttttttttacttgctaaacatcccttccatgcattttgttgcataaatatcctatgggaatgatagacgctattaaatagtcaacaaagcaagaatgacaactggtacatggttggttctttgaactgtttattaaatgagcaaatcaatgaatgaataataaatgaaaaattttcactcttggactatttacctggttttcttaatagtaaattactagtcagttatgtaaaataaataggtgtttgggcactcttgggcatacatgtatgatacattttatattttctagaaggttccaccagtcttctcttacatattgaagacacaaatatttcactcatatattcacccagtatctttctcatttccagctaaacatgtttttccttttcaaattgtgttaatgacctataagtgagtcctcatctataggatgaaccaaatttacagtgttgcaaaactaatgttggccataaaaatcaatacattgactacaatctataaactatttataaaagaattgatgttcgtaattataactcaatttatataataaaaggataaaaatgaacaactaaaaggaaattactggcagcactgccactgatatctagcactaccactgatagtgtctagaaaattgaagcaaatgtattttatgaaagcagtgagttacttagaatggaagaagaataaagttttaaggtttggtgaatctatgtgctaactcaatactgatatcatattaatcaaggttcttggatacagacaacagaaggcagttatgggttttactcagaaaatgaattttttagaaggaaatggttagtacatagaattgaaggaaatgctggaagattggcagaaaccacagaattagaaatggttaagaacctaaagcatctacttagccaaattgtgctcttggaatagtagctaggaggtccctgctgctggtactagaccacacactgaccgcatggacacgttggcattggctgccactcatagatgcttcactgtagcttctgttgtaatcagttctgaactgttcttaattctttgtatcacttgctctagattcatggtcccagatgatatcatccagttgtttaactgggtcacatgtttatgctctgttgtctggtgccagagagagagagagcaattaactgtaattttcagattctgctgtggaagggaggaccctacctctaataaaaacatgtaagaagatgatctcccaaaattggaagggaatatgtatgcatcaaaatgactaatgagcactaacgccattaaaacgttgtatgacctaagagggcaaattattcaacctttctagatatcagtttttaaatgtgcaaaacaaagattgagaaatggataagatctacctctaaaataactaatttgcagtttagttagaaagataatataagcactctgtaaacaacagctacaactaccaaagatctgcagtagtgggagtgaaaatgaaatatcagagatggaaaaggatgtttaaaaggtggctggaggccgagtgcggtggccacgcctatgatcccagccctttgggaggctgaggagggcagatcatgaggtcaggggatcgagaccatcctggccaacatggtcaaacctcgtctctgctaaaaatacaaaatttagttggatgtggtggcttgtgcaggtaatcccagctacttgggaggctgaggcaagagaatcgcttgaacccaaggagttgagccaagatcacaccactgcactccagcctggaggcagagtgagatttttgtctcaaaaaaaaaaaaaaaaaaaaaaaaaaaagggtatcctgggagtttgtcagtctgcatctgtacaacatgtgctgttcacacaatatacaaacacatgataacagctggatactattcctgtcaaatcagattttcacaacagtggcaaaggattaagatgattggagaatagtaggaaatagcctctatatgacctaacatactaatatcttaggttatttaagacagatgagaggacaaactgtaccgtggtgttcggggaaaaaaaacactccgtagaaattctcttgaaaacaaagccacctacatactacatagcaattttagagaaatatgtctcattttcattttcttttttcttttgttttcttttttcttttttttttttttgagatggaatctcactctgtcacccaggctggagtgcagtggcacaatctccgctcactgcaacctctgcctcccaggctcaagcgattctcctgcctcagcctcccgagtaactgggatgctgggattacaagtgcctgccatcctgcccaactaatttttgtatttttttttttttttttttttttttttttttttttttttttttttttttttagtagaggcagggtttcaccatgctggctaggctggtttcaaactcttgacctcaagtgatctgcctgccttagcctcccaaagtgctagaattaacaggcatgagccactagcgcagcctcattttcttataataccattatatgttgtttgataatttttcatatctttcaataaggtttatatctgtcaggaaaaatcactattttttcaggtgcctcacaaaattcaaaggctaggaaaagcatagaccttttctataatttttgagaatatattgatttctgtgaattgtgtcacaagacatagcaatctctcccatacttttcttccattaagaaataacacttttatagtatctttcatcccagaccacttgagtgttattagaatttcaccctgtccttttgctttatctcattattataggtaagatatcctagcaaataagtaatattaaaaggcctcaaatcacagtggactggaattttaaaaagctatatcccattgatttaaagtttagaaaaatgattccagatctatgctgtcacttattctctgagcttaaaaaaagtcaccttttccttcctttttaaattttctcatgtggtaatgagggaatgtcttaaatggttctaagatcactctgatttctaaaactatgtgattctatcataccactgtacttcaacaagtctccaactcgtgatacacgcagaagtttcattgagttgatgtttcttgatgtatttcactcttctgctgagaatttgtaactgaaaaacgaaataagtcaaatatataagaaacataaaaagtacatgtatctatttagatatgtgcaagcgctattctctccctctttctcaaagagaaagaagtctagatacagaaagatgtgtatattacaaacgtagtttaaaattttacatataatttatttgtagggatacttagttatgtgataatgtactattataattttgatgcacaaaattatatctaaaatgcttagacatatgttttggaatttataattagaaaaataatatagtgcatataccatgttttacgcaacactcccagtagcatttggtcagtgtattagtctgctttcaggctgctgataaagatatacctgagactggccaatttacaaaagaaagaggtttaatggactcacagttccacgtagctggggaggcctcacaatcatggtggaaggtgaaaggcacgtctcacgtggcagcagacaagataagagaacttgtgcagggaaatttactcccccttataaagccatcagatcttctgagacttattcattatcatgagaatagcatgggaaagacccaccaccatgattcagttatctcccaccaggtccctcccacaacatgtgggaattatgggagctacaattcaagatgagatatgggtggggacacaaccaaaccatatcagtcagcaacccataatcaaagaaattaacagttatacactgaaataaacttagtattcataaataaacaaaactacaataattccccatcaacttcatggcaagtttgtctggcacgttagtttagatcaggtcaagtttttccatcgcatgaattaggaaacaaagcttttaactttaaaaaggttttaggcttgagctatatgcataagggattttgaacctatgaatacatgatttgtctgaccagaaactagtcttttgggaaagagtttttgagcttgcttctgttctagacatgtattttgtactgaagtttatcgctgtcctcaggccacaccctcccctggacacagtggagagcagccctgattatttactgagcagtgctcacactgtcctcttgaaatccaataaattcttgacaagaaaactggcatcaaacttaacaattacagtggaaaaaactagtatttatttatttatttatttatttatttatttaacttgataaaggtcaaaagaaagagatatagacaagcctctgcaggaaactgtggtaattttctgtcaataaatacctcagactgaaagtcttggttctgcagattgtttctcctctctgactgtgaattctctcttcaacccagttaagttgtttcctacttctgagctgaatttaaaggagacatgaaggacattcaaagagcttcaggggggtaggttgtggaagacattactaggaggatttcttccccctttaatcattggctttacttttcattgaaacatgttacttttaaacttaaaaacaacccagcattttaatgctgcaaatgaactagctgaattacttattctgaaagaataaggaaaataaatgatactagtgaataaagaatacctagctctcacagaatgctttagtttaagtagttataggaaagtgctctccaattgcagtatattagcctatagcaaaccattaaaaattcttacgaatttttttcttcccaaagaaaactatttaggcatcaaatcagttaatataatgaattaaaacagaacatcactttggtggcacagtttcaaaacagacggattagagacattcagatactgaacatgcaacaccagctatgatttcagcagggagtcttatttggcctttgttcatcttaattccatcaatttcaaatgttattaacaacaatgggacacaattccaacagtgatgctttacacagccacgtaaattttgaataattttagtccttgcaccattttgtttctaagggcaggtatacaatttttgttctaggatgtattaaaataaccagtatttcttccagtgagcattgaagaattaagctgtaaaagacaataaatatttagttttagtgtttacaggggaactactactacttacctgatttaacttagttatgagtaaaaatttggataggaagactaagatgagcatcctaacctactgaacctgctgctaaagtaacaggattgtcaagaataagaagttattaattttaacgtaaatgaaaagtagttttagagtagttagaacatgggaaattttacatacaaccacacacacacacacacacacatatacacaaccatacacacataaagtgttttgtgcttgggtgtaaactaatcatgagtctgttaaacggggaaccatatgatatgttcagtaaaattagtatgttagaatggtaagagtcagaaacaggaacaaagaaaaggaaaatacgagagcagcagaaaaaggcagtgtgcagcaagtgaatggcaatgtaaaatctgcagtaaagctaggtggaagtgtttagaatctgagtaattacacaaactacagatgtttaggtggtcagaaatattttcaggtcgtataaatgtgcaagtttgtagaagcctggaaacagaatgagggtatttcaatttattcactttgtggaagcaggaggtgagggtcactatgtgggcagtatatatagctgccttagattgtcagaggttgcaaaattgcattgttccagaaaagtgagacaaagacagtttcattaataagattattatgataataataatgttacccataataatttttacccatctctgggtaaaaatcctcaaagagtggtagtgctgaaattaaagaactgagcaaacacagcctggcctatgatgtgagcgagagtaagaattaattgtgctacttccttatccttataaccccatcctcttgctcctcctcacggaagccccaatgacaacccctgtagaagcagattcattacatccacattcactcagtatttactctgtcaagacctgagctaagcacattcatatatttaatattatctgaggaaattaatttgtgataacaggcattgctattattttacttttcactatgaaacagatatacagcaatatccgaggaagattttaaaagatttttagtataacgtatttcgtgatgcacggtgacattctgcgtctctcactctttctccgtcacaaaaaaagccacaacaaaaaactacttggaacttacttcctccttgtatttctgcattgaattccttatgattgtgagagtaacatcatagataaaatgaaataatgtttaacctatggagcacaagtttattaaaaatagggaataaatttatgattatcacacacacacacacacacacacacacacacacagaaagagagagagagagaagggggcaggaaaattttacgtattacttaactgagtagactgaatacaaaattcaaagttcctaagggggctgctttgtgaaatactgtgctgtgatatacacatcattagagatgagaaaactttagattcatcaacaatttagagaactatttctaaagataaatcctttgaagataatgtctttatgaacaggtttcttgggaaaaaaataaagttgtcaaatgccagtgtagcttttattatacatatatagagagacagcactgatgatttcaggaaataacacaaacacacatgcagtcagtgagaattctgtcttgtggaagatgatattgatgctgtgtgcagcccgctaataaaacactcagttgtgattagcagaagagctgaccagagtataaagtttcttacatgaatttttgtaaaaaactaaaaacaaaacaaaacaaaaaatgctttagagtgcttggcaacaaatgaagtcattcatataaaaaccatactaggggcttcaaaatgtaaagaaagagggataaatgttagagaggtggtacttcttggctgctaatggagaaagtctagtatgactttacaagtcaataacagcaaataaaaattactgggctaattttagtgaacatctgtgactggagtccactattttggcagaaaaaagggcaggtatttgccttctgagaactctggcacgtgagcggcacacattcacctacattcagccaatcaaaagcgttctcctagcattgctttagtctgaatgtatcataaagcaacaagaatagttcaaaatctattctgcatgtggtagcagcagcagtagcctgcatacagtaatagaggtgggaacaatggggccagtagcaatttaaaaactgtctgctcaggaggccaaggttggaggatcacttgaggctgggagtttgataccagccctcacagcatagggataccttgtctcttaaaaaataaaaataaaataagctagtcaggtgtgctggcatgagattgtagtcccaggaggatgactgggagaaccacttgagttgatgagttccagccaacaaagtcagaccttgtctctaaaaaataaataaatagtagtaatattcctttgggtatatacccagttatgggattgctgagttaaatggtaattctgattttaggtctttgaggaatcaccacactgcttttcacaaggattgaactaatttacactcccaccaacagtgtgtaagtgttccctttttctccacaaccatgccagcatctgtttttttttttttttttttttttttttttactttttaataatatccattctgattattgtgagatggtatctcattgtggttttgatttgtatttccgtactgatcagttatattgagctttttttcatatgcttgttagccttatgtgtgtcttcttttcagaagtatctgttcatgtcctttgcccactttttaatggggttatttttttttcttatgaatttaagtttcttatagatgatggatattagacctttgtcagaggcatagtttgcaaaaatgtcctcccattctgtaggttgtctgtttactctgttgatagtttattttactgtgccaagctctttagtcaatttttgcttttgttaaaattgctttcggcatcttcatcatgaaatctttgcttgttcctatgtccagaatggtgttacctaggtcatcattgagggtttttatagtttcaggttttacatttaaatctccaatccaccttgagttgatttttgtttatgatatatggaaggagtccagtttcaattttctgcacatggctagtgagttatctcagcatcatttagtgaacagggaattatttccctattgcttgtttttgtcagctttgttgaagagcagatagttctaagtgtgtggcctcatcttcgggtctctattctgttccattggtcaatgtgtctgtttttgtacaaatactatgctgcttcggttattgtgtcccttcaatatagtttgacgtcaggtagcgtgatgcctccgggtttgtcctttttgcataggattgccttggcaattcaggctcttttatggattcatattaattttaaaatactgtttctctagttctgtgaagaatgtcattggtagtttgataggaataatattgaatctttgggtggtatggccatttttatgatactgattcttcctatccatgagcgtggaatgcttttccatttgtttgtttcatctctgatttcttcaagctgtgttttgtatttctccttttagggatctttcacctcctagttagctgtatcctagctgttttattctttttgtggtaattttgaatgggattgtgtttgtgatttggatatgagcttggttgttgttagtctataggaatgctagtaatttttgtacactcattttgtatcctgaaactttgttgaagttgtttatcagctgaaggagcttttgtgctgagactatagggttttctagatataggaacatgtcatctgcaaagagtgatggtttgacttcctcttttcctatttggatgctctttatttcttcttttgcctgattactctggtcaggacttccaatactatcatgaataggagtgatgacaaagggcatccttgtcttgtgctggttttcaaagggaatgcttccagcttttccccatttggtatgatattgtctgtgagtttgtcataggtacctcttattattttgaaatatgttccatcaataactattttactgatcattctaccttaaacacatatcaatgttcattgcagcactatttacaatagcaaagacatggaatcagcctaattctcaccaacgacagattggataaagaatatgtggtacatatacacaatggaatactatgcagccataaaaataaatgagatcatgtcttttgtgggaacatggatggagctggaggcaaactaatgcaggaacagaaaaccaagtattgcatgttctcactcataagtgggacctaatgataagaactcatgcacacaaaaagggaaacaacacccactatggcctacttgagggtggagggtgcaaggagggataggatcggaaaaagtaactgttgggtactaagcttagtatctgagggacaaaataatctgtacaacaaacctccttgacatgagtttacctgtataacaaacctacacatgtactcctgaacctaaaagacaaaatttaattaattaatgaaaatgaaaatgaaaataaatagaacactaaaaacacagtcagtggaatcattttgcttgtggttctaaccaaccaacttcctttgatttctgaacattttcaagcctgaatcacctttattctcattgattccttttttgaaaatttttacatttttaatttttgcaggtacatagtaggtgtatatatttaggggatacataagatattttgatacagacacataatgtgtaataatcacagcagagtaaatggggcagccatcacctcaagcatttatgctttctttatgttctgtgaaccacacatcacttatatatttaggttattttctgctcaagatattcagagtcattttctattatttgccattcagtatcttgactgcaacccacaaacaatacccaatactgtggtggatacaaactgtcctagtttccagtatgagccaagtccctaaagaaccatatgattctttattattctgagcttcttaaagtttagagttatcacttaccataatttttgctttttacagtctgagagcacattctgatgtttaataaatacatcttgaatgaaagaataaagtaggtattttatacctaatttaatagaagttttattctcacagagttaaagaacaaaagctattttatggaacacgctaatcccactatcaggaacctataggaagaattatttgatcccatttgtaagaattgaacacatgaatgttaatggtacaaaagtggtacgcaaattcatgcttttttgaggactgtcctttctaatgattttgattccttttgctaatattataataagtaataataagcattcaacttatttgccaaagtagatataaatactttattagaatatgtcatccaacgaagattttgaaatatgtaagagtgaaatgagaagtccttggccaaaataaatcgactagtctttataaattctcaatctaccagagccttggctgattgagaaacacaactgccattgtaaaaatctccaaaaaagactgtgatttccattttctttccttgcaaactggtggactcaaataagcagaatagaatgaagcaaggtaacattttccgaaagtgaaaagcttctagagttatttgaagaataagtaagtctgtttacaagaaaaatgtaccatacataatgtgtttgctttaaaaagccctttgtaaaggtgacacaccaaagaccatttaaaatctaagtcattgtaagatagcttatgttgtcatgaatagaaaattgacttatactcaaggaacaagggcaggcacttctttgaaagaaaaaatttgaactaaggctcagtacttggaatagttttattttacatttttacaaaacatctgacagtgcttgaccagtaaaatttgtaatttagcagataatactaaggatttccaggtatgtcagaaatatttcaagtggatctgagtgaagaaataaaattgtatagaagttttattgtcagcaaatacaagataatgctttagaagaaggttatatgtatgagcccagaaaggttaccacttacctgcctgtagcagaggcaattactagcaccagaaagaatgggtaagagaaagacagaaatctgtgttatgggaggctagcaagtataaggcatgacatctcccattgaggaagcagggtacttggcaagttgtcaaaactgagcctcaaattactggaataaaagaaatttgattactagatggaacagggattagaagagtagtcaaatcagaggagaaataggccaagtcaaagcaggactccctgcagattctcttgaccctgatgttcatgagtttcttaatttcttctacattgagggtattttcctgtctttctgattaaagttcatattagtttctgaccttgggggtcagctggattctgcagttccacatcattcactccggcaaaggagagaacttgtaacaaagatgagtgccaagtttagtcaatttaccctacctggaatactatatacaactctgggtctcatgtgtgttaaaatacatacagtgaagctgaggaagagccactgaagtaaaaagtattgtttacaagttggaaaggatgtaaaaataatctaaagtatactaagtcaggaataaaaggcagagttaataaaattgtggctggtactgatagactaaacagatatattttctaaatcctggaataattattaaaaaattttacatgtatcaatggattccagactccatattttaagtatcacaactagtgtaatttaaaagtatagtttattgaaggtctggagtctgaataaagtaccccaagtgagtcttgtgagaaggtaagtttggaacacactgacttacaaattttgtgcttaatttatggattttgtggccctcaaaatatcatgtgggctaaacaaaagaatcttgaagaatttaaaataaatcatgtccaaaatgagttgtcaagagaaactgaatatattcttttggtaacagccttaacattttgaggagatatcatcaaaggttaactgttttttttttttttttttttttttcttaaactgatcccatgagatcagttttcttttagatgataccactttcatagcctgaggcaattaaaaatgtatgcttatttgttctctagtaggtagaaagttaagtccttaggaataggttgtgctttagtgttcttgaacatgtgagagtgtccttttctatactaatatttcccaaagaagactcagtattttatccacccactctgctcaaatacaccccatgcatcttaggaactaggaaaatagagtgattttcatgtaaaccattgaaaattcagaatgaatacctccaaacaaatgtcagaattacacatccataaaaccagtgttcactgaccttaggcttagcttagagttctgcaaagttttcaagatacaaataaattataattatcaatattaatagagttgtcaatgttcaccatcatgaagaagtaaataatagattgtgagaatgatatgtgaaattttcctatgatttatttaaagaatttaacaaagcaatgagattactggctagcgctcttgaagtcatgtttaatatagttgcctctttctagaacacatgctcttcaatgtttccttggatagataaactacgttttattctttgattttccttaaacaactacaatcaaaaacagatatccacttaattgttttaccttcaaggtaacatttatgcttatatccgtttatgccttcttaattctctgcaaactataacacattttaatgtgtgccaataaagttataaggtcagccatttggagctatctctggtgctttgaactcacagtatcgaagtaagattgggcatggcttgctatatttaatcttttcaatatatatagcttttgagttagacaaactcttatttccaaagataaatgtgcatttgagagtttaattatgtatttcttaacatttcatgtattttaggcatatatgaataatacatttcatgtattttaggcatatatgaataaataatatatgtacatttaaagttcaatttcatagaaactagtatacccctgaaaacaatagatgtgtctaggagacagaagaattgtcctttgtaaaatttcgctacagttgcagcaaagttatttgttgataaatgagagaaacagactactcataaactatggcctttgtaatactgaacagagtctagaattatgataatcatatggtttccgcgagatctagctgatatgcctttttgagatgataacttctgtccttgagacacttcactttttttttcacttatctccagcattgaataaagcccctcttttccctgttttgagtttgttatcatatgtgtcacatgattactatcatagtttactgcttcacaagaattcatacagttttcctatattttgggtgcttaccacatcccagaccaggtgttctagttccgtatttctatattttctcctttacagtgaaccatacttggctttcaagttccattttgctcttggaacctgcctgttctcagtccctgctttgcttttggttgctgccacctgtttctcagatgcagctccatgttcgacagcctgtggatatatcccaactacttccttatttagatcaggcttcagcctaggagaaggaaatttagatttgagcagaacatttaaataaagttcaaattgtctccaagggttataattataaagaaatcttactgtaggaggcattgggaagatacaattttagtaatcttccaatggattggttcatcttaattatttaattgtatttctatcaataatagcagtggcaagaaaagtaataaaattaggcctagatcgtttttcacaggtttaaatgcagtggtttatgttcccttgactgattgtacaacttcagtcacatatggtgaggtcaatatttattaaactatgcatccaagtgtttgtgagtaaaaatgtagtactttctagcattcatattactatgatagtatgcttggagatatttttgatatcagctttgataataaattttatctggaataaacctagcgaaactttttaaatccctaaagatgatagcatataaaacaacaaataatatttaaactgcactctcatttccactaatagggtggaccaagtttcttgactgcttcttccactaaaaaacaaacaaacaaacaaaaaacaaaaacaaaaacaaaaaactaaaagaagagataaaatgtaaaagcatccaaacatatagaagtgcaaacaagagaataatcatctaggccaaaatataaatgcgggcaggaattgagtgagaaaaaattgcttttatcctaaggacatatgccaaatctggaaacatcttagctttggtttctctcaagctcaaaaaaaaaaaagaaaaaaactgtactcctttaagatctataaaaatatgctgttttaatactgtttcattaaacatcataatagttagactattatgatgactaacctgatttcacagatgtttggctattgtgttttatcacccatcaggtgataagaaactttaatggtggtagactatatgcttctcaaaattgtgtgtgtgtgtgtgtgtgtgtgtggtgtacacattttcttaaactgtagaaagagcatgcgttttggtttcagacctgtgttggaattctgactttccttcatttgatgtgatgcagattatttaattcctccgaagacttggtttattcatctgcaaaatggggagaaagatacctatgtcccaggttccctcactcctcacatccaatccattattgaggcctgtcatttcttctttgaaaaaatatataataggcataatatttctgagatgtaagccaaccaatgtattttctttcttggaaatttctggtccctagttgtctcatcagtctatatcaagagccacccctggtagaccttcattggagagttagttttatattatggagaggatactgtttccacctgagtttactaggtcatgaggctcctggcctataagaataatggccaaatgatgtaagataaattcagattcgatggaaagagaaacgggaaagcttactctttctggtcctttagaatgtaggaaaaaaagaagcaagtagttaaccacatgtctgttcctgtttgaaatcgtagaagtggagaacgaaaaggagcagatgcttgtgtctcttcttattgaaaggctacttaaaataggccagcatcagtggtgggggtccagtaagagttaaaaagtgtttcagaaaatgtttaagcaccgaaaggatttaaattagtcatcacaggtgtccttaacagatgcagaagtttctacctgccttgtggtgggcagcatgatctatgcattgagaagtaggttacctgcagcaagggctccgtaactgagaatgagtgtcttcccccacagaatctgaggtctggcagctcagacagaagctgggtggagggtgtgattgtgttcagaaggtccaccagtgcaccaagagtcaagatgagaccaagtcagcaaaaagaggaccccaaacatttatcatacaagagaacaaaatttcatcaagtacaatcccagtaagagaagccagggaaactctcagtgaccaggtagtaaagggaaattctccaaagggaagagatgaccccaacgacagccacgaccctgtttccaacctcactaaggacatttaagcctgcttgttctccacagaagtcacatgctcctatattaaattctacgattttaaagttttaatatttatatttagatctttaagactctgtgaattgtgtatgtgtgtatatctgtatgaaatgtagtcaggatctgattttaccatttcccatgtggataacttgttccagcattccttcttatctcagagaaaaaggggtccttcttaacactaactcttccacctgttctttcagtttctccatctttccacctttcaaaatcctactccattacttaacctatttcatttctcatcttaatttctttttttctaccattttcatattttctgtttacaaatgggcttatgttccctctatttccttcaacccacatttatacatcagttaaggccactatttttaatttctatcaagttctttgaaatgataacaaatgtttggtgtgcatgctcttaaccttctcccaatcatactcagactgcagtatttacctataacctagttactaagtcagttaacctgtttttgtccctcatcaaatgtattatttttgctgcatctaatatggcctgtttacttcttgatagtgttctcacttttagttctgtgacattatttttctttggttttctttccatctacctggtcactgtttctgtggcatttttccttgttgttcctttctctcagtataatgaatctgtccatagggaaaaatagaaataatctttgaaacattaaagttctgttgataatataaattttattgatgattggaaatatagcctatctctaatatagttatttgatccctccaagttataaataaattatataatcaaattaatatcataaaaatttatttggttttctattgcagatgttttctttctccttttatttcctctatgattgagaaaatcatacttaacattgtcaaaaaatgaacacatgctagttaaaatacatttgggatggaagttaaatatgtgttatttatcagcatcaagccagcattagaattaaaaaaaaaaaaaaaactgcagtgaggttctttttattaaaatgtaaccaaaataactcctttgaaatagttatctttaagattgtcactggttattttttatggtttaacactctcaaataaatgttcatcttgcaaaaatctgcatgtaatacatactgatgcataaagaaaatgcatcaactaagcagattgttctgtgatgacttggattatcaaacatttgcaagttaaattcaatattactgtataaatttgaagaattaactaaaattaacataatttatttattctgttagtgaataaccaaaattttaaagttcctcaagctattttaaatgcttattaggataattataattattcatttctatttaaaaattaaatgatgttagccctacagtgtttggtgaatataaaaatatatatcattgaattataaatcattttgtctccagctgccaacttgaaatgccaggcatttcacttatcttcatatttcatataatgttgaactatttatggtccctgtgctgccatatgtaaaagagcaatattcattaactcttcatgcttcatgaagcaaaaagggttatttcatttgtgagcttctttcgtaataaagactcgtcaaattttctacgttatttatctttgccaccttacgtgattgtaggcatccagaattttcccactgagagtgtttattaatttgttttcttcatagtaataaaccataagcccagtgagggtaggcaacaggttaatcttatagtcattatattctcagtgtttaacaaattgcctgattgagatgaataagtgcatttattttcaagcattttgtttttatttttgatatagttattcactaaaacgatccactcacatcacttattcatgcctgatgttgtcaaaacaatattaaaatatatcgcttcatgtcagagaccttcagtattatatctgaagacacaggttaatacatgtggatcactttcagtgtaaaacattgtcctattaatactacttgaatatcaaagagtacaaatcaaataggtattcagaaaagagggtcttttatggggaatcagactcctggaagtgacagttgagtaaagcttacaaaaagaaatatttgcaacaaataagaggaaactttcctttccacataaatggagcaagacattgagggcttgagaaaggaaagatcataaactattggagggtataggaggctccagagcttattaaaaaagaaaagagtatgtttggaaattttgtgttattttatctagatataaaggattctgaaaggcagtgaaagtactttttactccagagagttaaaaaaaatatgggtctaatgaatgactgtgaagaaaagattgcacccagtgatgtgttgagggaggttgaaggtagattgaaaagtagataaactgaagtggagtgtagaattgagtcagtgaagatctgggttaaggttgggacaacagctgtgaaaggaagaaaaaagaggatggggtgattgatttgagacagttacattaaaaaaaaaaaaaaagtggccaaactgaaacaaaggtgtcaagtctggataaataaatgagcaaaggtgttataccaagattgaagaattgagagatgtgggtaagtttctgatgtatgaaatttgagatgatagccagccagatacttatatgaaaatatctaaaaggataaagaaacaacttaaactatgttatgcaaaataatttccatgtcccacttaccatatcaaatgcatatacatgttcacacagttttcgcctctttaattgcctactttttccaggaaattttctttacttattctcatttttacaaaatattttataatgcctttgtatcaagaagagtaagatattacacaatcactttaaacataaaattacctatttgaaaaagatataaagtttcctttcctttaaaatggggataacacttgccctacccagctcacagggttgttgaaaggatcagaagaaatgatgggtatgaaagcactttgaaaacgaaaatcctttacaaatgcaagctatcatcattatgattatactgtctcctccatatgaacctgaagcaatttcaatttccatttatcacgttactcccctaattcctgtagagcatgtcccacaagatttttatcatgtgactctattttaatcaacgacaaatgcattttcatgaaagcataatattatttctattatagatattctttgaactctggataaagaataatacacatttcaaggaccattatacttctgagagttttttcctatctctttcatttcatagcttcctttctcccatattacatgggtgcaatgaaattttcattgagtgaagtaccttataaaaacttgactgtatgtcccatcctcctttcccctgattttatctttttcttactctgtgaattcaaattctctgataagcaccatccttcgctctgtggattgacaccagtccgtcctaggtaccaaattaaacactgaagatgttttaaggagatgatagcaatatcatgctcattatgtagtggagcttaaaattagagcttggtaccaaccacatccaaaagttgacatgttaaagagagttctagttatttttaaggctacctatgcctctactccattccttctccaattaatactaccccaattcttgcaacatttgttttgtgccctgggcataataatggcaataagataaagagaacctattggtacacataggttgtacgaggacctaaatattcttccacccccacaaagtccaggaaagtaaagcaaaagttaatcctttagtcagcttttctagatgtgcagtatattttcaagcattttgcgtgtatatgagtaatcagatgatccatttacatatcttaaaattgttattttggaaaaaatagcaaatctgttacaaactaaactacttttacattccaaacttgttaaagaaaaaaaatgctgattataatattaaatggaggaagttaaattcaatcaatttctaagagctatataaattagttttagagcaacccaaatttcagttatataacattatttttcaaaagaagttcttaaaaaccatctaattatataagacaaaagattagaatagaaatgaaccttaaatatgatacttacttcatctaatgtgtgagggatagttttagaacaaaagggacaaggatgagtacaccttatccatctactctcagtggttagttctgaagggcttcttcctagcttcctgtcttgggtgtaaaagccacattgctgtagaccattgaacaatgtctgtcttcattctgttactcctttcctggaatcttccacatgccttctcctcaagattgactctctttgtctcagaacttgattgaacagttcataggtttacgaattacctttgccactgtatggctttcctagctgcacctgacagggctagctagcctttgatgttatgcacaattcaggcatctcacagaccacacttagtaaactgatctgtggctggcccttaacttggccattcaccttcatcatctaagatagttgccaaggttcaccatgcttcatctccaggatggcatggtaaggaactgattttaggaccaagtagccactccctcctttctgtatcattctactgcctgtcaaggtggctttattatatttcaccctgacaactttcactctgtctctctcctctcttggcatttatgcaaagcagtgtaagcattcacttgggaaagagaggcatcttggcaaagctgggtcttttctgatacttgaattagatcaccaggtcactgcagagttatagaggaaatagactacatttaagaattttctataattgccagaagtccaaacctgtaattactattgccactctgggagcttcaagtgaagcctctgtagttagcctttgcccttatccatcctgactttcctaccatattttgctactttctcctttgttagaatttatattagaaatagatattttaaaattcagctcaaagtttttagactagtacaaagaatattgtttaatttacttgttacataacatgtatcaacaagcagaggggaaatttaattggtggtaatataattgttaattttaacaaaaattgggaacgtttgactttgaaattttcagtttttgagctcataatagaagacccatgaccactttgtaacttatcatttcaatatagttccattgggtagtagtacctttattctgttttgaagataaggacactgaagggcattacagatgaggatactggaggttcaagagttcacagattttcctggttcagcaactgagagctttcagacccaagtgctatatattggttaccacactggcctgcctcttcctcacttaaattcatccattgactacatatcatcttcaggataaactaccaaggaatgttgcaaggcctttcataatatcactctttcctacctcctctgtcctgttcttgctagttcacttcctatacttcagcattctaaacctcacggagagcccttcctctgaaaatgttgcctgtccttttcacctcaataactgacacctatttgttgggcccaatcctctggggaagccagtgtcatcagagttggcttcagatggtgtcttgtgaaatctcttttagccgttagtgctgttaaattattggttcccttagataaggcttgtgagggtagagagtgtctccttcacttttgtttcctcttttccattgtctataaaataaatataataatagctaccttgtagatttattggaaggattagaggtaatgtatgtaagtaacgtaactagcagtgccagggacatggtaataaaaccaacaataactcatatttattaaaatcattttctgtgtgccaggtactatatggtaggcacttaacatgtattatctgtaatccgtatgtaatgattactgaatggcctgaactcaccgccaaaaagcacttttactttttttcttcaagcatgttatcaaatcttctcatcttgtggtttgattcaacttaggcagagaccatagcttttctgattttgtcataaacacaatgtaatttcaataattaaaacttatttttatttattaaaatttccaggctgtacttaattcaggtaaacttcaaaatcactcctctccccttaattcagtcctgactcctgcctccagctctgcattgcagagtttgttgactgtattttttaagtatctctcagtaatcagtgcctctgtcaatggcagggattgactgccatgtagaatatatgtgtaaactattcagagaaccactctctcccctacaccacactatttgggatcccatctttctgacaaaggacatattcgctttagctaccactcagctccagctctcagcagcaattccagaatctccttctgcagttcccttacttatttgggaaggtggttcttttctttctttctttctttttttttttttttgattgtaagatagctacattttatttttaaaatttattattatacttcaagttttagggtacatgtgcacaatgtgcaggttagttacatatgtatacatgtgccatgctggtgcactgcacccactaactcgtcatctagcattaggtatatctcccaatgctatccctccccctacaccacgccacaccagtccccagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatccttttttatggctgcatagtattccatgctgtatatgtgccacattttcttaatccagtctatcattgttggacatttgggttggttccaagtctttgctattgtgattagtgccgcaataaacatatgtgtgcatgtgtctttatagcagcatgatttatagtcctttgggtatatacgcagtaatgggatggctgggtcaaatggtatttgtagttctagatccctgaggaatcgccacactgacttccacaatggttgaacagtttatagtcccaccaacagtgtaaaagtgtttctatttctccacatcctctccagcacctgttgtttcctgactttttaatgactgccatttaattggtgtgagatgatatctcattgtagttttgatttgcatttctctgatggccagtgatggtgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgtgaagattttctcccattttgtgggttgcctgttcactctgatggtagtttcttttgctgtgcagaagctctttagtttaattagatcccatttgtcaattttggcttttgttgccattgcttttggtgttttagacatgaagtccttgctcatgcctatgtcctgaatggtgttgcctaggttttcttctagggtttttatggttttaggtctaacatgtaagtctttaatccatcttgaattgatttttgtataagatgtaatgaagggatccagtttcagctttctatatgtggctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtatcagtaccatgctgttttggttactgtagccttgtagtatagtttgaagtcaggtagcatgatgcttccagctgtgttcttttggcttaggattgacttggcaatgcgggctcttttttggttccacatgaactttaaagtagttttttccaattctgtgaagaaagtcattggtagcttgatggatatggcattaaatctataaattaccttgggcagtatggccactttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcacgatttggctctctgtttgtgtgttactggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctcatttattgacagttttttgcatgaagggctgttgaattttgtcaaaggccttttctgcatcaattgagataatcatggtttttgtctttggttctgtttatatgctggattacatttattgatttgcatatattgaaccagccttgcatccctgggatgaagcccacttgatcatggtggataagctttttgatgtgctgctggattcagtttgccagtattttattgaggatttttgcatcaatgttcatcaaggatattggtccaaaattctcttttttggttgtgtctctgcctgactttggtatcaggatgatgctggcctcataaaatgagttagggaggattccctctttttctattgattggaatagtttcagaaggaatggtaccaattcctccttgtacctctggtggaattcggctgtgaatccatctggtcctggactcttttttgttggtaaggtattgattattgccacaatttcagagcctgttattggtctattcagagattcaacttcttcctggtttagtcttgggagactgtatgtgtcgaggaatttatccatttcttctagattttctagtttatttgtgtagaggtgtttgtagtaatctctgatggtagtttctatttctgtgggatcagtggtgatatcccctttatcattttttactggaaggtggttcttttcactgggatctcataaagctagcaaattactttctgtgggatgactgagcccatggaaacgcaggcattcttgtcatgtctaataatgggatgtagttcctcccagtccactgtctcctctccttgttttctgctgttatagactgcatcagccaacattatgcattctgaattctccaggagggactgaagcagtcatctcaatgttcacacgttcctccaaactttaggggccacatgtcagtttgtttcagaatcttctcatcccagggttatgtggagatttggctgcacatctctgcagctcagcaagcctgaggtgagaattgagacactgctttctttgccttgcaaaatgcaccactcacttaacatatgggagcacttgtgaaaagaagacaagtcagaagcccttctcttcccttggataacatctcattgcgtggacgactctttctctctcaaaatactccataattctgcatttgagaggccagaggtggtaggttggtagccggtttggctgcttattaggaagccctaggaaaggtgcctagtgagtgctctttagaatcccttctgttaactattctcaatatttagggtttagctgaaatgtttgaaacaaagaaaagtcctatttcacatcttgtacttttaaagcactcatttacatctaaagaaatgtgactgtagaagttaggttatattccctaaggccacaaaatttacttattaaaagtcaaaatctgatttgtctgtaggttattctcaccccaaacctccttttcagttcattgtactatttacctccaaatatgattgttcaattataagtggttactgtagggcatgtgtaagttgagataaacagcaacagaactcttcagtatttatttagatacagcataaaattgggttttgatattgtaggcatattaaggctagccagcttaattggctcctgcatttgtgctaacaactattagtctttaccccccagtaagtgaagaaaatacttgatatagctaaagtagtacctagctcattctgagacttcagtaaatattggttaaatgagagactgcaggaattcaaagtgagctgatgctgccactcccaacaaacagtgacttctgctgagttttttctgatacttttactgtgaaggtctcacttttgttcatgcatctgtcatcaacccttatattcaaggaaatgtctccagaatttttattggatgactgcattttccttacatgcaagtaaaagaaataccaggctttgaaagcgggctgattgagtgagagttgaacatttaatcagcaagaacgcacttaaaagtgccaagttgtagcaaaatctagggaattttaactttacatatgaaatccttttctgctccactatagcctcaactttctttcagtttttaaatttagaacattctggtaaatggccactgcagaagagtttaatatggtacaataataattcttatttttctcttactgctcaaaggaaaaaaaatctggataaatcccagggacctttaaggagttttagaaactgtcctcttcattaggttaatccactaaagatcaattagttaaaatgctatttgaaatatttagttcttttcttagagataaagtattcatttgtaaattgaatctattgaagatatttccatataaaataaagagtgaaaaacaaaaaaaaaaattgaatcacagctgctttatgtggactgatagataccttagtgcatttgcagcacaaatccaacatttaaaatatttaaaaatacatctctgtatgtggaattttagaaagtattaagctatagtgagagaaagctgatcagcctgaaggagttggggaggggcttgactgtaaagagacatcaggaaacattttcaggagttagaaatgctgtctatctcgactgtgatagtggttacaggaatatttcctagttgcccaaatttacccaatggtatacttacacaatgggtgaatcttttgtatgtacattaaagctggcgggtggggagaagaggaaaaaaaatcttattgaatttgggctattttacttgtaatatcttttatcctgataaaacagatagtactgtggtagacaaagtgttttatcatctacatagaataataaaatctcaaatttcaaatgttattcattcactgttagtcaattggcattaaagtgttgctttctgtgtttcaggaacagtgcaatttgtgaggtacagaaagccaaataaaacagtctttgcctaaaggaagtgtaattcattatccattgctatgtaacaaattaccgcaaagtttaatggcttaaaacaccacacatttctcatctcagttatcatctgtgagtcaggtgtccaggtgttgcttagttggtatctctgtctctactttggggtatctcacaagactgcaatcaagaagtcactcaggcctgggatctcatctgaaagctagactggtaaaggatccgctcccacgctcacttacatagtcgttggcagaattcagtacttcaagtgctgttggactgagggcctcagtttcttactggctgttgaccagaagctgccctcagttccttgacaggtgaccctctccatgtgactccttcatcaaagagtgcaggctgaaaaggcaatagatggtcagttaggaaagggaagtcacaattttttataacccagtcacagaagtacatcccttcaatgacgctatgtactgttgcttagaaggaagctacccaagaaaagggaattaacaaggacatcaatatcaggaggaggagaccactggcggtcattctaaaggctacttaccactagaagcctagttgattcaacttactatccaggattaatacatcaagaagtcatccagcaagtgctttaatcttttctgctacacagaatagtgtataagagtggtggctttataatcagacttctcttgcttaagttgtcgctaacccttattagccatatatctgggaatttattaaaccttctaagcatcagtttctcaccataaaatggtgtatacctcataaagtgtgaaaattaaacacaataatgaatatatagttctgagtatggcacctggcaaatagtaagcatgcaaataatgataattattttttattatatatctacttactttattcctcacttgaaatccagctctctgaattttcctgttgttgaaattagtttaccaacttggaacttattaatcaccatatccactttaaaatcctcaccctgcctttaatttacatctgaagacagtgtatttgttgccttcattttctccctacttgtgcacactccagtcttccactgtttctacagatgttccttatgtaacatgatttcaagtgtcgttcacttccttctgaccacatttgttgcattataacataatgaatctgtaagtcatcacatacaactaaataaattccaggtgtagcttgttccatgcaaaaggaatcaagattattactagtgatgtaaataacctatatgtattgaacaattttaagtagtttttaactagtacaatgatattcatgaatctttttcttgaaaatgatagtagtttacaaatgatctaaggagcagcaaatattattaaacactttgcgtacttccatccagatttatcaaaattgttatgaagctgaaagcatagtgcaagaatacagtttggtgcctcatggttctttttatgtactttgtttaatataaggtgatttagcaataatatgattaggatgcttactgtaaaaactccttatctctattattgcttaggcacatagtttttttatagttgtaagacatgaaatatttatctatatgctataatgaactatttactggatataccatatatatgatgcttattcactggtgataaacccatgattgtttttaaatatagattttcatgattagattaataatggaattcacactctttgatagttcaccattatatgcaaaggttttttacaaaaatgatagaagttccaaatattttttcccaagttcacaattcttacaagctcacataaaaataggaagtgtggtttttctcaggggtggcattttctcattattctccttagaaaacataataaagtgaagttcatttactcatttatttttggctttaatattaaacacaaaatatatttttattggaaaggtcaacattgtttatttctgcttgttaaagtatacatgttcctggtaaaacatttaggaacaacaaaaacacaaagaagaaaataaatattaccataactcatagacaattgctgacccatttaatgcatattttagacaattatcataagatcactttttttctgttggaatattagtattttattaaatgattttttaaaagtccttgtatacatatatacatacatgtagtgaagatttaggcttaaagcattttttatttctgtctttgttgtcactgttaggatgctttatttctgttgcaaccacattgtgtcctcttattattccatttctaataaaaaatatagaataacaatattaaaacataaatttttccttgtatgttgtttgtgaatttttgagtgaagttgttttcaataactcagaattttgagttgaaaatacgtgaggatttctgtgatcaaatatttgttatctttttgtaaagagtgctgatttgattagttctaaaaatcatcagtgtaatctgtaaatgatgtaatccgccatcagcacttgcacttttcttcagattattatagaaattcaaatcaataacattttgttgttttctattaaataacatttggcacattacgtatgttcatatggttaccaatattccttaaaaatagcaaggttttaacatgttcatgatatccttaggtagagtctaataacagagaacatttgtgtgaggataactattttaaaatatactctcttttttgaaatagattgtgaaataatctttggtaaaatctctatctttgttaaaaattcccagaatgagaaatgtgaatgtaaaatacttagaaaacttcctttcctagggatgtaaatttcactattataatctttatttataagtcactcgttaaaatggtcttgcttctaggataagaatgcagttcttcatagaataatatctaatttgaagttttgctaatagttttggaagtgaatgtatttttttaaagttttaaatacattcattttagcatattgctttgactatatggactaatttatcaattaaaatatttctattttcatttgatagtaatttttttcaaaaacttatattgtttataaactcagcaagtcttcagaaacatgtttgagtttgttgtatgcatccagattaggtcctagatcaggatgcttttgaattaacttgaaataagaataatatctatggtctatttttatttgaaagttttaccttcccatgatgggctcattttgttaaggatttctttaaaaatttgtggcatatatttgaaatgaagctgcctaaaagataatttatatagttcttaaaagatcatcaaatctcaggtctgcatttaatatttcaaccagtaatgttattgtgctttaaaaactctggtaagataaaagtagacttttacaaaatgaaattgtttcatttattcactcattcattcattcaataaacattaaagaacccttgttcatgttccagacactgggtatataatcacctgtggactagaaggaaaaatgacagacacagaaaccattttaaagaagataatacattattgttaattatagttaattaaagaaaattaatgaaaattcctttgatataaatacttaggtcttacctatattagtaatgtccacctatttttaattaatagagattagcaactctgaaatttataaattgttaaagtttttcagtaagcttttaaggttgtgtgagatatagttttagaaaatatttgaaaaaaaaagtcacattaaaatgatcaggattgtcttttgtttctgttttataatcaagggcctaacatctaatatgtaaatattcttctagtaagcaattaatgtggttattataatcttattattcatagaatatcccccccgccccataaatatcaacttcctaatccccagaacttgtctaagttacatggcaatagggacttagctaatgtggtcaacgatcttgagaagggaagacaatcttggattacccagttgggcccaatgtaattatacagtcctagtaagaggcaagccagaggatcaaagacagaaggaaatggacaacagtggcagaggccggggtgatgtgccttgaaaatagagggagggctccagccaagggcaccttctgggatctggaaaaggccaggaaacaaaaatttctcccagaaggagtgtaccactacctataccttaattttagtcctgtaagactcctttcagacttctgacctccagaactgtagaaaataattttgtggtattttaagtaatttaaatgtatgataattagttacagaaacaataggaaattaatacaaacctacacaattataacattgtaaaatggcctctgttgtgacaatttaacaaaatgccaggttttttccccagaaaaatccctgcagagatgattagctattagagcagagtgtgaaaccttttaacaaaggtaggctagctggtaactgcccattattaccaactaagtctttgaaggtagcaaagcaatacaaaagcaggtactcgtgtaacctaggccagaaccaccacatttattgatttttcatagcttccttttaactgaatccccagataccactagaattttatgaaatgacttaagaataagacatttgaacatgaaaatttaggtgtttcttcaactgtcacacattcaaagagcccctcctggtaatctgtgtgatcatgttcttgcatcagtcgcagacaagcaaaaagctgaactcagtactgcacctcctgttttctgggagtatttaattttaagagagacccatacttccttttataaggtgaagggaaaagctgtaatagcttctttgccattagttttgaaactctagagttcattaaaactccctttggctttcttcactgccatctttctttcttcttatgaattattcaagacaaatttcacttgaggtaaatagtttgatttgaaggtttttgtatctggatttagatgcaacaagaagtgttaaatgctcagaattttaagtgtagagaatggcacagactcagctattaagatggaagacatttgctgttaatgttccagggctgctgttgcgacttcagcttggtactattattcattctgaagtaggcaggcattatgatgcctgcagtataaatcagattttacagagagcttgatccgcaagcactttgaacattccatccacttctcagttaacagaacattttttggttttacaaggtaaagtttcttttttttttatccttgccaatacattattaatctctttttttcatatattgtataccaaaccacaaaacagttttagactatacatgtctcttgaataaagcgaaattgtaagttttgaaagtttcttctttcaataaatattgtgaaagataagaggacctagaaaatatttcatttttataaaactcaacgtaagaccctttcttctttcacagtagtaatatcttttctagatattgtgtcataattttaatcttttaaacacttagctcatggagtcacacacctggaaaaatgatacatggaacatatgtctgaaaactaccttattttggaacttaagaattggttcaatgaatgtaccacatttaaaaaccaatccaggccagtgcagtggctcccacctgtaatcccatcactttggaaggccaaagcgggtcgatcacctgaggtcaggagtttgagaccagcttgaccaatatggtgaaaccccatctctactaaaaatacaaaaattagccaggtgtgttggcatgcgcccgtagtcccagctactcgggaggctgagacaggagaattgcttgaatccaggaggcagaggtggcagtgagccaagatctcaccactgcacttcagcctgggcaatagagtgagactctgtctcaaaaaaaaaaaaaaaaaaagaactatgcaaagaaatcttattatagttttgtctgctactaaaattcactttcctaatgtcagtttctattaaagttgcctagataaaattatgtttatgaaattatgcccaggtagtactgctttcaggcaaagcatttcattcccgtttcctgctctaacacaatatcacaagcagcaggagtttcattactaaagaataataaaaaacatttattaattgctatatgatagaacatgtgctaagtactttacatgcatcacctaagttaatgctcacaatgagtcttagaaatagtttctgttagtgcccccattttatagctagacagttacatggagagcacagtcttgtaatccctctgtaggacatcagaatccatgtccttaaagactaccaataagtgcaaactcaaaatgtacaggaacatagatttatgaagttgcctagtataatgcaatatgaaatggtggatactgtaacaaattgtcaacaatttacatgcatttatatttaaactacaaatccagcaaccaataatttatttgtgggctatattcaggtttcagccctctggtttttaactcaccacaaagccacactgctttcaaaaccgttcatttacatgcataattattcctttatttatttcaatcttattcagattttatcaggcaatggaaacatgcagagaacagaattacattgtaattacattgtaatcacaatgtcttataaccctttccatggtaaaggattacccattagcccagtcatgtagtttacctgttgttagaagggaagaaggaattctcttctaagtctgaaggagacacaggttgagaatcttttatccaaaatgcttgggggccgggtgtggtggctcatgccgtgggtggatcacttgaggccaggagttccagaccagcctggccaacatggcgaaaccctgtctctactaaaaatagaaaaatttgccaggcatggcggcacatgcctgtaaccacagctacttaggaggctgaggcaggagagtcactcgaacccagaggcagaggttgcagtgagtcaagatcgtgccactgcacttcagcatgggtgacagagtgagactctgtctcaaaaagaaaaaaaaaatgcttgggaccagaagtgtgtcattttttggattttggaatatttgtatatacacaatgaaatatgttagggatggaacccaattctaaacataaaatttatttatgtttcgtatacacgttatacacagagtctgagggtaatcttatacagtgttattaataattatgtgtgacctgtcacttgaggtcaggtgtggaattttccaagtgtggtgtaatgtcaacactcaaaaattttcggattttggagcatttggagtgcagattttcagacttgggatgctcagcctgtgctggaattgcaagaatgttcagactcaaaagtcaaagaaaaagttgagttctgaagagggcacattaattgaaggggccaacaaaatgtattaaaatttagcctgtagtgctcagtgtcttattgccatgaatatgagagtgatggtggctaaggaagggaactggagccatatttctaaatcgggctttatattttgtaggtgattgtgccagccatagtgtaaggcagacatgagtcatttttcaagggacttgggatgaagtgcatgtaaattttggacatgaaaatttaagggcgaaagagatgtttaaatcctctaaggaaagctatgggaaagctgtgtaggcaccattagtttatttggatcatgaagtccaggtaagagattttcatgttcatgtgtcaagtaacaaagataagtaggaaaagtgttgtcatgtgttttattatttaataaggaaatacattttgttatgaatgaatacatttttttcttggcgtgtttaattggtattccttctcaaaatgtccaatgactcatcaacttagttatggcaggcatcttaatttgttaagttgcttaagttttctggttgttcatttccatgaagctgtgtgtgggatttataagctttttcccccaatggatatgctaataaaatacaaagtttgaaaatcactgagactgattaatcatattcctgtcagctctaaaattcagcagctcaacagtcagttatgtcaagggtgtccattatctgatcattctttctactgaaatgtgctttcttttcttcttcttttttttaatcttttcttctattctgttactttctattaaaaaatgaacttcattgaatcttaactcaatgtttcagtgtggggaaggtttactcaccattatggaacatttgaaaatatgtaagaggccaggcgcgatggctcacacctgtaatcccagcactttgggaggccgaggcgggcggatcacgaggtcaggagatcgagaccatcttggcttaacacggtgaaaccccgtctctactaaaaatacaaaaaattagccgggcgcggtggcgggcgcctgtaatcccagctactcgggaggctgaggcaggagaatggcatgaacccgggaggcggagcttgcagtgagcccagatagcgccactgcagtccagcctgggcgaaagagctagactctgtctcaaaaaaaaaaaaaaaaaaaaaaaaaaaaaaagaccttactattagcatttagtaaccagttagggatattgttaaacatcatgcagtacatcagagaatattcttatgtaaaagatcaatagcactgtttttgagacatattgaaatgggttatgactctatagcctgacagacattgcagtaaaactttttttttttttctgataaggactttaatttctggatttatttggtcatgctctctgcctcaagcacctttctagttaccctgtcaaaaatcttgtttgctcttgaaggcttagttcagatctcatctcctttgtgaaatcacttgtaaccctttcactttactataaactcagaggtctccctactttttgatggcccttgtataatctcttgaacacaagcttgaataatctccaaatgcaatggcaaattgagaaaaatggtactggcttttccattctgctttccgtgtgagttgtgtaaaagggccaagacatatcacttttgttttgttttatttaaattattgttcctacagagaaatagatgataaatactgaaataatagtgagtcatccttatacacaaaaacatcaccatagcaaatatgctacctaagataaacatgctgcatagctcaacctaactttacttatttgtagttaattcactataagaactcattgagagtacagcatgaaacttgttttttaatatcctttcttgctgattgtgtctcaaatccataacttagattttaatatatagactacctgatgataataatggtgttctagaaataaaggcagctttcggagcttctcttaaaaaaattaaagaccgtctacatgatcaactacctaccagttaactgaaacaagactgggtatcactggcccactgtcctagttcaaactcaatgaaggaatcaacactattctagatcatattcttaacactatgatcttagtgttaagaaatagaaaatccttgactcctgccatatgtcagtagtgaaaatagacccttccaagaccatttccaatccttacctctagaaattacatgctgtttctgattttcagcacatctcaaagagattcatatttcccttgagttacagttgttgtagtttgtaaaaatgttcctatttctccatatcctctccagcacctgttgtttcctgactttttaatgatcgccattctaactggtgtgagatggtatctcattgtagttttgatttgcatttctctgatggccagtgatgatgaacattttttcatgtgtcttttggctgcataaatgtcttcatttgagaagtgtctgttgatatcttttgcccactttttgatggggttgtttgttttcttcttataaatttgtttaagttcctggtagattctggatattagccctttatcagatggatagattgcaaaaattttctcccattctgtgggttgcctattcattctgatagtttctttttgctgtgcagaagctctttagtttaactagatcccatttgtcaatttttgcttttgttgcaattgcttttgatgttttagttatgaagtctttgcccattcctacgtcctgaatggtattgcctaggttttcttctagggtttttatggttttacgtattacatttaatctttaatccatctcaagttaatttttggataaggtgtaaggaaagggtccagtttcagttttctacatatggctagccagtttttccaacataatttgttaaatagggaatacttaccccattgcttgttttcgtcagttttgccaaagattagatggttgtagatgagtggtgttatttctgagggctctgttctgttccattggtctatatctctgttttttttttttttttttttttttttttttaaccagtaccatgctgttttggttactgtagccttgtagtatagtttgaagtcaggtagcgtgatgcctccagctttgttctttttgcttaggatcatcttggctatatgggctcttttttggttccatatgaaatttaaagtagtttttttctaattctgtgaagaaagtcagtgatagcttgatgggaatatcattgaatctatgaattacttttggcagtatggcattttcacaatattgattcttcctatccatgagcatggaatgttttttcatttgtgtcatctcttatttccttgagcagtggtttgtagttctccttgaagaggtcctttatatccactgtaagttgtattcctaggtattttattctctttgtagcaattgtgaatgggagttcactcattatttggctctctgtctattattggtgtataggaatgcttgtgatttttgcacattgattttgtatcctgagactttgctgaagttgcttatcagcttaaggagttttgggtctgagacaatagggtttctaaatatacaaacatgtcatctccaaacagataatttgacttcctctcttcctatttgaatacgtttatttctttctcttgcctgattgccctggccagaacttacaatattatgttaaataggagtcgtgagagagggcatccttgtcttctgctggttttcaaagggaatgcttccagcttttgcccattgagtatgatattggctgtgggtttgtcataaatagctcttattattttgagatatgttccatcaatacctagtttattgagtgtttttagcatgaaggagtgttgaattttgttgaaggccttttctgcatctattgagataatcatgtggtttttgtcattggttctgtttatgtgatggattacatttattgatttgcgatgttgaaccagccttgcatcccagggatgaagcctacttgattgtggtggataagctttttgatgtgctgctggatttggtttgccagtattttattgaggaatttttccatcgatgttcatcagggatgttggcctgaaattttctttttttgttgtgtccctgccaggctttggtatcaggatgatgctagcctcataaaaagagttagggaggagtctctctttttcttttgcttggaaatttttaaaagtaatggtaccagctcctcttggtacctctggtagaattcagctgtgaatctgtctggtccagaagttttttttggctggtcagctattaattactgcttcaatttcagaacttgttattggacctaatagacatttatagaactctccaccccaaatcaacagaccatacattcttctcagcacaacataacacttattctataattgaccacataattggaaataaaacattcttcatcaaatgcaaaagagtgaagatcataacaaacagactgtcagaccacagggtaagcaaattagaactcaggattaagaaactcactgaaaaccacacaactacatggaaactgaacaacctgctcctgaatgactactgggtaaataatgaaattaaggcagaaataaagatgtttcttgaaaccaatgataataaagacacaacataccagtatctctggaacacagctaaagcagtgtttagagggaaatttatagcactaaatgcccacagtagaaagcaggagagatctaaaatccacaccataacaattgaaagaactagagaagcaagagtaaacaaattcaaaagctagcagaagacaagaaataattaagatcagagcattactgaaagatccagagacatgaaaaacccttcaaaaatcaatgaatccaggaggtgtttttttgaaaagattaacaaaatagatagaccactagccagactaataaagaagaaaagagagaagaatcatatagacacaataaaaaatgataaaggggatatcaccactgatcccacagaaatacaaactactatcagagaatactgtaaacacctctatgcaaataaagtagaaaatctagaagaaattgataaattcctggacacatataccctctcaagagttacagttttaaagatgactttgattttcaagttttaacaagagaatagaattgtttcttcaaatacactaatatatttttgtaggatattacataaaactgtagataaggatgtgtctaaataaattcatgcttaatttttaatcagtttaataatctagatattttcattcttttttttttttttttttttgagacagagtcttgctctgtcacccaggctcagtggcacgatctcggctcactgcaagctctgcctcccgggttcacgccattcgcctgcctcagcctcccaatattttcattcttaatggataattaccataatctagaaaaacaatgcaagacaattgcagacttttgttaaatatgaaaaagcaaggtaattctgtaccatttcatacctaaagtaaaaaaaaaaaaaaagaataacaaaaagttaactgtaccacctatttttattctaaatatggagcatagtattttatttaagtaaggaactgttatatgtatgcttacatttcctaagacatcttcagagcattacttttttcatgttcttaaatggctatacaagtagtgtaaatgttcaatagccagaattctgtatgtaatatatctaagtgttatatatgtatgcatatctaagtgcttattctctttccagagagattatgaattttcaggatttaggaagtccagttatattgcctcttgtgaccttgggttgtacacccactttgaaaatcagtttggcaatatgaagccatatgggagtagtgatgaaaaataaatggagaaaaaaccctatcttctgcttggtttactacctaacatttgggaatataatattaggtaaatatattcaaatatattgtggatcagaaagtgctgggtaagtggaaaataagaggtggcacttctgggcattttcttttgatataaccattttgaataaaccatttacacaaacatacgcatacaacctcttacctaggaacatcaaaactgaatatttaaattatgtagtcaggaaacatttcgactaccatgggccctaggagtctaaggcatgttgaaatgaataaaataccaatactttctggaagcattaaggaacctcatgcattcagtatttgctggaatttgtccttttggcattgaaaagagataatgggtgattacactgtcaaaacttctaattctcaaatataatcttcaaaggagtgcctgtgcagacataggcagaataattttaatggaccttgaagcatctggaaacatagaaagaaaccttgcatagcaacacaggaacattgctgatatttttgtttgttctctctctctctccctctctctctctctctctatatatatatatatatacacacacacactcacacacacacacacacacaaacacacacacacacacaagaatatattctgtgtggtcttgaatgagctattcaaagtctccatctgtcatttccatatctatggaatggaagtaattatgatgatacagcatgggtttagtttgagtgtgaaatcaggcactgcataaatggcacgcaaaagagtgcctggcaaatgataagtactcaatacttgtgttgggaagaccacaccactacatagcttcctgcctttcctcatcatggggaatagttccatatttaagagaatatgaaagcagtgaacagtatcttattttgaaaaaacttttcattatgacagatttcaaacatgcaaaagtagagacaatgagtgaatgaaggaatccccatgtgtctatcattcttattcaattatcaacaattatcagtatctacagtgttaagataaataatttgcaaaggtagtgaaaataccttggctcaaaactgaacatgttcagaaccccatatactttacatatctcttgaggtaatagatttccctatgtctctgtaacaaataaatatatttacctatattctgttgttagatagatgggtttgaggaaaacaaattcactaaatgcagaatcaacttttacaagaaaaagaaattataaatgaaaagcttttaaaattggttcagtttgcaaaactgatactaagaaaatatgtcaatacatttttcatcagaataataatattagctaaaatcatagattgcttctatgaaacaggcttagcatcatctcaattttcatagcaaccctattaattaaggaacactctaattatcattatatagatgaagaaattgaggttttgtaaatgtaaacaaattgtccaaggcaagtggcaagactagaatataaatccagggctgtctctagagattattcgtaaccactataacatatctcaaaacattttagtcattagcctaataaaccaagaataagaacgctatgaaaccttattttacttaaaaaaaagtttttttaaacttatttattttaattatatctgtaatgatacattttataaaatttataaatgtttaaaatgtcatccacatgggattaaaagaaaatcataaatctcatcagggacaaaatggaaggaattttttcagaccatttttctgttgaacacaatagaagtttagcttaaatatgcactttaattaccccatattttgattccttgatttcaacaaaaagttctgaggttacttagaaaaaaacctagcatactctaatgagattttcagtaaatagaaaaactctgtcatatatgccatacaaagacaaataaggttcaaagtaataaaatatgtcatccagcaaaatctatgctacagatttaatgatgatgacaataatttagccaaggccagctgctgtactaatagaccccaaatccttgtaatggcacaaaacaacagaagcttctttcttatttcatatagcagcatggggtggatgaataagtgtccatggacgctctctatgtagtcattcaagaacccaggtgggttggggctcttccatcttcaacagctgggttcctgaatgattgcatggaggagacaaccatggacgcttgttcatcagttcatcactagtagtcatcagtcaagaaatctaagaataagaatgccatggaggcagggttatcagataaaatgtagaacaacaatgctatatgtagaacatactagcactaaaatattattctgtatttacctgaaatttaaatttaactagattttccatattctgtttgctaaatatggcagcactacatgtaactatgtaagaaaaaaaaagaaactgtgcattaaccttttaaataaatatttttaatagtatcacccttaaatgcttagcacaatgctataattaactttagtcatcctgatatggaaaaagtagtgggataattatctcttaattatgtgacgaggaaagaaaatgtaattttgacctccccaagtgggtaaatgactaagattagaagccatgtccactcattactagatcctgcataatcttgcataaactaatatcaaatattttaacgtttgaaagtatgctaaatgtttatcagagcaggtgattttatttcattgagttctcatttactcatgtatatgttaatttatctattatgtattcaaaattactcaaatattgtattgagtgctctaggataaatattaataagtgaaaattaacactaatatatctctgattctttgcaatgtgtataattaattacctgaactggacactattgagagaaaagggatgcttttaataatcactccagaacaacaggggacagcttctggaaaacagggacaaataattattctgttggtccacctgattttaagttttccaataatagaatttcagaggagagctatcatagagctcatttaatataattgcactttatagacgaagaaatctgaggcccagtgaaaagaaataataatttctgtatattaatgtttctcacttaagtttatgacattttttaatgaagaatgattgatatgagactttttccatcgtatactcctcttgtactggaccaaagattgttgtcttctaaaacaatacgtacttcaactaagatcctaaagaccataattaaatcttaacacattaccaggtatctctatttattcttttagagcacaaatccactttttctaaacctattaagaactaagtatgtgttgcatgaagttttaaagtaatatttcatcttacaatccagaaaactcttttatattctaatggctctatgatgttgtagaacaaatgacatgtcattatttgaccgagaatggaactaaacccaaaaatggcccagccacagaatcttaaaatcttctattaatatggtctctggtaaatataatgagctgaaacacaacttctatggtatttttagagataaacattattttctcttgaaattctcacagtattcttttagtgcttacatgtcagatgtaggtttttaattgttaaacatgaaaaatactctgataatttaactactcctaaatttaagtgtatatatgctttcttttttgttcacagtaatgtaggagaagcagtgttaaatgatgctaggaatctgtactctagaaccggattgcctaggttcaaattctgatacaaaaactctatggcttttgaaacaaggcttacatttctaaccagcctattcatcactgttctcatctgtaaaatgggattcattatggtaataactacataatccagaacagataagtaaatgatttaattaatataaaacaattatcagagtgtatctgtcatgtattagacataataagcgtaagctttcatcagtatgttatttctttaaaaaaatccctcttttctctgccttataatttttggataattttttccaaatataaactggtaaattataaaccagttaaaatatcaggacattattgtttacaatatgtcgtttttaaaaactaattaagatcacattgcagtgaagaatgaccccatttaatatatattgacattatatttttgagcattttgtagattaaataaaacaaaaaaagatttaatacgaaacattttctatgtttgataaagttgcatgtatattatcactgttattttcttacctgttaaggaaaatattaccccaaatttaagttggaattttaaaaatgcatactattaagagtgaataagagtttatattctgcttgaattcctggtttatgacatacatacaaaatgagaaaggaaataaactctaggatgaatcttattttagtaagttaatggccttttcactgaaagtaggaaatatttcttctttcaaaagcacccaagatcaataaataatcttgatttaggaaatatgacaatgcaaacttttttcaaaatctgcttaaaaatgtaataaacaccatatcaatgggaatgtggtaataatcagaacaaattttctcaaaaatatatctttttttaagaatgagcaaatcaaatattttggactttattttttcccatggtattatcattaagaatatctaccccaatgtctgctttctccactttcatgcctaaactacagaacatcactggacaaaataataacatcttgctgatggggtccactacccatgacacttcagattagctctcagttggtgttttacagtattttatttccttgttttcattttctagtgactccattttacagttctttcagtgacttttctaaaatttaacagttctgagtgtcatcatactgcttctattccctctccctttaaccagatgatctcaaatccatcaatatggggaacattgaattctttttacttttttttttcctggttttgttctttagaagaacaagaagttcccttcaacagttttcaaccaaacatctgtcttcaagttacatcttcatcatctcaccatcctgaggattaaatgtgataatctatgtaaagcacttaacaaaatatcaggcacttaataataactattatctatcttttcccctagtgaatagtgggcaaagtttcaaccattgattatttgtttaaatacttttatttcagtaaaattgcttgcctttgaatatattttgccagtgctgaaaatcgtcatatgtcttctaatatccaaaaattactgaataaaatagtggttaggagcaaaggggcaggggccagacttcctaggcttaaatgtcacctttgccacttacaagctgtatgacaattgtcaaagacttaaacttgcctctgtatcctcatttggtaagttatttaaaaaaattatctctagtacagtaaagaagaagaagtatgataatatacacaaaatgcgtagaactgcctgccacatgctaagtactaacaatactagctgttattaattttcactgtgtctaaaattcattatttcagcaaatatctattgaaaccctattgaaaactaattgtgatgtgtgattttaaaggacaatgataattatattacttattgtctagacagcaaaaaaaaatacaaagatacaaatcaaagtacaaattatattaaaagctatgaggaagtgtcaggttatcagaggggatgttatcaaatttggaaaatcaggcaagctgagattcttagagtttgtaggtgctcattacaattttattttattttttctgatagtagtaataacatattttctgactatgataaaagccaaagtgttatctatgttctttacgtgaaagttcacttagattctctttctcatatggattatagattgtcccttattcaggaaagcaggacattttttggtctgaagagatttccctctgggtttcatttgtatcaaaagtgaattgtgaatcccaaaggcattcacattgtaagatgatactactagttgggatactgaggttccatttttattcctttaatagcttcctaattatagattccttttcctttaatttcagcctctatattaatgataaaactaatctgcaatctctctcaaataacttttatgctaaaagcaattaggtagatattttcttggctccttagagaggaaatagatttagatatgcagaaagagctttgtcattaaggacccaggtaactacgatcctctaacagttaatgacacaaggaactgggctcaagtagagacatatagtttaaagtgaaaacattttgacctgaaattccaaggtgcacctggtaattggtgaccttaacaagtggttatgacagcaaagtcctacagtttgtggaagatagaaagcaaattcactaaaaggaaaggtaagaggaggaagcaaagagaaagaatgcaacagagaagaagaaaaaagaataaaagttttccctaattaaatgcttactatcatccctttctcactgctattttataatattaattttatatattactaattaaaaactatataattatatacataattaatttttttctggttcttcaaaatatttgactaaataatttagaggtctcaaataaaaatggtaattttaagaccactgtgatcaagttctggaaatttttaaagatctaggaactttttaaagctttaatattttttgattatttttatattttatacaacatttttactaattccaaagaattataaatgactattatgtatttttatttggaaacattttggttatttgggaaaaagtaggtgttagtccagctatacattgtatgtttactgatggagaaaaaaaaaatccctcttgttattagacactgttattttactgatacccaaattctatatatttagatatggtttgggatgagctgtgtaacttatttggacatgtgaacatctttcactatatgttttgcatatgaaaaaaattatctcactttgccttttatttaatgattctttgaaatatattctttgtataaaccttataaagttgtcaaaattaattttcaattagaacatccataaaagtgccaagttattataactactgccttatgattcactcaaagtaaaggataaatccataacattttctattaattgaatagataatcttcattttacaaatgatttccatatagaattagtgttacgataggcagttcttagtgaaatcaatatcagcttatttcctattttgagtcatgaaccaaatcattgtcgtcatcattaaatctgtagcatagattttgctggatgatataatttattactttgaaccttatttgtctttgtatggcatataagacagggtttttctatttactgaaaatctcattagagtatgctaggtttttttctaagtaacctcagaactttttgttgaaatcaaggaatcaaaatatggggtaattaaagtgcatatttaagctaaacttctattgtgttcagcagaaaaatggtctgaaaaaattccttccattttgtccctgatgagatttatgatttttttaatcccatgttgatgacattttaaacatttataaattttcatgaaaaccattttcatatctgttaatataaattactctatcaataattattttttgtagcaaagaaaattaacaatactttgccatttttgttcactttggcctcctcctgatgtcattcttcattttatccacatttcattaatgtgcattttataaactatgctaaaaatagcctcttttgaccacatgtgactgtgactcagaaagtttacttgcatctgtgcttcaaatgactaaacatttttggtttctataatggcaggtgaagggaattaaagaagaggtaaagtaaatattttaactggtgtataatatggttagatcatcctgtttttgtgccttccactatgatttgattacttctaagataaatgatttcgagcatatttgacgtgcaaatatatttaagattcaactatcaacatttgcttagtaattaaaaatttagtttttcaaaaaatgctgagtgccattttgtagctgcagatgaaatttcctaatatcgggaaatgaattgtttttatttgtttgtgtgtctgtttgcattttcccatggcttgctggtgcttatactttatttttcctcaattataaaaatattgttctaaaagagaccttagagttctacacagcaacccacttacacagctcaggaaacatgggccaagagagatgaatgttctgcttcttcagtggttcttacccctgaatgtttgtggtaatcatcggaagcacttgagacccaaggtcagacttctaccactggcagctctaaaatccaagttcggggtgggtcctgaattgtaatttttaaagtcataggtcactggaatggtctgtcaaggctgaaaatacctactcatgcatttagtcttatagaaaggacataagggttattgtgatttcttactagtagaattgaaattagcattaaggcacttaatactcccttcactctaatattctgcctctgtttttttttttttttaatggaagttattctacttgcagacactcgtttttttttttttgtttttttgttttgttttgttttgttttgtttttttgatggaggctcattctgtcacccaggttggagtgcaacggtgcaatctcggctcggctcactgcaacctccacctcccaggttcaagcgattctcctgcctcagcctccctagtagctgggattacaggcgcctgccacgacgcttggctaatttttgtatctttagtagagatggggttttgccatgttggccatgctggtctggaactcctgaccttatgatcgacccgcctcggcctcccaaagtgctggtattacaggcgtgagccaccgcgcccggccgacactcttgttcatccagaaatctggtcaccagtttccttgccagtatctaccagcccattctgcaattctgacggaattattaaactcctctgtgccctaggggcactattgccttatgcacagataacatctaggagacactggtttttttttctggtatatgtaacaaaaaagtaacaaaagcaaattgctgaattgccgttacaatagtacttaattaatatgtatgtataactgtatatgtgtatatttatgtacttagtgtttctgtatttgtattgtttttataggaaatgcactgattctctaatattaacacaaatcctcttcattcaataggtgttaaaaatctctaacacacttgtcagtgctctcagatatgagtatcttttcattgtcaagtcgcagattcatgtctgatttcagaactttgtaaggccagtgaaagtgagtgacgaaggatcatttaaagacaaggtacaaatagcttgtagatatgtttgtatcatataaatttactgtttatgtggcattttgagatctcttacccaattgacaccctttggcaatgaaagtgaatccttcatttatccactggttttatttattcactatttttcattcattcaacatttattgagcattcactctgtaccagatgcaattctaaaagctgggaatacaaaagtagacaaaagtatacctcattctggtcctcatcacacctaatagctactggtcaagacagacattaaatatcatccaaataatcataaaatttactgtggtgagtgcaataatccagggatctaaactagtctgtgcaggagtggaggtggataaaggcccaggggcaggtaaggctctcctgagaaggtggcatttaggaagtagtaagtaggcaaagaggctgaataatagttcccatatgaagagagaagaataaatgaaaaggtgttggcactttcaaggaactgaaagaaaaagagggaaactggaaagtgacatttttacaagtatttgaaacctttttttttcatgtgtaaatgtgggattacttttacctttgcagaaataatatattggattgtaagagttgttttcctgaaggtcatcaaaaattagaatggccattttcctaatttgtcttattatggcagtctcagtattaacaacaggtccagccctctttcagaaaacaaaatattaatagtgacctttttactcctaaatgcattctagtttggatagtaaatcttatggttagcctatctagaataaaagaatatactttacccaattcttaaagttgcaaaggaaggaattctggtaaatgcatacataggaaagtgtagccttcttactttttgttttgtataatgtcttggtatagggaaaataagctaccaaataaccaaccaacattttaacttctcttattttcttccttttttccttccttttcttgttacttttcaaagtgcaagtaaccaatattatggaatgtctaccttatgcatggtgcagtgccaggcaatgggtatgtagtagttaaataggcaggaattagaacaaaaaaaaaaaaagaggaaacaagatgaatttgagggggtgctttgagagggcatgagagcagctataatatgtgctctggttaggagaagaaaaacatagtatttttaagatactgttggagactagtgaccttttcttaacgtttaaaaatataacaagagagtcagttttttctgattcttcatgtcctaagacacaagaatctcttgggcaaggtaggatcctccttggaggacagaaattagaaagtctgaatcagaatcctcagtatttggcagagggaaagaagatactggggaaaagagcatggcttattttcttttcatggtgacactacttttctattgggttgcaactaaatttgggaggttgacacagtatcataaaagcaaagaaagatatccagccctatagtctttttttttttcttttatgatgtaccttcctaggtcaactgagttttgcatattcctcattgctgggactgtagtcacctctctttttattctcactacaatgggaaataactgtcttcagatatcaacagtgtggattccttttaggctagatttcccacacttaaatatcctagtgttatatcagggacgaggagacaagacaaagagacatgccattttcatatttatatttttcccctctccaattctttattttccctccaattccagaaaactcctagcacttctcaaatgggaacatattaaaatcctagcaagtattttaaaaattctattgatagtctcaaggcttcagctttcggaaattaaaataattttgcttctctatttggttcttctttctttttcagtaaaagcacctacttgaagacatagagatcttttcccctactaagttgcccaacaggagatgatcagtttaaagaaaatgtggaaatacaaattcaatctgtaatgcatcacctggttttttccaacacacaagtaattgacctctttatattctgatttaagttcctaagtatttgtgtttgacaagatctgtagtgtctgacatagggcatcctcaaacagcacggtgccaaaaaatatggggtcagaatggttgggttttaattgtgactctgatagttactgattacggaaccttgggcacagtatttaactagtctatatatctgcttcctcatctgtaaattggaagttattataaagccttccatatagacttcttatggaaataaaatgaaataattcatacgaataccctggcacatattaggtactcagtgaatgttagctagtattacaaatgtctatgacaatttaattagcatgatgtctagaaccgccattatttgattagaattagtttagcaggaggatgaaaaaactgagaaggaccctaaaatgagtagccatgctgttttatttactcctttctttatttaagacatgaacaacactctaggtacagttttatattttaatggctatgttgtcttctcttcgtccttacatgaaataccctcaccctctcccccagaaaaaaagaaaagaatcattccattgttagaatgcagtttagagattataaactccaaactctgtacgtcattaaaatttatattcactgggaccttgaacttagtcttcaacttttacatgcaataccattagtttatttaagttcagttgattcactgtttgtctccctccacaaaccaacctcttgcatcagatgttctccttaacttgcttagaggcctgccatttctttggatttttttttccattttatcacctgaaacctcatttccatcttaagtaggcctcccatgcattgtctaagtatctccctaataattcccaacattttcttgtcccaactgcagcctagttctctctttaatagaattgttttacatccctctcttgttgcagatatgatttctctccaactccgtatgtaaaaaagataaggtgaaaagaggatattgtgagcaactcagtttcccttgccacttcccagattggtagtccaaccccttctctgtgtctattccctccagccatgctactattaatttattcttgtggtctccttgtatattcacagaggactttgcgttgtggctcatagtcttcttgttcaccataatttatgacatcatgagggctccttaagttttcttgagccttttggtattaacgtctgtcaatcccattctgctttagcaaactcactgtctgccatcacttctgggttttcttcctttgtttcctttgttctgcctggaactcactgcctttccaacattttcattgtctttatcccattctgcatctgtaccattatccctaaaacttgtcttcatctaataatttacttggctagtactatcctgagaagtctattagaactgctactacaaatttatggtcttaacttttttttttttattattatacattaagttttagggtacatgtgcacattgtgcaggttagttacatatgtatacatgtgccatgctggtgcactacacccactaactcgtcatctagcattaggtatatctcccaatgctgtccctcccccctccccccaccccacaacagtccccagagtgtgatattccccttcctgtgtccatgtgatctcattgttcaattcccacctatgagtgagaatatgcggtatttgttttttgttcttgcgatagtttactgagaatgatgatttccaatttcatccatgtccctacaaaggacattaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccagcaacagtgtaaaagtgttcctatttctccacatcctctccagcacctgttgtttcctgactttttaatgattgccattctaactggtgtgagatggtatttcatagtggttttgatttgcatttctctgatggccactgatgatgagcattttttcatgtgttttttggctgcataaatgtcttcttttgagaagtgtctgttcatgtccttcacccactttttgatggcgttgtttgtttttttcttgtacatttgtttgagttcattgtagattctggatattagccctatgtcagatgagttggttgcaaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaagggagggatccactttcagcttcctacatatggctagccagttttcccagcaccatttattaaatagggaatcctttccccattgcttgtttttctcaggtttgtcaaagatcagatagttgtagttatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaatcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgccaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctggattcggtttgccagtattttattgaggatttttgcatcaattttcatcaaggttattggtctaaaattctcttttttggttgtgtctctgcctgactttggtatcaggatgatgctggcctcataaaatgagttagggaggattccctctttttctattgattggaatagtttcagaaggaatggtaccagttcctccttgtacctctggtagaattcggctgtgaatctatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattatgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccgttattaatgtgtgggagtctaagtctctttgtaggtcactcaggacttgctttatgaatctgggtgctcctgcattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatggttttcctgaatacagcacactgatggatcttgactctttatccaatttgccagtctgtgtcttttaattggagaatttagtccatttatatttaaatttaatattgttatgtgtgaatttgatcctgtcattatgattatagctggtgattttgctcgttagttgatgcagtttcttcctagtctcgatggtctttacattttggcatggttttgcagtggctggtaccggttgttcctttccatgtttagtgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacctgacctttctctctggctgcccttaacattttttccttcatttcaactttggtgaatctgacaattatgtgtcttggagttgctcttcttgaggagtatctttgtggcgttctctctatttcctgaatctgaacattggcctgccttgctagattggggaagttctcctggataatatcatgcagagtgttttccaacttggttccattctccccatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgatcgcattggctcctgaggcttctgcattcttcacgtagttctcgagccttggtttgcagctccatcagctcctttaagcacttctctgtattggttattctagttatacattcttctaaatttttttcaaagttttcaacttctttgccttcggtttgaatgtccttccatagctcagagtaattcgatcgtctgaagccttcttctctcagctcgtcaaagtcattctccatccagctttgttctgttgctggtgaggaactgcgttcctttggaggaggagagacgctctgtgttttagagtttccagtttttctgttctgttttttccccatctttgtggttttatctacttttggtctttgatgatggtgatgtacaggtgggtttttggtgtggatgtcctttctgtttgttagttttccttgtaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcaggttctcagatctccagctgtgtgctgggagaaccactcctctcttcaaagctgtcagacagggacatttaagtctgcagaggttactgctgtctttttgtttgtctgtgccctgcccccagaggtggagcctacagaggcaggcagacctccttgagctgtggtgggctccacccagttcgagcttcctagctgctttgtttacctaagcaagcctgggcaatggcggacgcccctcccccagcctcgctgctaccttgcagtttgatctcagactgctgtgctagcaatcagcgagattccgtgggcataggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgctcacccactggcctgcgcccactgtctggcactccctagtgagatgcacccagtacctcagatggaaatgcagaaatcacccgtcttctgcgtcgctcacgctgggagctgtagactggagctgttcctattcggccatcttggctcctcctggtcttaacttttatgaactcttatacagccacttgtccaattttccaaaacagcaattctaaacttttctctccagctaattattaaacttaatatcctatcctgatgctattggaagattgtcactccagagaccctccagaaacatgatcaatccaacaatagcatgcaattgcagcatcaatttttagaaagccagtttttcttctgtgtgtgtgtgtgtgtgtgtgtgtgtgtgtgtgtgtgtgtaagttgcttgaaaggtagtcagctattgatagaacttgaggtgagaatttaactggggtttggttgctaccagtacagcatttttgcagcatcccttgggttcattggaactaggaaataaagagtatatatattatctaaaatagagaagaattgaggataaccgtttatccatttatataatgtgtagctaaaatctctctcatatctccttgaactgagaaccaaaatgtttttactaatttatttatttaatgaaatgtattatttaaataaattgtaatgtgtgtatttaaggtatacaacatgatattatgggatacatatagatagtataaaggttactgcagtgaagcaagttaatatatccatcatctcacatagttacccattagttttagtttgtttttgtggcaagagcagctaaaatctacttatttagcataaatctcatatactgcacaattttactatctacagccttcatttgtacattagatctctacactcttgcatcctacatatttgctactttgtatccactgatctacatctccccattcctcctgcctcctgccccttgtaactactcttttgcgttctctctctctctctgtgtgtgtgtgtgtgtgtgtgtgtgtgtgtgtgtgggtttagatttcacatataagtgagatcatgcaatactttcctttctatgtctgacttagttcaataagcataatgtactccaggcctatccatgttgtagcaaatgacaagatcttgtccttttttagtggcaactcaattgtggaaaaacaaataaactgatttaaaaatgggcaaaagacctgactagacattttttcaaaagaagacattgaaaatggccaacagattaatgagcaccattaatcatcagagaaatgcaaatcaaaaccactgtgagataccacctcatacctgtcaggatggctattatctataagtcaaaagataaggaatgttgaaaaggatgtgggaaaagggaactcttgcatgctgttggtggcaatgaagattggtacagccgttatggagaacagtatggaggtttctaaataaattaaaaatggaactaccatatgatcttatgggcacatacccaaaggaaatgaaatcaccacctcataaagatacctgcactcccatgtcatgttcattgtagtgttatttaaaaaagctaggatatggaaacaactcatggatgaacagataaataaattggtacatatatataattttactaatttcaaaggcttattttctaagacaaaatttaaaggggcagtttcaccccagatatgcccaatggaaactagcaagtgtgtgcatgagagatgactggtgccttgccacaatggcatgtaccatcatcgtttgcctcagctatggcaatagcttccctactagacttccagcttctcccctcaggccctccagtccattctccacactgcttccatatcctcctttttagataacaaaactgataatagcaggcctttctcattagtgattgggaatttggtaaaatgaaggtttctggactacatcctacggagttagattgtaagcttgttctattaatctgtgttttaattaagcattctgtggttttcaattgctattgctccacaagttatattttgagaaaacactgacccacagtatgatatcaaacatatgtatgcatttaaaaaaaaacctttcaagatctgttctttagtatcattttttactactggcccttaggcatcctgtgccttagccatatgtattactcatcttcccatgtcctgtctctcctctgtgcctttaattatgctctactgtttcttttgctcagaatatctcctgttctactgctatctgagacgcgttctttaagtaacctagccaggttagacacttgtcctctaccgctctagctttgtcttcataatccttgcaaactagttttcacattgtcttgtaattatctctctctcccctcctcacctgtgttgactgtggtcttcttaagcaaatatatacaggtcactgctttcatcttctgtatctgccacactgcctggatagaggaggcattcaattcattattgctaaggcaatgaatctatcttcaaatctgtatgtctcagattccttacctgtaaaataaagattgccagagagactttttcaccaaacaaggtcttattgatccggctcgcttgcgcttgctcgctgtctctctctctctctctctctctctctctcacacacacacacacacacacacacacacacacacacgtggttcaatatattttaagtttatactgaaactatttaaaataaataactctatagaatatataaactattagttatagttttcttttgctttttaaacctagtttgtttcccaaagctaatgttagataaaaagataatcaaagtagccagatggtcgttaatcatgagggctttttattctataaacataaaaattccatcacctccgaggagtttcacatgtatcttggattcatcctaatgtggggtatgaaaaattggtttcaattcagatgtacgatttagatcacttacctttttcttccttatttttcttgagtagggttgtgagaaatggctcaatgtaaaaggcataaacatagaattcttgatgtaaatggatgtagtcagcctcaatctaattaaagatttctctctttcctttaccctttgtcagtatctttgtctcttgcttctagaaattaaattggaaattttactatgtttctgtccttttctaacctttacttttatttgctcacacacatatgctaagatgcacacagatacacagagacacatacagtgtaatttgcagataaaggaattcacacagaaaacatatatagggtgaagttactttgtatagtataattaccatggtaccctctactctacatttcctaatttatctgaccaacttggcattcaatgtgaagtatattgtgtgagttatgtctattaatacattatgacttataatttataaaccacctttaatgcaaagcaaatactatttcaaggggaaaaattgcatattcaatttttctttatttatacataccctaggatttacttacacatggatgatttatagagatttccccattgttttaaagtaatttatggcaacattcctttatctaatgaaagccaagcaaagggaaacaaaaccaaaaccccttttgatagagaaatgctgagtgagaggtactaggaaggggcacgaaaaagcatattctatggcttaatgctctaggcttacaaaagcatggtgttggaatggtaattggatttctgagcattgcttttgtgaatagactgcttaaatcattgaaaaggaaatcattgcagaaaagaagcagggaagaattgcacaggctgtttgagtacttacaaactaagaataacatacgaacaatgaagaactggtttagtgctgttgagatttgacatctttaaaaacctgatattgtagctgtagttttgatcttcgttcctttgttgaatgaagtcccaatgcattttggaccagtactttcaatgagggctgaaacaaatgagatttttaaaatgctttttccagaaaaataaaattttcccccaagtccacattatatttttgtttgaaaaacacagatacagatacatatgcatctctatttttagtttgtttcacatgtttatttctgcggtggttgacttgccattcttaaaatgttaaaagtcctctatcctcccaaactttcatgttaatagagtgactgtcacactgtaagcattcaaaaattattttgatgtgctagaagaggcttgggaattggaggtggtgtctgggtgttagcctcttaaatctgcatgtaaatttcccatcagcaattataaaaggaaaacatgtcatttactagacagagttaaaggatgtccactatctgctttttcaacaatacctatccactatcactggggaatcgtgaacatggacacaatttttaccttcagataacttatacgtattgcccctctgcccagtttttgcattttactctgaaaggtgcagaaagaaacaagaaaagataggaaatagacttctaggagagtttgcttaaaaaaaaaaaaagagttccatttttcttggagataatacaacacagatttttacttgtccttgttaaatttgccacagaagataaaacatttgttgagtgtgtaattccatgctaaacaacttgctagttatattaatcatatattaaatatattggtcagaataaccctccctttattttatggtgagcaaatggaaaacatagtgataaaaatttttcagggtcaccataactagaatttcaatccagttcttttggactccaaagcatatattttcctctaccgtgcagtaatttattttaaacattagttatttgaagacaattgaagtactgtatacttttctttggggaatattcattgctttatggaatttcttttaatttttgtactctgttgttaagttcaaatacaattgtacttttctctttgttcaaatagaggaaagaaagtcactcacaaagtggcaatgtgcaaaggactacaaaaaacatctattctccatctgagacctagctttatagagacaataagaaccactgggaggaaaccagtgagtgtcagtggtttactctagtgtaaaacatttggctctggaaaaaatcatgttttttataaaattgcacagcacaagacacagaagcactttttataaaattatgaatgacaattttgaatttttaatgttttaactatttatttttaaaacatgccttactagatagcttcagaatatatgaataaaaatatgtaaattatttactaacattcaaagcagattatggtggtaaggaaaatgttcctgtaatataaccttcaatagcaggtgttaatttcactgatttctcactgcttatttagatggaacagtgccttccataccgtcaatgacagagtgtgagtcccacagtcactcagctgggcttcataatgtcctacttatttcctgtgttatgtgaggtttgtcacttaacattcctgagtaagaattcttcttctgtaaagtagggcactaataccgatctcataaaatctctgggagaattagctgactgatgtaggaatgtaataatggtagccagcttgtcctgagtacttacagtgtgcctgggatctcctcagatttacaggcattagcatctttagccctcacaacagcctataaggttttactgttaagcctccttccactggggagacaactgcaaggcaggaaggggcatcataaaaagataggagtgtcagaaccagtgctggaagccaggcattttgactccacaaattgtgcacttggccaatatactatactatcctgactcccaccactcaccacaaagttaggatttttttttcgttcatggccaacaggtctatgaaaaattgctcaatatcactatgagggaaacgcaaatgaaactacagcgagttatcaccccacacttgttaggatggctattatcaaaaaatgaaacaaaagatagtcctcctatctaactgaaattctgcatcctttggccagcattttctcaactcctactaacacaaccacccaagacctttgtaaccactattctgttctctagttgtatagtatcaaccttttttgattccatatttgagtgagatcatgcagaatttgtctttctgtcctggatgaactcacctacaataatgtcctccaggttcattcatggtgaggcaaatggcaggatttcctttttctgtggctgaatagcattccattgtgtgtctttaccacattatccattcatccatttatggacttttaagttgatttcatatcttggctaatgtgaatagtgctgcaataaacatggtagtgcagagatctctataacatactgattcatttcctttggttatatacccagtggggggattgctggataataagaaaacaagcattggtaagaatgtggagaaattagaatcctgtacactgttgggaatgtaaaattctgtagcagctatggaaaatagcatagaggttcttcaaaatgtaaatatgggactaccatatggtttaacaattctacttctggatatgtatccaaaagatttgaaaacagggtctcagagattgtttgcgctcccctgtttgtggtagcatgattcataatagctaaaacatgaggtataaatatagaatggaatattattcagcctttaaggaaaatcctgtcatatgcaacaacatggatgaatctggaagccattatgctaagtgaaataatccatgcaaagaaaaacaagtactgcagtatttcacttatatgaggagtctaaaatagtcagacttacagaggcagagaatagaatggtggttgccaggagttgaggggaggggagaaatagggagctgctattcaatacctgtacaaattatacgtggttctagaaatctactgtattaaatcatgcctaaggtcaataatactgtgttgtatacctaaaaatgtgttaagagggtagatctcatgttaaatgttctcaccacaataatctgcatgggttgaattgtgtcccccagaatgatatgttgcagcactaaccctggtacctcagaatgtgaccttatttagaaatggtgtccttgctgatataattagttaagatgaagtcatgctacagtaggctgagttctacatccaatatgcctggagttttataagacaatgtgaatttacaaaggaagatgccacgtgatgatagaggcatagattggaattataaagttgcaatccaaggaataacaaagatgaccagcctcctccagaagctaaaaaaaggcaagaaaggttcctacccagagtctcacagggagcatggccctactgacatcacaatttcagacttctatcctccagaactgtgaaacaacacatttccattgttttaagccacccagttagtggtcctttgttatggaaactcttacacacatacatatatatatgtatatttaatagatattttaagaaatattaagcaaagtattaggtacaataattgctcaaaagcgattgttcctattttatatagtctaatagtggggaagtctgtgcttatgggaaacttttaaaaacatcaaacacttcctgtgtgtaatttgctaaagttaaaaatctgtaaaaccacagtgttcttgtgtagtccttcaggagacaaatatgtgcctttcttgacatggaagtttctttccacctcagccagtagcacattcactccaaacttagcattcatcatttatggcaatcagatcagtatttaggtctatattgccttgtagtatttatttttattttaaccatcttattttctttatgtatgtagattataaattcttagagggagagaattatattttatagttttgtaacatagcacctaaaacaggacgatgtttgatatggtttggctgtgtccccacccaaatctcaacttgaattatatatccaagaattcccacatgttgcgggagagacccagcgggaggtgattgaatcatgggggctggtctttcctgtgctattcttctgatggtgaataggtctcacgagatctgttgggtttatcagggggttctgcttttgctccttcctcattttcccttgctgccaccatgtaagaagtggctttcaccttccaccatgattctgaggcctccccagccatgtggaactgtaagcccaattaaacctctttttcttcccagtttggggtatgtctttatcagcagcatgataatggactaatatatgtgtgcatgtatgtgtgcgtgtgtgtgtgtgtgtgtatgtgtgtgtgtatatatatatatatatataataccatgtgtaacatttgaaaatatatatattcaaatttcagtctctggcattcatactgaaatttgtttgtgggtacctcaattggtcagcttaatgatgtcttcccttctcaagggaaggtaggtatattagttttctagagctgccataacaaagtactacagactgggtaacttaaaacaacaaaaatgcattgcctcactgtttgggaggctacaagtccaagatcaagggttggcagggctggtttcttctgtggatatctccttggtttgttgttggctgtcttctcactgtattgtcacatggccttccctttgtgcctgtgtcctcatctctactttttaaaagaacactagtcatattagattagggcccaccctaatgacctcattttaacttaccccttttataatccatctccaaacagagtcatattttgagatatcgggggttaggactttaacatatgaatttgagggagacgcaattcagcacaaagcacaaggcataaataacttgtttttgtacagattcttagctaaggaactacctttctagaaagccctgtgaaatattcaaaagtatatgaggtgacagatacatgaattagcttgatttaaccatttcacaatgtatacaggtaccagaacatgctgcacactgagaatatatttcatttgtacgtgccagttataccttagccataaattcatgtggatagataacgtttttctttaaaagcaaacttaaagaatattaatcaaagagtattcatatcaaataattactgacagtgttgttttccaacctgataattttcttgaggtaagaaaatatagatcacggctgacttcagcctcgactacctgagctcgagtaattctcccaactcagcctcccgagtagctgagatcacaggtgcacaccaccatgtctggcaaattaaaaaaatatatacatttgtagagacaaagtcttgctatattgcccagactgaataatatgcttgatcaaactgctaatattgatttggatttgaatatagtaatccctattatttcaagtaataatatcttcaaagtaatgaatgcaaaggagataaactgatatttgaacacactaacatgaccatttcaagaatatgacatgacctcttcaattgctccattcggcttttagatggaaggagaatgcattagtctcttacaggatgtactgtctttatctgaggaactttgaagagtatgaaaaacagctactagggaaaaaagaaagcttttatattctttgatgtggaggattctgtgattctaacactgtgattatttctttctgtaccagagcttactagcctacacagatattagaattcatagctatatgtaattcaaatttatttctgtatgtgagaaggaatgtgattcccttctctaaaaatcatttactgtatagacataacataacattatccctctattattggtagaaatattacaaatcttggatgaaattttttctcaaagcacaaatttatgctgctaaatatattgattcagatcagtctccaaaaacaacactaaataattagtagttttcagaaattttagagaaaaaagggaaaaatattcagaggggactttttaatgaactctagagacatacattaatgtaagtaactgtaagtcggtgatgttccacaattactttttactacccaccatataacaagattggatcatgtgaagtgctgtgcttaaaacttaatcttaatctcaacatatcacagaactacatttgccttgtttgccagtaattgaatattcagggtaatcactaccatactcaccaaagaaactaaggccagcctctctttcctgaatcttactagattgtagttctagaattggccttttctttcactcctgaaaataaggcattgaactgtgtttcagggcaggacccagtctttcctactcaccctactgtctctagatttactcagagctgtcccctgatggagatgcaggattggatagaaaggatgctttcttctctagaaatatggttgttgtggattaaaagtgtctggaggtgagggatagaagacttcacatagggtacagtgtatactgctcaggtgatgggtgcaccaaaatctcagaagtcacctctaaagaacatattcatgtaaccaaacatcacctgtttcccaaaacctattcacgtaaaaaaattagagattcccaaatccatttccagtaagtctgaagtagttgatctaggcaatttgaagaagattaaatattattaaatactctagatgattctgatatggatgactaagagccctactccaagacaggctcagaactccagaatgctgacagctgaatgaaaagggaacatttgcttctcagtagaaaccaagcagtattgaagaggtagagggctagagaggaagccaagaataaaattccttaaaaatgaatgggtgcttctgatccaaaatgatttttcagaatttactacatatataaggcagcctatccccttttttatgagatcagttttatattgggaacttctcacattatcatgtctttaaaaaacaaacaaaaaataaaaccttcgcagaggcactaaaaagagagtgtcttttcaacaatcatgggagttttttttttttttttttttttttttttgaagttttaagctacttatttattgtttgggaagacagtggtggatgtacttcttggaacattttaacttagtttctaaaacagctttattggggtataattgatataaaaacagcatacatatttaatctatataatttgatgagtttgaacatacacatacatctgtgaaactttactgcaagattataataaacatatccatgactctcaaaagtttctatgtgccccatctcctattttgttgtaaggacatttaacataagatctaccctctaaacaatttatttatttatttattttaataatttcaagttttgttttagatttaagaggtatatctgcagatttcttacatgggtataatgagtgatgctggggttgctgcgattgaacctgtcacccaagaagatagcatagtacccaacagtttttcaacccttgctccctcctccttacccccttgtagtagtcccaatgtttattgctgccatttttatgtccatgtgtgtccaatgtttagctcttacttgtaaatgagaacatgttgtatttggttttctgtttctgaattaacttagaatgatggcctccagctgcatccatgttgctgcaaaggacgtgatttcattcctttttatagctgtgtagcatttcatggtatatatgtacaatattttcttcatgcaatccaccatcaatgggccataggttgatttcatgtctttgctatcgtgttgtgatgaacacacaagtgcatgtgtctttctagcagaacaatttactttctttcagatatctacccagtaaagggattgctaggttgaatggtagtcctaagatctttgagaaatctccaaattactttccacagtgactgagctaacttacattcccatcaacagcacataagcattcccatttctttgcagcctcaccagcatctgttgttttttgactttttaatagtagccattctgactgggatgagatggtatctcattgtggttttgatgtgcatttctctgatgattagtgatatagattggatatttgtccctgcccaaatctcatgttgaattgtaattcctagtgctggaggtggggccaggtgggaggtgtttagatcatgaagatagatccctgatgatttggtgctgtcttcatgatagtgagctcttgagagatctgattaaaagtgtgtggcacttctccttccccctttctttctctcgcttgcacctgctttcatcatgtgatgtgctccctctttgcctttcaccatgattgtaagtttccagaggcctccctagaaaccaagcagatgccagcatcatgcatctgcagaactgcaagccagttaaacctcttttcattatcaattaccttgtctcatgtatttctttatagcaatgcaagaacagcctaatgcaattagtgatgttgaacaatttttcctgtatttgttggccattgctatgtcttctcttgacaagtatctgttcatgtcttttgcctcactttttaatggggtgattgggttttgcttgttgaattaactttcttatatattctggatgttagacctttgtcggattagttgcaaatattttcttccattctgtaggttgtctgtttagtttactccgttgataatttcttttcctgtgcagaggctctttagttcaattaggtcctacttatcaatttttgtttctgttgcaattgcttttgaggatgtatccataaattacttcccaaggctgatgtccaggattgtgttttctaggttttcttctaggattattttacttatttatttatttatttatttagagacagggtctcactctgttgctcgtgctggagggcagtggcacaatctctgctcactgcaacctccacctcctgggctcaagccatcctcctgcctcagcctcataattagatgggactacaggcataggccatctcaataagctatttttttaaaaattttttgttgagccgaggttttgccatgttgcccaggctggtctcagattcctgagctcaagtgattcgcccaccttgacctcccaaagtactgggattaaaggcatgagacaccgtacccagcccttctaggattcttatagtttgcggtcttatatttaaatatttaatccatcttaagttaatttttgtatatgctaaaaggtaatggttcagtctcattcttctgcatatagctagcctgctattccagcaccattgattgaaaatgaagttctttccccattgcttgtttttgtcagtttcgtcaaagatcagatggctgtaggtgtgcagctttatttctgggttccctattatgttcccttggtctatgtatcttttttttttatcagtaccaacgtaggccttggttactagagccttatagtatagtttgaattccattaatgcaatgccttcagctttgttttgttttgcttaggattgctttcgtcatttgggctcttttatgtttccacgttaattttagattttttttttaattctgtaaaaaatgatgttggtagtttgacaggaatagtgttgaatccatagattgctttgggcagtatggttgttttagtgatattgattcttcaaatccatgaacatggaatgtttgtcgatttgtttgtgtcatctatgatttcttgtcattgtgtgttgtaattctccttatagagatctttcaactcacaggagtcatttttattccagcttgctccctttttttctgatgtgttctcctttctgcctggtaggaatgttcctgctgtgtacaatacaggggatgtgtttagaggtggcaaacttgattaaatatatactagaaataaataatacaaacaagtgcacttagatagaagacttttccaatctgtattttgtctaatataagcattcttttaatttgtcttttggatcatcatttttgagggaatcttattccaataagctacatgcatcatctgtcattttgttttcaggatttattttctgcgtcatggagattagcttaattgtgatagatattttgttgtttttttcatatatatgattttcttttgctcatcatttctattgatctatgctcctgattttagtaattaaaacacagttcagtatgctagcattttcttcagccaaatttaataacctgtcagattcttatggtcacaattaagagaaaggtgtttgtaagtgtgttaatacttagatttctttataattaaaaaattatttgattggctatgctggatttatacttaataatcctttgctcatgcatgtcggtaatcttcactggttacccaaggttcaaacccttttaactagtgtaagcataatgatatgtgcagttataattggtttcagtaacaaaatttaagtcagaattgtagtataataaaatcacagttaattcttaatatctccatattattttacatttgtaagtcattatgattaaggcagaatgttggagcttactgcaaaatttctttagaaagaaaatacttttcctaagttcatacagacaagtttagatattagagtttgaggcaggtaataattggaattcttcagttcgctgacaatattgatatttattttcataactttatgcaaatattttctttaagtactaaaaagatgtaattgataatgttcacactggtcactttcatgacatctgaaattttggcatgtccctaactttgtgagagacaaaatggtgaagtgattaacagcaaggggctaagttcaaattgtgactttttaaaacttcagtggcttctgcaaaatggagaaaaaaatcgtttgtactttgtacaggattgatttggagggattgaataagatgcaggtacatagaaatcactcaggaaatgcagcaactcttataattaatctgctatgtgtcccagcccatagtaatgactgattagttttctgtacctgtaattttaccttggcaagaatgttataaacataaacctactctcttaagtcttgcttcttctttcactaagcataatgcatttgagattcatctactttgttccttgttccacatattaatattattttcctttttatgccaagcagtattctgttatatggatatgacacagtttttttattcattcctgtttgagggatatttgagttgtttccaggtttggaggattatgaacaaagctacattaagctacataatagctacataaaagtttttaggtgaacataagttttcatttaacttgatttaatctctacaagagggatttctggtttgtatggttaagtgtatgtttaataatataaaagaaaaaaatccttattcccaaagtagttttactatttttcattcccaccagaaatgaatggaattttccattgttccacattctctttgttacttactagtttcaggattttgtttgtttatatgttttgccgatctaataggtatgtagtagtggtgtatttttttaataataaatgatactttaaagcatattaatgtataaaacagtctttaaactaacttggaattataaatttgtacattttcttttaagaagacttcacattttcttctttagatatttccaggggagaaactttttgtgtttaattttattttctgtgctaatgtgagatctctacagattcaaaagtaaataagaaacggtttctgatttcaagttgttcataatttgtcaaaggcactgaggtggagcccaaaattttggcctcggaatatattggagagaaaacagagtccagtgtagcaactgaatggataaatgttgctgattggtgaataaggattagaaaagtagttgtgatgttcataacaataaagtggaagaaagctttgaaaggtcagatttagagattgaaaaataattttatttttgagctagctacaaaaatgtttattcttttgagtttgctttaaagccctcaggcatgaacgatcatgtatttacatctgtgggaaaggtggcatagtgaactgtcggagctagaagaaccaaaaagaggaaaagagcagtgcactaaataaatccttagacctatgtcaaatcagatcggcaaattttgttcacattatgattgatttaagtatcaataatgtttataaaagtttagtagcttatctaaattcaaaataggggttttcattgttttctttagacatatacgtcaattcctcatcccactgcccatggcaattcatatctcaggactagtattggggcatttgtaagattggctttggaaattcctctctgggttataatttatacaatgctttgcccacagccacatataggtatatttattcccttgttcacatcataaaaatgagctgaaattaaacattaagtagaaaatatgagaacaatgaaatgctatttaaacaaaagggaatatcactgaacatttggataacagggagcaccaacaaaggcaaaaagaaagaaatggaggaagaaccatggaaatgcatttgggatgtttgttactctcctatgtggttttccttttctatctcctctaaaatttaaattttcttgttatactcatttttgtgtaaatatgaaaaaagattataaatatacatcactgtaataacatagctaaatttaaatggtaacaaactattttatggctgttcaggttttaaattaggatcagtttatgttagcacttgcaatttgattctaattaaatgcttccaatttaaatgccgtacatagagtctattttctctagtattaaattctttatacaacgtttattgtctgttctttttcttttcctacaaccaccatttttgcttgccttctacatgggaggaactatgaaaggctgtgaagacacaaaaccaaataagacctagttcctaacttcaaggtgcttacagtcaaagatgggatagtttccatgagagctcctctggaaggagagacagatgttgagtcaataattcctgtgctgcattgaagggtgggtaggaatgcttcttccctcacaggaaacagcaaaaggaagctgtgaactacatttttggttgcaagcttggaggcagaggatactctgcgtattgtttttgtattggaaagatcaaagcagggaataacagaaaacaggccacaaaagaactcacgtgtcatgctacagacgtaccaatctacctgccacttaccgagtgacagccagcatcttctgttggtcaagggtaaaatataatggtttgtggaaccaaaatgcctggctttcagaacttgttctcacacttctcttatatgtgacctcctgttctactcctcaattttctatctgtaaagggaagtgatgtgaaagagcctacctcatgaagctgttgtgaaggctaaatatgtcaatgtttgcaaagctaagaaggctgtggccacattgtaaggacttagtacaagtcagctatcatttttatattactacattggtcagttaattcttcctacaattttattaggtgagtgttattgcctactttacagaagaggaactcatattcagagactttacctgataaagctaatattacatgggaagtaaacggtaccacctaacaaagagctagtagagactgtctttttctgcagtaaggaaataacgtctcaaagagtattacctctgtaactgtttggattagggaatcattgaccctagttacgtaaaaaactccaaatgaagacaaggaaagtaactagcacattgcagagatttttattttcagttaatgtttggaaactcacatctcacagcccaaaatgtccatctaatttatcagcgagcattagagctgattggatgccttgtcatgcaaatatgaacaaggaatctcatcacagttgaagagcttggaatgtatgagcttaatgcatgtctactcagtctgtacatatgaaacatttagtcccttgcttggtatagagcgtgctctcacatgcagccttgtgatcacaatctcgatgcctgtaggagccaggcatgagggcgctaagtgaagcagctggcctaattctatgtaggtttcttaaatttatttttggggtacagtatcttcttctttgaatttatcttgatgcacgtaccccctgtgtttagctttaaattttccacttctgacgtaggcatggatataaaaaatgcttcacctacttcttaattacatactaataaataaaataacacaaactcgatgatagcaacctccagtggcagcaaaatggtagagaacagggcaagtaatgatgaaacagatactatgtgtccaatattgtcagttttcctaacttttacccaaagccagaggagtgaattttttgttttatcttattttcctttgtgtgaataagtattcaaataaaaaacacaaaacaggctgggttcagtggcccatgcctgtcatgtcagcactttgggatgtcaaggcaggagaatcacttgaggccaagattttgagaccagcctgggcaacatagtgagactccatctctacaaaatataaaaatgttagccgggcattgtggtgcgtgtctatagtcctagatgcttgcgaagctgaggcgggaggatcccttgagtccaggagtttgaggctgcagtgagtcctgatcatttctctgcacactagcctgagcaacagagcaagagcctgtcaaagaaaagcaaacaaacaagcaaaaaaacaacaatgaaaaaaaacaccacacacacccaaaacaagaacatcaagacaaaacattatatagatcaagggtatctgaacgagaaaaaacaacaggttgtttgatctcccagttagccttcttctgtttaggtaaggagaataccagcagagttttcagcaggaaagagaaatggttaggtatgcacgctagatacatcattctagcagatccatttgtctacctgttttatcactctagaggtggtactgaaactatggaagaagatatttctagaaaccacagatatagtggaacaaacaaggaggctatggcttaactctgggtaaagccaataataggagacaagcgtccatgcaaaaaacaataggaatgatcagagaggaaaagtaaatttaagtaatttaattgcttaacacacttcagaaggacccagtaagataaactttgaaaaatgccattttgttttggcaccttgaatttactcagaaatggatatgagaacttttggtagagtgaaagaattataatggctgatgtatgctattcttttgagaacttagattagaaagaaaccagtgatgaaaatcaatgcttagacagtgaattaagtaccaggaaagggtttatttttacaaaagggacttaaaagtgtttattattagagttatgtctctaatgtttacccaaaaggtggaaataaattgccattttttagcaatgaccaaaatccaggtactgatgctccaagtgttactagattatcacattaattctcacaaccatgttgaaagatagcttaacattctgttttagatgtagaaaacttaatttcaaagacgttaaatatctttcaggaagttccatgaagctttttaattttaatttttaaagtgacataaaatgtatgtatttatcatctacaacatgtttgaagtctatataaattacaggaagttacatgactttataatcagtattttttcttttgtttgccatccactcaatagtggttctagaaaaaatgtaagtgaatttagaaggatatctaatatataattatgaacagaagacaactcgtctcttttttcatcgcacactgccagaacaatatattttacttttaaactttagtattaaaactgtagtacgtgttttatttccttcctgcatatcatagttctatgtttgtttggaaattaaatcattaaaaagtttttctcactttccatccagataaacaaaaaaaagaatggttaatactgatacttaataataatttatattttgttatcaataatgaattatattataacatatatagcttcacattttgtcaggattaaattactttcatttcatttacttgcaatgtgtttgcattaattgaaaaacgtgggctccctcttgtgacaacatcaatgattctatatttcttttggagccacactaagtcacctgtctatgttctttaatttttcacaagtaaagttatatataattttatataataatgtaatagtattctttttttgataattcattctacttttttaaaaggaggccaatatttgataatatttgattctgattattgtttaaagatttatataatatttaaaaatattgattttcaaatttatattgaaaatatcaaggaaaacaggaaatgacaaatttagatttccttgttttatattttatatgcgatattagctgttttggttggcattccaagatatgcacataatttactttatattctacgtgttccctgtgtttgatatgtgtgcttatatttctcaaaatgcatggtgctcctctctgtttttctctgcaaactattcatgtgtattatttccacatgcctcaaggaagtagcatacatattgaactacccataatgggaatacccataatgagatcaaagaaagaaaaaaaatcatagttcttttttaaaaatgaaagcattatgtgctgtttataaatgtgattgtgtttgtgtgcttgaaagagtatagtgggtgcaaaaaaaaggaaaaatacagaatcgttatattcatggatctagctctggaagggctttttagggttatttcaatagtacgctgttaattaagagacctggatttaatctttgctgtctcatggaccatctgtatgggattgggcaagtcatgtttcttcctggtatgtcaattttatcatctgtttaataagataattgcattaaatcaacttattctctgcatgaacacatctgtaggaaataacatattttcctggctcagttgagtattgattattaagaatatgtctgtggggtgatggaatagggactttggtcgtggcaggctgtgaatataaagttgtcaagagagagggctgtccaaggtgaatatgaaatttcaggagctgagggggtgccatgcagggggcattcccattccccacttattaattataaataagcttgattctcagttctgttatccaagattctgtaaggccaaaagcattttggcaatgccatactgataggtaatatgagaaccaaaactgcaataaaaattgttaatattttttatttctataattcacacgctaccgagcattttgccagagtcaaaaaatataggctgcaaattgcgcactaatttcaaaagcttaaaatgcagttcaggagttcccctttccaccccaggtcccatcagtccacatttttttgtcacaggtctgctttagttcattatattacttgtctgattccaggagacatctgagtttgtggccctaattaacatatccgggactgttttttatgacctatgtaactgttgttggatttggttctgaggacttctgtgccacctgctccaataagactgagacacagactcttctagggagcagctgtcactttcttcacctactcaggaacacattccggttctgaatcttcgtgtctggatcccttctttcctttctttcatattcctgcattcctctctgttttgggtgatacctaaatgcgtggcctgcttggtcttggagctcacttttgtttcagcatgccatgtctcaggtcacacacaggcccacagtgtgtggcccacagcccagtctctccctttaacctctaccttatcctaggcctgatttgtttgagagagtaaatcagtctcaggctaggaatgaacaacagcaatgggtggctgtcctctcatggttaacacacttccatccattcattccttcatttacatcaaaaatatttattgaatgactacggtgtattcattacattctcgttgcttcaagaaatttgtgattgaatgaggacactttgtgggaagctcaggacagagaactggttctgattgctcaggcagatgtgacaaagtaacgtggtactttatttgggtatattagtgtgaatagtcagagctgaacttgcagttatgtgtttgttcattaaagaaaatctatggttcaccttctacatgaaaactgttttaagattctagtgagaaagactgacatggaggaagtgaacgcattataatgtataatattacaggggctaggggaagaaaatgtaaggttttgtgtattagcaacagagagagcgagagtgaggagagagagagagagcactgcctggtaatctttgagagaaagattttgtttactagatcatttgtcataacatatagttaaatttatacatgagtgaccagggaataatgtcagttttctgttaaattactggtaagggactccaaaagggaaggagtggcctctcatattatctttattagcaaccaccctccagcccacccttccacacatacctagtgtcatatcctaagtgttatgtatgtatgtatggcttgtgtttgtgtggaggtgtacaagcatgaatgagtctatgcacaaatacaagccatataacgttgtgcctgtggtgggcagagagtttaagcatgctccaattttagttgttgagacgtttgaaattatgtgcaactcatggacaatttcaatttgataactcgttaaaaataatgttagtttttaaaaagatacctattctcttgcctcaattgcatttctgcccccgcccccatatagtgcaccacttatgaagagaggtgatgaaaaaccttcatacaggattattcacttgatagaattgttgtcatttaacaaagcactgctacacgctttttcttcagtaagtaactaacttcaaggagtattgcctctattaactctctgaattgtgggatccttgactctagttaggtaaaaactgcaaaatgaagacaaggagaacaagtagctgtcttttttgactcatagagattcatacattttgtttttaggacctcacctcttatagcgtaaaaatcttgggatatatgagctttgagtatgtccattccctctatggattaaaaaccctgagtgccctgtttggtatagagtaggtgttctggtcatgctaggttcttctcctttctttttactttgcattcttcaaaaacaaaacaaagcaaaaaaccgtcagaatctgcagcctgattataggtaacttttatcctcaggtgtcatgttaatatgcgaatatccagcaagcatgtggtccaatcccattcagataatggaatgtgagtattaagcttgtagcacagggctttgttagctgttagtttttttgttttttttttttttttgctggtgtgctaattgcaaagtgatctcctctcaggacattaaaaaataagtccttaaaaaacataagtttgggtcacctaaaatctgtgtgtatttacatttcttttatttttttcttttagttaattgctattttaatacagggcagagcaggactgcaggaggtgaggtccccttagcaaatggcaacagtggggagctttgaagcacttagcacccactacagcaggaagagcagggatgtcatgttccttgattattcctggaaaagaaaaagcacaggatcctccttgagtgctgcttgcaaagctgtctcttaaaacccctttcatttatggttgtattgtgccttccaccttaagtgtccctgtatgttgtttgactaaatctaggggctgaaaaagggattttctccttttaactgtttagtgccttcatatagtggttcccaatcctggctccctggcttagcttttggaagctttgctccccctgagactttctaaatcagaatttctaaacttcagcctcttgaagctaaggttcagagccaatgcattttcatagaatggatgtttagtaaatctcaactgagaaacatggactgaattaaatttttatattttacctgaaatatactctctaccttgattgatttgttttataaattgtattcctctcatctaatcttttgaatttgttcataatatgagaaggcactaagatgaggtgacatatggtagtatgttgtatacatagagtttctctcacttgcatcattattgcatttaccacattttttgcaaatatttaaatcttcagtagactaagaaatctataattcagggaccatattgtcctcatttcatgtcccaggacacaggctcatgtctgaacgcatagaaggcgttcagaaaaaaaaatgaacaaatgagttatagcattgttgtagatttgtgtctaaaatatatatgaaaagttctataattattttaatttttacatataattaaaatttatagatattgctccagaaactactactaaaatgatacagcttatgttattggatcagaattctataaaactaataaaggaaatataatttggttttgatgcagtttacatatatattagggaatgattactaaaaagatgctttttagtaatctgggagaactgggaaacttttgacaggggaaatcaaaaatttgcagtccagtgaagaattaaactactgggagtaataatatgggctgatgcactcaatatagcagtaatgccctctgagaaggataggaaataattcagttcctccaggctgcatggaagctaaatacagtatgacaagaaatagtagcagtactcattatgtctgattgctaattacctctttgaatgattcagttatgcctgctactagataattagtttagtaatttatggctgcggcacaaactagtattttaatttttgcagcaccattttcacaatacctacagttcagataatacctttttaattcaatgttaaattgcttttttgaagacctataaaagagcaaatattcttgcatttttttctacttgtatttcatgaaaaagttaggcactttatggaattttatttaactttaaactccagaaaaataacatcttcttaagtcatgtcttattatggttaattttgccaattttgtgggcaaaggggtgaaattttcaaaaagattccatcaaattactcaatataacagttgccaaatttcatttttcaaaaagacattaaaaaattgataataaatcttttctttttacacatttctacttcatacatggggttctgcttatgtctgggtgtctgttcccaatgctcaggagctgcaaactgagtacagcttttctgcattcccaaccaatttggtgtggtccacaggcaagtcaaaagctatcagattaagtaagaatatttcaagtaagcatttccaatttctattcgggtaaataagattaactctagccaaagagaatataattgagtctctatggcttaaagtttggccttgggtcagtatcctcttgaattcacttttttgttctctaatattccaactatatttctgggttttattggtgaaataaatatgtaattatctaaaattattttgtcatctttcataaacattcatttttagttccgtatccccactactctagtgcagttagtgatataaaaataaatcagagcaagagagagaaagacggaaactgatatagtatgctccccaattctgatgactgtaatatattttcaggtcacagcccaaagacaacattgatcaattaaattcacatgacaatttcaacttactcatatatttattttcatttatatacagaatgtacatatttgccaaattgttgagtgatattgtgagttaggaattgattttaaaatatcccttgcctaggtgttggattatcaggcttgaattcttagtagctgatggaaaagttgccactttaagatcaatataattaagactagataattttcacaatgaaagagagcattgaaatgcttagaataacaaataaaattttgcattaaatactgggttttgccatccctaacagatcaaaatgaatgctttaaaattaataaggggcactgctaaacacattgccttatggctaagagtttatacctagcatcttaaaattaagaatatttggcattacttattcccatttgctttctacttggtgctttgtttttctctataactcaattacaaaatgctcatggttttatttgctatgttgttctcatactcgatatttaccagtactggatcaatgttctaaagggcagccctgatatttcagtgaacatcaggctgatgtttattacagaccaaatctgtgccctttattgccaacagtcttactggaaatatgtgttccttgacccatttaataaatggttacccacagatagggcagtgtgactctttttcttccatacatgctttttaacaaaagtttcttacccgtaaggcagtctgtctaaccatcaaaacatcatattgacctttccaactttgctcagggtgacagcttggtttgttgttgatactactttttttttttttcccctaagttgctaactagagctctcacaaagttatgtgctgtcagagtttgaggcaagtcaattgctttagattcataattcattctttttttgcttgttttaatactatttatattctaaaataaaatgtagcccttataaagtgtataaaagtatcagtattaaagtcaaaacttataggtgattacctcattgccaattatgaaagtccaataatatattttctttttgtctatattaggaaacttttttggttctcatctcactagtaaaaaataaagtaagcactggttatcaatataagggtgacacatttataaatgaattagcaaccaacaggtagtactctttagaaggaagatgctataatgcctgtgtttcccttacaagtctcagagagctgaaattttttaaagagttaaggaaatgttgccaaagctttcgtaattgcattgttcagtgaacattgttgtatttagcatagaactgtttatgtatttttgtacatttctttcattaccttcttttctaaatataaaacaggatagatcactggataaaaatatccaaaagaaagtcaaagcctttatttttgaatttgtgtatatatgtatatttatgattaagatgtttgtgggcatttctccttaaagggaaattcagccaatttcctgattttatattcttgatataaaggggctgtgtttacctcgtttgaatacactgcttaaaatagatgcagtacagtatttcctactgcgtctcatcagagcttttaaagaattaattagactatcatagaatttgatactttggagtgctaagaattctcttcataatttcttgatatgtgatattatgttatttcgtttgagcaagtagcaattttaaacacatgtgtatatgtccatacaaatataatagctctttggagtttaaacaaatgcatatatataaacatatacatatatacacacatatataattagagctcttggctatttagaagcttaatagcacatataattctatctcaagaggtgcttaacaatttcctaaactggagagccttcaatatgtctacttcagacatgatatctatgaaggtaataggatacagaaagagaaaatatgtatataatgataggagagaaagcagtattttatcatgcaattgatttatttgtccagttaagcttgttgagctacaaatcaagaacacattttagtataaacaagaccaaaccagagttcaggtccacagagtttaatatctaacgagagagagaaataaacacatataatttacaaacaactcaaaacaagagattgcaatcacagaaatatattcaaagtgccaaggcaactcagagaaaggaaaggacaattaatttaatcttgaacaattgtcttagactgatgctgatattgtctgaattcagggacacagtgtcaatgacattgaacatctcttattcagaaatgaattaaataagctgactagtttcattaatactatctcaaacaacaggttttgttggcttaaaaaataaaatcttggatgctctgagagcatgtaggtagaagcagagaaagaatattttaaagccttaagtggaagcaaaatgttgcctaccattttgcaaaattgggtactattatttttatttgtttatttataccaaatccagatgtaggctaattcaatctcaaacatgaaaggtgggcagattttatcattaaggtataaagtcatgctgaagattacatataataaatggacttcatgtacttccagaattccaatgtcagaagtaatgcatctttggtatcaagtcagtctggacacttctaaaaacaaaatgaatatactgtgatgtggggtgtgtgccacgtgggcatcagcaaggaagagatagattatctttcaggtagggcagagagcatggatggaaagctagctagagcagagtcagagtcatattttagagatgtaagatgggggaagtggtgactagcatcaggtagaaaaatacttagatttctagaagctctgtgtttgtttgaggaggtagggcaaaccttttttaaaaatctggtatcaggtcaactcttcccagaaaatagcacatacatgcacactgctatacataacttcataggcttcatagactacttgcgatctttaaggatcaatgagtttaagtggaggaagggataatggaagtagagtatttaccttcatttataaagagcctcacattttaaatcaactcgatttgtgttcgaggtggggtccttgttccaaatggatactacagttaaaactacgagctaggggccacatgcactggctgaggctttgtggccacctctttggtgctctccttcacttggcattcgccttcgcatctagttaaaaaacatttcatacatctactctttcaggaagctctcttttaacattcaatgttaggtactttctcatcccaaaagtctctcccacaatagagtcacaacttctatggaaacaaacaatgtctcactcatttctgaatccctgttcccaacacagtgcaaggcatgtgggaggaggtactcaggaaatctttattttatgaatgaataaaagctaacaattgtgtatagcaggttttgctatgtactagaaattagaagtagagaatactcttcacactgcagaaagactatatcaatgcgtaaaagattcacataatctgaagcaagttattttatatggaatgaattggggtaactatacatagtataatataaaattctttgccatgcaaaggggaataaaaatgagccaggcgctgcacagaatttgggaacattgattggggaacagttctgaagtagaggcctattgtgtaagtaaatctctggctgagttcatcggtctcctttgattgttcagctaatgtcacttcaaaacagactatgctttcttcatgttaacccttttttaaaaaaattgaaactgttcagggcttcaagactagataaggtataccttatgtctggtataaaagataaggcattcactgtggaatacaaaaccagaaaagtggcattatttttttccaaaaggaaaaatgagctcattatgagagaagaagaaacctttcatcagagcaaagaaaaataggttcaaatagaataaatctgtgatttagccattttccaaaagtactgagtttttgctgaaagaattatcccaaattgctcagattttggtgtttgtagagaaaatatagtttctataggattctgttttcttcatatcaaagaattgagccattcagggtttaaatattgaaaaatgaatttaacctagacctaatagaagacaaagtcaatcacaaacatccataataatcaaatgggcaaagctctcttacatgtatttattttcttaaacattaacaaatcaattcaattattcagtctcttgctttcaggatctctagattaactgggctgaaataatccttaagtccatttctatatacatttctgtatctgttttatcagaattcttggtatcttgggaatttatttttcctgaaaacaatttacatcagaacttaaacatgggcagttcatctagtctgattgcctagaatcttcctggtttcatctcagttccactctatcttcagccatgctatttcctctgcttagtaccccaacctcaacctcaaatctatctgataagtagcccatattgtttctttagaactcaactcaggcataccctctctcttctttcagtctattttagatgtatttttctctctgttccgagggtaaaatgtacacaattataaaatgtagtgaggaagagagaccaatggggcagagagacaagcatgtagctctctgaaacagactgggtgaggtgttgctcactggtgcctagcacagatgttggaccattgcaggatcccccaaaagtttttgaatacattaaaaaatgaccttttaagctgcaatcatatgccttttctaagcactgcacattaattaactcgtttaacacaacactcatccgaatttggtatcactgttataccaacaggaagccaagaggatactaaggttcaccaatggtgtatgacttttctgtagtcacacaactagtaagtggcacaaatgcaatactactcctgggcatccagcccaaaccaaatgttcttctttattatgctccatattctgacctgattatattattgaaggtactggataattgagcttgcttctaaagaaaaaaaaaggtgaatgaatgattcattgtctgtcatgaattccctaagtatttattaacctctctctagtcattaattcaacagataatcattgcgttcctactatggcacaggcactgggcatctacaaaagaataagatacattctgaatacaagtgactgagattcagaaggggaaagcatattatatattgtgttttgttcacattgcatcataggaagtttcagcctacattacatcatcttagaataagtacaattacatcagccagaaaatttttaaattaatattctttatcatttaggcatttaactctgacaaagatactatagtacattttgtagtgaattgatgtaattgccctccttggatactcaattttaggagtcgctttgagcatccacacatttctgcagtatacagtttatgaaacttaccagaaaataaaaggaccaatctaaaataaagaatctctattgtatttttctactgacaatgcaaatgcttatcttaaaacatctaattttttcccccttttcacaggcaagcacaactgtaacacttccagaatctcagttccttgccagttgtcattctgaagcataaatggaatgcagggtttggaagttgtatttgctctgcattaacaaaagaagtaaaagctgtttttccctcacccctaaatgatgtaccataactcatagaatagacaagtagtattacaagatatcattttcatagacactcttctaaacctagctctggataatataaataatagagttcactttaaaatttttaaatactttttgatggcagagtgtctttcatttttgttttcattgataacgttctctatccttaaattaactttaatcatgtaggccatgttgccttttaccaaatgtctttagcagttctaatgatatacaaagtgttgtttttgcagtattttgaaaaagggacatattaatgtttcacctttagaaagtttttttcacaagaattgaatcactttctgattgttctgtatgacatcattgtagatgtataacactttttggcttatttaagtttattttaagcattctctaatatcttacgccttgtcttaacctcagtattaatcctgttgattacataatttgtattctttgaagcctatttcattatttgcacgtctttctcctttctactcatcttgagctgatgaacttgaattacccttttgctctaaaccttaagtcagaccaaattagaataactcctcctttttttctataattatttttcctttcttgtattattactccttaccacattgtattgaacttgtttaggtaattatctgtcttctaaattatgctgtgtcattgacaagatatcaaactgtatcttatttacagaggatattttatgcttttagccccagtgccaagcacagcttctgacatagagcacatcctcaagaagcgttttttaaattgttgaatataaatagcctaaaagaccattggcatctgatcaaaattaatttttacagccaaataaattaacatcatgttgacctcaacttaattctttcatttgtcaggaaataaaatttgaattgtttgaaataatcaacttcatctgtactttgctctaatagttccttgcatgtgacaattgatggtttgctatttaaataatattacaaatgtcaaagatgataaatgtgtagtcctccatcttcataccctggctgagtgtagatattgtaaaaatgtccatttaagtaaaacaatgagggcataaaagtacaattcggtatttccaaccatgactcaaaattaaatcttttcaacacatgttttaaagaacacatagggttctatactgtatctagaatttttcttatattaattgttgattatatcaagtcttgagtcttgtaacagaaattcattttatttcaaatttggactcacatgatactgtgatatgctttcccctaattacagagctcctccattatctttcctttctttcttcttgaggaaaaaattcactgaaacatgttttaaggacaaaagatttcaaacttataaaaatatttcagtcttataaaaagaaaaggtaaatcaaagttggaacctaatggtcttcataatgccactaaaagttcatagctgataggaagaatgatctatcacataaaaagtagtttagttaacctaacaaaacaaaaataggttatattttgcttgtatggtattaaaatataaaattataaacattagtattgataaaggttatttctaaagccatcttatattttaagtagatgattttcagcagatcaccttctgtcttagatgaagtatgtatgtacttttttatttaaatgaaatgagataccatgagaatgaagaatgctctagggaataaaaatcattatgaattattaattttgattatattttaaaattaaagcatttgttactaaaaaatcttgaaacataatgtgacaagaagtaaaaataattaagtcaaacaaatgcaagctaatttataaatattttataacatttattgagtttctagattgtatatgaaactaatggaacagatgtcaacctaacagagaattgtatgtagtatgataaggcaatgattaaagtctacaaaagggattattaaatcatctaaaagggacagttaaccaagactgagaggtctaggaaaactttttagaaaatgttgcatctgagttgaaacttgaagaactaggaggcataacaaggcgaataggaaataaaaggaaatacatttcaaagccatgattagaagattaggacaaacatggtcaatcagggaattgtgtgggagtgtaaactgcaaataaaagtaaacaaacataaaatggggaggcaactgggtttaaatcattaaaggtgttgtaggtcatgttgaggagtttatcatgacagcaatggggagtcattgaaagaggttaaacagaagtaccaacaccagtatatgtcctttgcaatggaggaatggaggcatgggtggtaaagatgtttctaactgtgggaaatgggagccaagggagaggacagtggattgagagagtttctgttttgatggcttctattttctctataaataaaattgctgaaatcatctccagtaagtgagagagaggatagtggagtagaatgtttatggaatgtggtgaagacataaaatatcatctgttgggaaatggcactgagaactcatctgcgaagctataaggaatgattgctgggtgtgttgaacttcctcttcagttttttaggacactgcttcacatatttcttctgcttctttggaagttcataggaaaggacagaaaacacaaattcttaaactatagaaatctagataggttgatacgaaatttagattttactttatataaaaaacaggaacaaggtttaaagatgttgaagtgtagtcgaagcaatgagatgtgagattttggctaaatacagaagggagtgaaatgtatttgcaagtatacaaatatacctggaggttatacacacaggtatgaaaatcttgaaaggataaaatggtattttgaaagggtagaatataggattttaaaatgtgcaataactgaggagggtttaaataaattatggaagatctatatttgtggaagtctaaatgggtagaatgcttatggaagcaatttaaccttgtccatcaacttcaagtgcaaatatcattcaacccaaaaattccactcctacaaatttcacctccaggtatatttgtatacttgcaaagtgaaggctgtacagggtattttgttgctgcattgttcgtaagagtaaaatgcccatcatagagaattgcttaggcttattatggtgcatccataaaaatggcattatgaagctgtaaaaagaaatgcaaaaactctttatggatgtaaaatgttcttcaagatacaaggttaattaaaaaagaaaaacatcaaggttcagaacagtgtggtataatgcaatctaaaaaagggggaaaagcctatatatgtatttgcatacctgtgtataagatactttcaaataaatgtatatgaaaataatataactagttgctgatgagaagttggagggtcggggaacaaaagtggaaaaagaactttcgtggtcatttcattgtatattttttcatacagtataaattttgaattagaatgtattactatggggtaatttttaaaaatcaaactatagatataacaaatataagcatataagcttttgtaaatcttagtagcttggaaatatattcaaaataatgagcttagggcagggaagaaaaaaattacacaagaatatacctataacactgacataatgcaggcatagtaaaatgataagagagtacacccaaaatatcaacagtgtttgctaaaggtggtaggattggattgcaagcaatttttattctttgcattttgaatatatcttagtgcatatgcattatttacatttgagcaagttggcccaatatgctatgaatgttattactaaaggagaaaaatttctaaaagattactctgagataattcctgagactccattcttttaaatgtggaaaccctgtttttgatagtttgcaatgaaatataatacagagaaatgtagaatcttctatgataccttccattttaatcaaagatcaaaatgtgacagatgtgcctgctaagaacttttatctgttatcataaataaaatgcattcactcatctaaattaagagaatattgcaagaatgaggctacaagacaaatctaatgaagggtaatatagaatgtcagaaggcccacggaattcacaagtaaaatgaataaccattcacttttatgttttcagcataattgacaataaaggaataacttccattaaacattcagataaacaaccatattctctaagtacagtgtctgcaaaatcttgttttctggtacaagctaggaattttagtacagttgtaaaatcttctgaaacatgtctgttttttcagttaataattcacaagtctattaaatgtatggtcatgagagaggtcaaaaaagaatgttatacttcttcatggcaaaaaataattatttaaaagttgatgtttaatgtatttactgtaattgggattcgattttttgaaatagccttcaattgaatggtagaaatgtggaaacatctaagcagtaagattacatataagtcttcatcccccttcctcatttctccccctatcattaacatcttgcatttagagtggtacatttgttgcaattgatgagccagtatggatatgctattattaccaaaagtccataatttacattaggattcactctttatgttatactttctgtgagttttacaaatcataatgacatgtatctaccattacagtatcatacaaaatagttgcccagattgcagcagtgccattttgtatttctaccagcaatgaatgagagctcctgtagtcatacttccgtgccaccttttggtgtaatcagttttttttttatttttatttttttttattttagccattctaaggtgtgtagtgatatcttgctgttgttttaatttccaatcgcctaatgatgtatgttcattgcttatttgtcatctgtttatcttctttgatgagatgttcttcagatattttgtccatgttttaattagattgttatcatattgttgcattttaaaggttctcaatatgttttggacaccagtctcttttcggatatgtcttttgcaaatgttttcgtttcttcctaatctgacttgttccgtcctctgaattgtatttcaaagagcagtttttactctctttgtaaaaaaaaaaaaggcagtttgaccttgccaaacctaaggtcacctagattttctactaggttatcttataagagttttatacttttgcatcttatatgcaagtctataatcacttttgagttactttttgtgaaaggaataaagtatgtatctagattcatttttttttttttttgcatgtggatatccagttgttctggcatcatttgttgtaaaaggcttcattttgtaaaacttatttttcttcatttatttactgagtttctagtcccttcataaaatatatggcttcaagctcatttttctctctctactctgtttcctccaaactatcccacacttttaaaaggaatcttccatatttttctagccacttttataatggggaatgtcttccataacatcctgaagttcatcatcaaattcacactaagggataggtgatgattttataaagcaacccacctttgttttgtataacctgagttattcattcattcattcattcaacatatattaagcacccatttttaaacagatattagtccaagaaattattatactgaagctaaaagtactatatcctggttcatccttttgagaaatatacaaatatttgtactcttaaatgtcattgactttcatatttgttagagtgtctttcactctttctcatagtttagcagttttctgttcttccaaacattcctaatgtgacattgatatacttgtatctgggtgtaatttcacttgtctatgctcctctcatgacactgtttactcagttacagacaattgctctagaggtcttccattaagtgtagtgtaaaatgggtctattactttctgtgacatggacaacatcctgtattaagctttaaatcactggtatttttgctgccaaaatagcatactgcactatcatattaaattcattataaaattaacatttgcctgttggtcatattcaatatttttcaagtgtggaaaatctcaatatgaggtgccttgagggaatgtagtagtgggggactaattttaattaattttaatttaattgtgtattataccaaggtatccaaagaggcaatgtactataatagaaaaatgctgcatttggcattgtgaaattcagatttagcgtgtgtctgatacatattagctggttgtgctcagtaagttatttaacttctttaagcttatgtttattcctctgtaaaataatgatgataacaatgcttgccttttctactttctaatgtgttttgagagattaacattgaaatatatatgaaaataattctaactaaggtttactgggaaataatttacataccttaaaaaatcaccctttttagtgtaccattctattgattttaacagatgcacatagtcatgtacccacaatcatggtgtagaacaatgccatcaccccatatatttccacttgtctctttgttttttatgcctggcaaccactggtctgctttgtatccctatagtttcgccttttctagaatgtcatatcaatggaatcattctgggtgtggcttccttcacttgtcataattctctgatattcttccatgctgttgcatttatcagtagtgagttccttttttattaatatatttttaaagtttttaattttattgaagtccagatcattatttaaaaacattaaaacaagttttttttttgtttttttttttattatactttaagttttagggtacatgtgcacattgtgcaggttagttacatatgtatacatgtgccatgctggtgcgctgcatccactaactcgtcatctagcattaggtatatctcccaatgctatccctcccccgtacccctaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtgaaatggtatttccagttctagatccctaaggaatcgctacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtccattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaatagaataccctttatttccttctcctgcctaattgccctggccagaacttccaacagtatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctgtattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattagaatagtttcagaaggaatggtaccagttcctccttgtacctctggtagaattcggctgtgaatccatctggtcctggactcttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattccctgatggtagtttgtatttctgtgggatcggtggtgatatcccctttatcattttttattgcatctgtttgattcttctctctttttttctttgttagtcttgctagcggtctatcaattttgttgatcctttcaaaaaaccagctcctggattcattaattttttgaagggttttttgtgtcactatttccttcagttctgctctgattttagttatttcttgccttctgctagcttttgagtgtgtttgctcttgcttttctaattcttttaattgtgatgttagggtgtcagttttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcagattgttcagtttccatgtagttgagcagctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtccacttggtgctgagctgagttcaattcctgggtatccttgttgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgataggtcttgactctttatccaatttgccagtctgtgtcttttaattggagaatttagtgcatttacatttaaagttaatattgttatgtgtgaatttgatcctgtcattatgattatagctggtgattttgctcgttagttgatgcagtttcttcctagtctcgatggtctttacattttggcatgattttgcagcggctggtacccgttgttcctttccatgtttagtgcttctttcaggagctcttgtaaggcaggcctggtggtgacaaaatctctcagcatttgcttgtctgtaaagtattttatttctccttcacttatgaagcttagtttggctggatatgaaattctgggttcaaaattcttttctttaagaatgttgaacattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagactggggaagttctcctggataatatcctgcagagtgttttccaacttggttccattctccccatcactttcaggtacaccaatcagacgtagatttggtcttttcacatagtcccgtatttcctggaggctttgctcatttctttttattcttttttctctagacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaattttttttcaaagttttcaacttctttgccttcggtttgaatgtccttccgtagctcagagtaatttgatcgtctgaagccttcttctctcagctcgtcagtcattctccatccagttttgttccattgctggtgaggaactgtgttcctttggaggaggagaggctctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggtgtcaggggacagggacccacttgaggaggcagtctgcccgtcctgagatctccagctgcgtcctgggagaaccactgctctcttcaaagctgtcagacagggacatttaagtctgcagaggttactgctgtctttttgtttgtgccctgcccccagaggtggagcctacagaggaaagcaggcctccttgagctgtggtgggctccacccagttcgagcttcccagctgctttgtttacctaagcaagcctgggcaatggcaggcgcccctcccccagcctagctgcccccttgcagtttgatctcagactgctgtgctagcaatcagcgagactccgtgggcataggaccctccgagccaggtgcgggatataatctcgtggtgcgctgttttttaagcccgtcggaaaagcgcagtattcgggtgggagtgacccgattttccaggtgccgtctgtcagccctttctttgactcagacagggaactccctgaccccttgcgcttcccaagtgaggcaatgcctcgccctgcttcggctcgcgcacggtgcgcgcacccactgacctgcgcccactgtctggcacttcctagtgagatgcacccggtacctcagatggaaatgcagaaatcacccatcttctgcgtcgctcacgctgggagctgtagacaggagctgttcctattcggccatcttggctcctccctccaaaacaagcttttttataagttgtttttaaattacttgattaaagatgtacacatccacttgcatagaatatagaggcaataacattaagagaatgattattctcttaaggcctacactatcatttttggaaatatttttctatttatttcagatgaaaactgaattcccaagggcatgtttttcaaaaaatataactttgtaatgtttgtgatcatatagtttgaaatgaaattaaaaacaggaggtggttttcttgaaaagtgtggattgaaaggccaaggtgtgactgattgtatgggttttttttttttctgttgccaaaaaaagcctttttgagctgaacaagaaaggtataaaattaaagtaaatgcactcttcaaattttagtagcaacatgaaatcttgctggcaatttgatgttttactgacattgtgtcctgccagcctattgtgaggtacatcagatgtgaatgctgcttattttccccagtgacttctaaatggtcttgtggagtagctcttatgatatgccagcagtgtgtcagcagaataccagtttgtgttccagagcctgcctctttaaatctgaaagttatcccatgtccttttcttgtttctgccaaattctctactcatagtatataattatatgttagagggatgattacacaccaatgaattacaatcaaacttggcttgttagtatataaagctttggttgttaatcacaatcatttaaataggagctcaccctccctgaaatgcagatgtcatgttactatgggttagccttccccaaattggaacctgttatatattagaaagaacactttggagtcatatgttcatcattgcctcttttctgtaacattgagcactgcctcttggctctgagttactttgtgaaactggaatcaatataagagtttatcgaaagaatgacttctcctacaaagtaagtgttgattttctaatttcttggacagagaaagtcaaatcacaccatgtctggtagaaaatatattgaactaatatattgcaaagttattgctattaagagaaatgcaggtttttaaaattagctctttgtttaggctttttcaaaaaagatagaaaacaacaacaacaaccagccagggacagtgtctcacacctgtaatcccagtgctttgagatgccaaagtgggaggatcgcttgaggccaggagttctagaccagcctggacaacatagcaagaccacatctgtacacaaattaaaaaaaaaaaaaaaaacttagctgagtgtggtgttgtacacatgtagtcctagctactctgggggctgaggtgagaagatggcttgagcccaggagtttgacagcctgggtgacagagaaagactctgtctccaaaataacaataacagcaacaacaagaagactggtttctcagtctcacacaggacacacagaattgtataacagtcaacattgtatgaaaataaacaaataagcattatctaatgcaaacttcattagatagatgcagcataggcctcatttatcataacactgtgaccttgacaaatttcttaaacattgggtatgtcatgttctgcatctgtaaaatggcaatactaataaaacatttcccaatggattttgtgagcaggaaataagttaatattgctaaagttcttaggacacttacttggtacataaaaaataccatgaagtgtttgttatataaataaacttggtaatcctaacattatattgaattacaatactttggacaatacttacacatagaaattagaggctcagtgtttgtctagtaaacagaactgcaaaattctcagtaggaacactttcattactttattcataaaatagtatgaatagtactttatttttttatcgtttaatctaaacattctaattctttgttcaggatgggctaatttctcatctgctgcttatctactgaccattcaaataccatttgtaaaataatgcttttcattcctttatttgaccattcattcatttattcattattcagaacttcctgtatccctggctatgcaaatttgtgtgtataaggtatgcttcctcttatttcctcttttaagggagataggtatatgaatttttataatacaggacaaaaagaggatgttggaaaacagatggagagcaaaatccctagtgagttcaaaaggctgggactgttaattctctctgagagatggaggaagactctaaatagcgcctgaagaaatgataggatttggacacgcaaagagaaaattctagagaaaaagaactatgaaatctcagaggtcaagaaatgtaccttagtatctttgtgtttagagaaactagtccatttcactggaatacataaagtacagctgggggatatgagattgggaataaaatttagaccagatcatagggaactttgaatgcaagtgaaggtttttactttattcattggacagaaagggaccttccttgaatgtaaactcaagcctgaaaaaaaaagtagacaagttcagatccttgagtgaaataaatctggctactagttagagtttgaatgatgaagaaaaatgtttttgacttaacagtttttactttttcaaaatcttcccttcattctaacagctctgaaagtattattttcttcaggaaatggctctatgcggactgcctgctagcttactcccatgcagggatttattttcatggaataatctttgagactggattgcaaaactcttcttttagaagtcatcagaccaaaattcttaaccttgctgagcctcagctttagtactctgtcactcaaaagtggtgaaaaaattaggaagctttaaataaattccttgtagttctttacatttttgtgcatatctgttgggggaaatgggcagggctacccaggtttatttagaataatccaaatagtaatagtgtggtttatttttgaagctgactaaaatatttttaagaattaaactcttaatatataatacatgtgctgaacattcttaacgactctaatttaaattacatatgtaaaagtagaagaatattagagaaaaagttttacattcatcagataatttagttaggcaataatattagatttaaaaatattagtttttaaatttaatattgatttattagatttaatatttaatttaatattagatttaaaaacatcatcatgatcatctttaaagtgcttttaccaagagctaaacaaaaaaattgaaagtgaattcatgtaattagcaatatttgatatagaataatcaaatgccaattaaatttattacttttaagaagttatccttaaatggttttttgaatgtgaatgttataaagaataatatctttcactttatttaagctttttctttaaaaaaatagtccttatgtggcaaattagttttagaacaatatacagcattgtatgtatggaacatttttgggtatgttcattttgtgtacattttttcttttatcagtgtcctttgggttttcattggtaattagtagaaatattttcagttgagaaaatgtgatcactatgtcacttaatagtgttatttttaataaataaattattaatatgttctacactatatctgatctatcatgtgaaaccatattaggccaataaactcctcttatatattttggttattagtattaatattactatacatacaattatcacttttcattagaataaaatttttaaattctttgtctcaaaaataaaatggaatttggttcattatatgaaattcttgttcatattacttaaggtgacttgtaattcagagagttattgattctgatgcattaagtagcaaacccatgacattctctttattatgagctctgatatcaaataaaagatgggtttacttgctctttcaaaaattgatttattgccagtttcaccactgtagatactatctttaaaacaaaattaaacatgcgaaagaaatggaggtttagtaatgaaataaagtgttgactaatgattacttcaaagcagaaaggttaaatatgatatgagtaaaattttaacagtacatgctttccacttgattagtttcatacttgttcatgcaaaaggtcatattgtcatttaccaaaaatatggaaatctttcgagttgtttgtgtaagcaaggtttaaaaaagttactttaaataaaaagtagtaagaatactttagggaaaagtaaatttctaattatttttcctactacaattttatgttaattggttataaactatggggcaagtgcaagtttctgagaaaatttcatagtactagagtatatttcctagccctttagagcattgtatatgtggaataaattcctcgatggaacttcaagctctgattattacctaagagatttctttgcaattgtagtgtgtaataatctctcaagttttatcttggtgggattctgatggtgaaagttcagtctcatgacattgtaaagagacgtccctgtaaatgtacctgaatcaaatttttctgctaagaaacttggatatttcaaactatctgcatttatttagactaaattttgtgtggtgaatgtgaaacacactgtactctgatgtctatttcttcgaaaaaaggaaatagaaaaatcacaagtgtaactgcaattccccacccccacccccagccccaccccaccctttttggtttgtttgtttgtttgttgttttattatactttaagttctagggtacatgggcacaatgtgcaggtttgttacataggtatgcatgtgccatgttggtttgctgcacccattacttgtcatttacattaggtatttctcctaatgctatccctcccccagccccccacccagtgacaggccttggtgtgtgatgttccctgccctgtgtccaagtgttcgcattgttcaattcccacctatgagtgagaacatgtggtgtttggttttctgtccttgtgatagtttgctcagaatgatggtttccagcttcatccatgtccctgcaaaggaacagggtctcactttcattgcccaggctggaatgcagtggcaccatcttggctcactgcacctttgacttccagagctcaaataatccttccacctcccacctcagcctcctgtgtaactgggactataggtgcacatcaccatgcccagttaattttttgtaatttattggagacaggttttcaccacattgcccaggctgtttaaacaacttatttttagagacatttaaaaatatataaaacaagtgttttaggcagattagaaaactctaatataaaatttttgaaggcaaatacctttagcttaatcaagggctagaaagatagaaatatgtgtttagacatacaccaaagaaaagggtttataatttattttcttttatgagaattgtgaattatcagaaattgttagctggtagattaaacaattagtgtttacgaagaaagtgtttggtaaaagaaaaaaaaggcttttgaatcttgtggctaagaagttattgaaggtatggtctccagaatttgtttaaacctactatagttgctgttgtccctttactttggagtggatcaaatctgttgcattaagattgtcgtagtctaggctggcatagtctaggttgaatatatgatatataaaaatactatttcatcaaaggaattacaatccagaagtttttaaatttggcattaatgttgctaaatgatatgtggagaaatacaaatccaggttaggaggtcagaaggattatagtaataacaggcattcattcaataaatatttgttattactacatttcagggataaaatggtgaatgaaatggatacagtccttgaagtcctacaacttacagtctgagatagatgtggtacagaggggaacatttcataaggaaaattgccagtaaagaaataaggtagtagagaaggcttctagtggaagttgttaaccttaaacagggaagccagattctatgctaatttcaatgtgagatgaatctaattctatttcatatatccaattcattatatctatatcaagggaaagctagccttgaatgatttcttgccagtacttttatattccacagacagtacatctagtcaaaactcttttcaagcttccactcccatacacaatgctttgactcttatggaaaacctcttttgctttctataaaaagcaaagccatgcaaggtaaagtattttattcttaatcttctttttatcttatcaaattgctgctacttcagctcttactgttcttgccttaaggttaacagaaaggtttactttttaataatctcttaaaatgttgagccaatgtcttattcctactgatacctgaaggttcttgtctcatatttactctctcttctaaccatacatatcaatattagtatatttattccctcgttgccaaatttctcaaataatctgtttatacagacatccatggaatcagggcaaacattttttattatgctctcccaggcttctgatgtgttaatgatttaggggaaatgttggtcctatgcagtgatgcagcagatgcggaaaggagcacaacattaaggagaagttttaattcaattgtgaatattttcagtttgaagaagtccaggagctgactgcaataactacacttggggctcatctgaatatacattcatagcaaaacagactctgttatatcagatttttatgtggtaatgaagacatggttttggaagacgtggcagagaaataataatatggaataaaaggaacacaaagtagagctccttgatcctcacacagggcaaaaaacatggtgataaatttgaaatcatgctatgaggctttcttttctttggtgtcattcacttattgctatgtaaagtaccaatctgactcatactttattttctaggtaaaatttcaagtctttattctcattgccacatgttagctgtattcatcattttgacttaactagcagatagccctaattctttacaacttcttgcatccatgtcctatttttaactaaattggatcgggagttagggtatctcctttagcatctaacgctgttgctttttcatcataagcactgtgtgtgtgtatccatctatctattgatttacatatattttaatataatgtacatataaatatatatttatttattgatcatttatataatgctcattatttctgccattgcagaaagtgaatatgatagagaactggaggttatcattattgaatttatatatacattcaatatatatatcaaatgtatatatatcaaataaaaatgatacatgtatattaaataaaaatacgatatatatttttgcttacagatttattataaataaataaatatatacataaactcaataatgatgacctccagttccctctcatattcactttctacaatggcagaaataatgagtattatttgaaagttgaattttagtgaaaagaattaaagcgtcacagaaagtaatttttaccattttatcctgatccttagagcaaaggtaataacatttctagctttatttctcataaaatgagtggaagtgatatccttaacacccttatggagtaagaggaagatatgacaccagtcaaataggcttacatgaaaattgtatcaaaccatgcaagtgtaagaatatcagaaaaagaaactccttttttaatagataagaaatagttttcattaatttttaatgtccctaaccaaaatacttgttgaataaatgaacagtttttaaaatttcagaagtcaaacagtatttttatttatatttttaatattttaagactcctgtctcatttcttcaagcgtgaagtctcagtaaaagattgtcaataaaagcctttgtgatacagaatttatattaatattgtagattttttaaatgagttaaaaacccaacaatttactttatgttgatacatgcttatttgtaatgtttatgtcttaatgaaatccacctatatatctattcaaatatactgattgagcactactaagaccacaaatacaacctgataaaaagattgtcccagagagtgagaatttgtcgcgaaatggaggaaagacaaagatgaataaattaaaaattacaaatgagtataatgtgctctgacagaaggcagcaattgagctgaataaaagaatagaaaagttaatgtaatgaaatgtctaaatgaaaacactataacatccagttttctatactaatcactttctgcacaagaaaaatactaagcagtccatggatattctctacatatcagatcatatatttcagcttttaaaagttatatctggccttaccctaaataaaatgaaccagaattcctgggtatcgatactgctcctctaatcttaataaaaccctagctattttagtgagtattccacatagggtaaccacacatcttttcatcttgtttgcctcagatggtctcaaagctcgtgttctctcttccttgcatagtttttgcacagaggctgtcttcagatattctctttagtttatcttgccttaggaatcaatacacaggctgggcgcagtggctcacgcctgtaatcccagcactttgggaggcggaggcgggcggatcacgaggtcaggagatcgagactatcctggctaacaccgtgaaaccccgtctctactaaaaatacaaaacattagccgggcatggtggcgggcgcctatagtcccagctactcgggaggctgaggcaggagaatggcgtgaacctgggaggcggagcttgcagtgaaccgagattgcaccactgcactccagcctaggtgacagagcaagactccgtctcaaaaaaaaaaaaaaaaaaaaaaaaaaaaaaaaaaaaaatctatacacagggttctgtatatcctttaggattctcctttaatctcatatacttttgtagataatccttttattaaactttcctaaattacttgcttttcccgaagattctgttcatcatcattatacacaaatgttacatgagaatttcatgcttaaaataagttttctcttttgaatgcaaaaatcaatatttttctcttcctttcatagacattgtaatcaaagataggcaacatagcctaaacatttatatattaaagtgaaagtttgggcaaaccattttattaaccatgaaaatggcacagatttgttttcctaaaatgaccaaagcacgtgttttaggattaaaatagtgcctgaaattccaaaggaccaattttaccctgagaaacaagttcagttattttcaaatcattttatttcctaactttaaaatgatcaattgattgattgtttctgtgtctttgttctggaaactattatatcgttggtatatctaataattattcttacaaaaaaggaaaaatgtactgcagtgagaacacatactctttttaagattactgggctactgcttacattcttgcctcctccccttgaatctagttttcagacattagaaaagtgtatccaaatattccttaagtattctcttaataaaaatcctgctgttttctatttgagcttcttttcccagggtagattacagaatctacctcatctacagaatttagaaacattaatgacttcagatcaccagggtatcatgtaatgtccagcagtaagttgttagagactgaaatatgactgaaattaaaaattgcttcctgagatttggagtttaaagctgatttgagcaaatggatttgatccatagtagcatcataggctaatttaatcttgctggaaaaaagtgtaatatctgatatgtgtcgaatacatatggacgagtagaccagtgagttccaacctgactcgttattcttattgtgtcaaataaatagtatttgattattaattaattatattttaagctgagtataaataatattctgaactgatcaagaaatatctatctaatgtatctgctaaatttagaatatcattaatatctggaaaagatgaaatacaaagagtgcactttgttctgagtaactcattactgactcattatcatcatcaaaaagaaactaaagtgggttaatgaataatcttgcctttgactgtactttgtgcttctaatgatcttacctcaatgagaaaataaaaatgcttactttaagatctgtttgtaggattcccttaggaagacaaccttctttgtttaggaatacaccttaatgagtgtttttggttttgtaattaaggacttctgtgcgtattctaaattggatagagcaagaaaaacagctgaaatgctttttgggagaaaacacagaaaagtaaacagggatttttacaggatgtaagcaaattaatcaagaggagatgggaagaagaaagccaagaaatgtggtgataagagagcgttcaagataggggacttttggagttcctattgtgttgaaaaaagaagccattttctggagatcctagtagaaagtagaaggactagtgatagcagagatgacttttatatctgtacagatttctcattctgagtaataaagcacagctatgaaaatatgcccaaagtagacttaataatatttgttgtaattaattttatctgcaactgatggatgaccttataaagtaaggagctcataaaatagagatattcagagaaaaaaaagtctaaaataaatagaaaatttccatattcctgcattgtttttatactattttaatgtttagtattatctgggcttacagatctctgaacatatttactacaaaatacatactttgttatcatagccaagtattataaatagcagaaacaaagttcagtgtgctagcaggagatgtagaagccttggccaaagcaagataaaaagaagaattaggatctgagaacaggtcaatttttaagagatgattaatgacttttataaattacgttcttctaaatttcattgttccattttcactagattacatagaaatacaattttttttgtatattgactttgcatcctgtaacattataaaattgaagtatttgttttttaggtttgttgtagaattcatgagtattttgttgctgttgtttgtttctgagacaggatcttgatctgttacccaggctggagtgcaatggcaccatcatagctcactgcagcctcaaattcttgggctcaggtgatcctaataattcagcttcccaagtaactaggactacttctattcctattttgaaatttatcaaacagactttattatgaatgttcatagaaattctatttacaatgcaatttaaatataatttcaacttagaatctgaatatctatgagacaatggataaaaaatgattggatagtgatgatatattcatacaacagcatactcggcaataaaaaagaaagaatagatgtacaaacattgataaatactacaggcattatgcaaatcatacgaaggtaggcacaaaagagttcacattatatttcatttgtatgagtatctaaaacagtaaaactaatatatggaaatataagttaaaaagatgattgtctgaaggccaaggatgagatttcactgggaattgacaagaaaatattctcagtggtagaaatgttctatattgtgattggatgctgtggtatagatatatacaattatcaactctcataaaattgaatatttgagtgttatatattttaatgtatgtaaatgatacctcatttgtaaaagagaaaaagcaaactaaaaattaagaaaggaactttgcaagaacatgttattctaatattggtctcatacttatatccaaagctgtgaaaggaaaattggtaagtttattcagtagtagattttctttaaataatatgcttacacttttagtacttaacaaaaccagaaatttttaaaaataataaattgatgagtagaaccacattgttgagagcagaggaatacagctctcctttgtttaattttttcaaatgaggataaagacaatatcccataatagatagcattagtgaaaaagtatcctgtgtaatcaagttatttctatgtttaatcctgatctttagtaaaaatgctttgctgatctggttatagtgaatatttagcacaaccaattttattttgtttatgatatttttgtgtgttcatttatgcttaaataatagctttctggtttcctttttaaactgttaaataattgtcctgtttatttgtccttgtttgcaaacaagtagcctctccaatttcactcaacatttaacaacttaaaaaatctccattagtctgtaactggccacacttaagccactcaaaatggtcatgaaaagagaccataatggtcatgaaaacagaacacagatatccaaaacaaagagctgtataccccaaaatatatgtttttcagtagtctttacaatacttgtttttactttttaaatttctctagggagctgtgtgtctgtttcacctccgttcttgtagattagatgatctccactaatgcactcatcattaaaaaattgcaagataaccaaattgtttggtttgccatggcataagtttaatagcttgtgcactattatcaaaaataatgacactcttgtaggtcactgattcactgttgagacattaaagtcctatatagccatgaagtgaaaatggcacatttgattttgtgcctagattgttagatacagaatataaaaattatgcttagtactatttttctgcattgggttcaaattaacctctttatgtaaaagttaattttgtgattttttattgtacagtacactttgaaaagattttgaagatatataagctggagaattagaatataatcaacatgaaattcactattcaatgagagctagcatttaaaatagagataacattgtttcaatttctaattgcaaattgcagtgttacctctaaatgtgattttatttttctctaacttgcatggctacataacatgctatgatacttttctaatactctaaaaagatataacttaatttttttcctctggagattagatataaactttgaaatactagacttggtgtgtaactttttactcttcatcttcttctggaggtgtagggtattcattgctattgcaatatagaccttgtgaagttactgaaagcctctgagtacttgtggtcaattaggccatgttgtggtgactgatcgatgactttcataggatggtgatattctggaaatttcaactttgccttaatagtcctctgttctttatttaataataacacaaataattgcaagtcccttaaataatgtacctttgtccttaagcttaattttgcctatatgcaaccaagcaaagatatcttcaactcaaaaggtggaaaatgtaataattgatgaaaagatgagacgattaattgggagggcagatattatcaaactacaacagagatatagaagctattgtgtttttgcaaagctgttcagagacaaagcatgctgagttgcaattgaaagccatctctgatcaaaagccagccatttttacatgcagtgacattttctaaaacagaatatacagttttactttggaatatttcacatcttgttttattcatttgttttatacattctctgttctgttttaatatgtttagctctccttttgggtagacattagtgaattacatcaattgagatatgtaaattttttttctattttaatgtttcttaaattaagatgtgtttttaaaatcggcacatgtttaatgcagcttttcttttttgaaacactttcattgagttgacaggttttcttgcaatagatagcaccttagaaatcaagagaaaagggttcaataaactaacaaattcaataactttaacattcagtaacttttacattcaataactttaacattgaataacaaattcaaaaactttaacattcaataaactttaacaaatatttattgagtgtgtctgctctgcaagggataaggctaggtactaagaaaaccacagcaagaaggacaaaccaggtcttaatcttctcagagttcttgaaagtagagtaaattaaataggctatagtctagtaaattaccactgtggtatgacagagatatattttaaatgctataggataaccagagaggcaatgtataattctgtctgtgcttttcagaggagaaggaactctcaagtggaaggataacaagcggaagaaagaacgtaagcaaaagcaggaaggtgtgaaatgtcagggtgtgtgctgggaatgatgagtagtctagtggaactctagttagggcactttctctcaaacatgagtaatgaacagaacacgttaaaagaaaaaaagatcttgccaatctacagtattcattcaaattatttttgttaactttacatatgtaatatttgtttttacaacagttaaactccaaaatacatctattcattaaaaataaacaacctcacaaaaacaattaaaatttaattatcaacattaactaaagtcatatgtgagtttttattttggggcatgatgagcttaaactaaacaagaaactagctttttcactagtttattcactgatctgtgaattgaataggccaatcaatttaagtacatgtcaaaatatcacaccataataatgcttagcagctagtgttattgagttattatatgtcaagctctgtaacaactgttttaatccagtatcttattattctttaaagactttttcaagtggcttcccctacggtacttatactttaatggatgtcctcttacctctctgccgccgccttcttgagcatcgttgtagctttatcctcttctaactttctaatattggaatatttaagggttccattcttagttctatatactctgtcttttggtgatctcatttagtttcatgagttttatttttctttatatcctaacaaccaaactcatatattaaactagctccttgatgtcagcacctgggggcctagcaaacatctcatactcaatatgcccagttttaaactactgatatgactgggaacggtggctcacgcctttaatcccagcactttgggaggcggaggcgagtggatcacttgaggtcaggagtttgagtccagcatggcaaaaccccatttctattaaaaatgtgaaaattaaccaggcatggtggtgcacgcctgcaatctcaaatactcaggaggctgagacagtagcatctcttgaaccaagggaggcagaggttgcagtgaactgagatcatgccactatactccagcctagacatcagaacgagactgcctcaaaacaaacaaaacaaaacaaaaactactagtatctccagacctatttatgtttcagtcttcaccatctctcagttgatggcaattccatttcagttattcaggacaaaaccttggaatttttcttgatttattttttctctcatccaagattcaaaatctttggaaattaatgagtttatattcaaaatatatccagaatatgaagcctcttctcacgacaccctctgttgccattcatatccaagcagccattattatcattacgtcttgtctacatttttacaatagcatcttcctaatcagtgtccacattctactgttgttctcccacaattcattgcaatggattctcaagaaagttgccagtgtcttcattctattatgtaagttatatcaggatgtgactcctgtaatttgaaaatcaaaagctttttttttttttttttttttgaggaagagttagaatttagacagtagcctacaaggctccacatggtatgattccccaactttctttttatagaatacagcagcagtgtacctagtgtgcatttgacacatacattggattattgtttagaacttctctcacctatacaacaagaatataattaataataataatgaaataagtaatcagaatagccaggaaataaaccaaaacaatataaaaattattcaacttttgtcatgattatatatacatatatataattttaaaaatattcttagaaaagcaaatagttaaaaatacttaaaagcttaatattttaaaattatatttatacttttttgaaaaaaaggaagcttgtatctgcatttatttggttataatcataaatagtatcattctgttttccagctttaacctctgcatactgtcaatgactttgtctagattactctgctttgcatattcataattaatagaggatttaaacagatatgttgatctgtctatgctcatatttggtcagaggatactttttattggttttaattttttatagtttctttcatatcaaataagagatacacaaaattagaaaaacatttaatatgcagctaaatttgaaagagatgtataaaaatcccacttcacaataaattccagaaaattcataaaaaacaataagtggttacattgaaagtgaaataaattttgttttctttttataattacaatataatttatgtttatatagaattaactgagtttttaaatgtattttgttgtggttaaaaacacttaacataaggtctaccctcttaaaaaatttgtaagtgtactctacagaattgttaattataggaataatgttgtacagtagatctctagaatcgattcatcttgtatcattgagactttacgcccaagggggagttgctgacctgatctactgtttaaattcaggcatagttaggaccaccacaggcactggatttataaactgtgccaagtgggtttaaagaatctcagaacttcatgaatttactcttgattgattatataatgaagttgtctgaattagcattcatatagaatacagtgctttatttcattttagtgatacataataaaacatgacagtttgaaactaataagcaaagtattaaaattcaaaaaataaccaaatcagttttttagagcttagatcaataaataattttttcagaaaaataatttttcactgaccttgttttgagtcgcctgcaccctgttggactgttcctactgttccacctttggtaggccactgaattttgagataagaaattcaagataaatgttccgtatttaaaagaattttttaatacatttgcagaattcaagttctgcttcactgcacttctactttagctgaacctttggcctataataaatatattctggaaatggtggttggttaatagaaaaagtcctttaaagtattagatttgttgccagtttttaaatatatgataggggtcaagaaaccaagaatcacagaacaaatatggcctgccaccagtttctgtaagttttattggaaaatggccatgctcattcttttacatattgtctatgcagctttcgagctggaaagaagaattgagtaattgaaacaaatatcaaaaaatggactgcaaagcctagaatttaaactatctgtcctcttatagaaaatacttgcaaaccccttcttattgtgtagaaagaatttggtgttaaagtttactttataatgaatttatttattgaactgtgttaatgagaaacagaaaagcaaataaaattgatctagtttggccagattgtatgcagtgaatgatttactatctgagaaaagtgttactgaggcaacagtgtttttaacatgactgtgaagtcaacagaggaaagatgtttatatccatggtgtgagattatgaaacattaactttgcattttcattaatattggaaccaaaatagcttttattgaggaagaatgattgaagtgttagcatccatacaaggtagagtaacaggaaataatttatcatgagatgatttataactccactttatagagacgaatattttcatggtacaaatatttcatatctggaaatgattgtaacaaatatgattttcccccttcagcataagttgtatgagcagcttcaccagttcagtgatacaaatacggttgaatattgcacttgtccaattaattgcatgagttatcccctatctattttaccaagaaggttaatatcaactttttgaggtctcaacatccagaattgctgtttgtaggctttcttagtctaaagaacacacagatggatagttagagagcccaggaagtacacaaaagttcccattttcaaaatgtctctgcatcctgttgttgctccatgttctgctgtaaattgctcctgaattttcagtattctgtgggttctgatgtggacctctgaaccttgctccctttcttcccaataggctgcttgaactctaaatttatctagttcctcctgtacaatcatttccatatacaaaggaacaactgtgtagagcagatgttagtcaaaccactgaagttcaagttatcccatttcccattcatagaatggtgattacttgcatacatttgtgtaagtgagagggccactgagttggtgcctaaaaagaacattttcaaagtaatactgggcccaccttgccaaagtggtgggcaagagcttcttgtttccaaaataatatttaatatctacctcataagatatattttaagtggtattactaggaattataattttatatttacaaatagcatgtgtgttttagttataagagctgccaaaatattttaaaagaactacttctttaattgagaggaaacagtgaaattaagacaaattataataaaggaagccatgtaaagattgaataagctttatttgcttaatgatatagtcacagatatccacgtgtattcactattttcacatattgtgcctcgctattatttgtgtgctcaaggtctctatcttcaagtgttatatactgtagagtttcctatcaaatatgagcataaaggaatgtttcatctctatctttacagtgtaatcttaaaactgctagctactattggcttttctttctttttccttttcttccctttggcttttgtgttattgttgaaatgatgtatctattccttttagcatggcttatactaggagctctgaaacccagttcagaaacctgtgagttatttattgatgttaacaaaagttaaaatcaataagccagacataaaaaagaaacttctagatctaagacgaatgtttagttaactttgaataccgtatatgaaattctcaatattttcctgccagatgttcatgtcatagagttagcaaacagttattgaaaacttactgttgcaaagttcttgggattcaaacctaagacacaaaagaccttcaggcaatttgcagtccaattgcagaaactggcaagctgaaaaggaattactgtgtattatatgttttattattggatagaagtaacagagagtgctatgggatcacctagaaagagcaactgaggaaattgtagatagcaataagaagagccaattgtcagaacacagttgtcaggctgactcttgaaagatgagtagtaatcagatagacaatgccatgccatgagaaagcaattaaaagaagttggaaattccatgttaaggacacagaaagacccaaagtgcatggaaataaacaagtgttggccatttagagagcacaagtggtttggaataactagaattcatatttttgttttaaagtgtcaagaaacaggccgaattagggagaaggaaccaaatcatgaaagaccatatccagaaataaaagtttttctaaagataaagaatgaagttgaattttaatgacagtaacacaatcagatttacttttgtaagaattacattcagagaatagtggaagtcagagtgcttgcgtgcatgtgtgtgtgtgtgtgtgtgtgtgtgtgtgtgtgtgtgtgttgagtggggagggaataattttcatactccaataagaaatgttgaagacttgagctttggcaaaatttattaatttatgaggattttgagcctttcatctcaccctgcccattaaaaaattttctaaatttgcctttataccatctcttctgcttactggggcgatttcagagctgccacctggctggaaacttactcacataaagcaagcaaatccctcaaggggccatagcaaaggagataatctgctcatgggtcaatgggaggtgaaataaaaaagaatatgcagaagaaaagattgaaggttgttgcctggaatgattcctgaagccaagcatcttcggttgttattttaatacttcctttggacactgaaggttggaactgttaaaaactgttaaataagaacatagagtcaatgagaatagacaaaactgttaattcatttgtctgtggaaggaaagaaggaaggcaggggctagaggagtgtttggaaaaggtgaatcaatatttattaaaggaaggaagtgggcatttccaagaatatattttaggataaaaaagatgtgggtatttttttataaatatatatatttttattattattattatacttttaagtttttgattgagggtgaatcagagagggacaattttaagttctaggatggtaactgactgtggaagatttctgtggggaaagcaaggacatctagactattggtagaagaatcctggagggatcattcaatgtgatttaaatttatattcaaatatacttttaatagcaattcatatttttagaaaccgctcatgttggaggaaggattccatttatttttgtggtattttttaagcagagttgaagacccctatgaagaaagtatgaggaagcatttatgatcaaaacggggaagaacgttttttgcccaaagtgacaatagctgtattgtttcctctgtctatataagtaatatatgctaattattaaaaatgaaaaaatgacatagaaaatacaaatacttttgaaatttcaatgcaaaaatctttttgttgactatctttaatactacttgctcactctctgtctctctctatcccctacacatacagcttaggtaagtggcatctcatcatatgtggtgttttcaccagaaataattttataaaaacagcattcaaaatatggcttattttatttttcccctttttcttactctctctaatcttacctgtttttgaaacagataaccagaattaattacaaagagaaatgtatttaaattcaatgcctgaggtggggtatattctctaggtagtcaatgtttgtttatttccatgaactttgggtctttctatgtccttaacatggaatttccaactccttttaattcctttttcatgccatgtaattgcctagctgattcctactaatgtttcaagagtcagcctgataacattctcaaaagtgattttgagctgattttctcagaatttccccttgctttaacgaaaacaaaagaaggaagctcaggaaaaaataaacaaacaaacaaaacaactttttgctatctaagaattttcctttaaaatgaatttggatttcttggatgtcttataagataaatagtttcctactatcagaattagtcttagatatatttgatgataatctctcgtacattccatagactcaatttctaaattgagaaggaagttgtcctagagcacttgtaggtttctttccaattttatgtttttattggagctttatatccaaccctatatccttagaatcttcattatttgtaaaattatgaaatacagcaagtgatgggcaatttgtgttatcccagttttaaaagaaaaaaaattcatataaataaagcattttttagaagtcataaaacagttctattatggaagcagaatataacttaaaactataaaaactataaacttttttcagtcttctaatgtttccacttgcaaaataactgagagaatgcaaaatttgaatatagtgtacaatacagtttttctcagtcttttccactttactttttaaatcgcaaaagtaaaacctgtcatggttaattttaaaaagtatacaactaaaagtaactttccatccccaaaccagaacaccaatccctacatttagaagaaaccactcttaagaaacctaatttatgcatataattcaattgtgtaactatagcaaagcttttaaaagagatttgattacaaaacattttttgcaaaatttactgtatcatatccatgttccaaaagcaaactaaaaagatctcaataaatcttccctgtttactgaattacattgaaactcctttgcttagccttcaaagtctgcagtctgaccttactttatctttttagtggatctcctgctgcttttttatatgtgtgtagtgcactcatcaaactgaatattttatgaaactgctcatgcttttttaatctgttaaaatcccttctttttcactaacctttcaaatgcaactatctccataaaatgtactggataccagaaaaagattgtgttttcccctcttgtgattaaccataatacaaatgggtacacattatgcatataaatgaataaatatatctttcaaaaggtattacataatgtagtttcttgcattatatttgtcattatggttgtatttgtcctttaataaattttacattttcagaagagtcccattattttacattttgcacaccagagcacctacttagagtagacacaatatatatccatctttttttaaaaactctaagttctgggatacatgtgcagaatgtgcaggtttgttacatacgtatacgtgtaccatggtggtttgctgcacctgtcaacccatcacctaggttttaagccccgcatgcattaactatttgtcctgatgctctcccttccctcccctgccctgctgacaggtctggtatgtgttgttcccctccctgtgtccatgtgttctcattgtttaactcccatttatgagtgagaaaatgtggtgtttggttttctgtacccgtgttagtttgctgaggatgatggcttccagcttaatcaatgtccctgcaaaggacatgatctcattctttttatggctgcatagtattcagtggcatatatgtatcacattttatttatccagtctattattgatggtcatttgggttggttccatgtctttgctattgcgaatattgctgcaataaacatatgtgtgcgtgtatttttataatagaatgatttatattcttttgggtatataccaagtaatgggaatgctgggtcaaatggtatttctggttctaaatccttcaggaattgccacactgtcttccacaatggttgaactgatttacattcccaccaacagtaaaagctttcctatttctccacagcctcaccagcatcagttgtttcttgactttttaataatcaccatcctgactggtgtgagatggtatctcgttgtggttttgatttgcatttccctaatgataagtgctgttgagtacttcatatgtttttcatatgtttgaccacataaatgtcttcttttgagaagtgtctgttcatgccctttgcccactttttttttcttgtaaatttgtttaagttccttgtaaattctgtatattagatctttgtcagatgggtagattgcaaaaattgtctcctattctgtaggtcacctgttcactctgatgatactttcttttgctatgcagaagctctttagtttaattagatcccatttgtctattttagcttttgttgccattgattttggtgattttgtcataaaatctttgcccatgcctatgtcctgaatgctattgcctaggttttcttctagggtttttatggttttgggttttacctttaagtctttaatccatcttgagttaatttttgtataaagtgtaaggaatgggtccagtttcagttttctgcatatggctagccagttttcccagcaccatttattaaatagggaatcctttccccattgcttgtttttatcaggtttgttgaagatcagatggttgtacatctgtggtcttatttctgaggtctctattctgttccattggtctatatgtctgtttttgtaccagcactatgctgttttggttactgatgccttgtagtatagtttgaagtctggtaacatgatgcctccagatttgttctttttgcttagaattgtctttgctatgtgggctttttgggttccatatgaattttaaagtagtttttttctaattctgtgaagaatgttcatggtagtttgatgggaatgttattgaatctgtaaattactttgggcagtatggccattttcatgatattgattcttcctgtccatgaggatggaatggttttccatttgtttgtgtcctcttatttccctgagcagtggcttgtagttcttgaagagctccttcatgtcccttgtagctgtattcctagatattttattctctttgtagcaatcatgaatagtaattcattcatgatttggctctctgtttgtctactattggtgtataggagtgcttgtaacttttgcacattgattttgtattctgagattttgctgaagttgcttatcagcttaaggagttttggggctaagatgatggagttttctaaatataggatcgtgtggtctgcagacagagacaatttgacttcctctctccctatttgaatacactttatttctttctcttgactgattgccctggccagaactttcaatactatgttgaataggagtggcgagagagggcatccttgtcttgtaccggttttcaaagggaatgctttcagcttttgcccattcagtatgatattggcttggatttgtcacaaattgattttataattttgagatatgttccatccatacctagtttcttgagagtttttaatgtgaagggatgttgaattttatcgaagctcttttctgcatctattgagataatcatgtggtttttgtcattgattgatatacagaagaaacactaagacctccatttcagcatcatctttgaagaataaatttcttttgaaaaataatcacctggaaattagcatatggtgcatagtttcatgtctttgttagatgacactagagtaatacacaggttctacctcttttcgggataactaaaacagtgtcagagggcgtaaaatactttgagacatcaacttgaaaaatgtcattttcattttgtgatgatttattaaaagcccaattgatttaaaattttttattttctgttttaattgtatttctcaatttatattttaaaaatatctaacaaaaatggatatttaaagaaatacaccttgaaattaaaaaatgtgcagatttcataatttttcacattttcctggcatacggaagcttttagaaacagggaactaattcattcatacaaggtatgtgatatttgaaaataattttaactatctcattgacctttcatttttgtttacctttactctgaaaactttgggtactcacctttcttttttgtcttacatttttacagtcttaagcagtttaatattttcttttctgcttatttgtaacctttgacgctttttcagcattacagccagaagcaaatgcataaagtgtctcttcagatgtaacaaggatagcaaaaccactgggctaccggttacaagttgttattagtattttgtaatggaaagatagtagactttgaatatagccaaatagaccacttaactactcactggccatatttttttaataagttgtacttctctgaattttgtcttttatttgtaaaatattttatgtcattttgtgatatttaagataataagtgaaagcactatgcattatacaggtagatatttatttattgaatactgtttgcctgttctactagaaaaattgatctttgttcatggtatcctagaggtttttagttaatgagactattaatagcagcaaaaaaagaactccacaactctactaaatgcttattcagtttattgtttttcttttaggtttagtcatggtgttagtgtatattggtccatttggaccccagtctcatctacatgtgaataagcaaggtagttaaataacaaataaatatgaaatatcaacaatagttgtggtctcaagtttgcaaacatgttggtaccatcactgggtgtttagtttcagataggatggcagcattagaatgctgcagattctgtctgaaggaagatttacacaactgacaggatattcccccttgtaattctggtttggtacccctataatgtgatcatctcacaaccatggcattattggcatagttctctaaccaagcaaatgaagctgctatatatacacttaaatcatttggaaacatgactgtcatttacagactgaatccccttagtagtgcaaacataagtttacctatatgcacaacatacattattattcttatgtgtatctatgaatatatttctaaaatatatctgtatctatcatctatctatcatcaactatctatctattacatataagttatgtaatccaaccctcacactttccaaaaacacttcaaaccacagtcagtgatacactaaataatgtaattgcagttttgtcttcaaccttatcccatttttaagcatttattataatcaatatgtgttaggataattttggaatgttttccatggcattatgacccagaaatgcaagaaaacagaaatatctccctcttgtttgattggaatttctaaagaagctaaacatatgaagaataacctgtaagagcccaagtatgttttttattagtaactgcttgagtactcaatattctaatgcaaaactctaaaaccatgagtcctggaaccacttaggcttatggtctaagatgaggccgcttaccatccatgaaaacctccatccatatcttagaattttcctaccttgttttagaaagtacagaactgataggcactacagaatcatacagaaacatgtctctgatggctactctcaagcatgtagagggaggcaaaaccagagagaggaaatctgcaaggtcttttatgagggtgaaatcaatttattcactcaggtccataaaactggagcaaagtgtgacttgtacctttcacaatatggtgactataccttctagtaactatgagtaactatggtttatttgatgaaccaaaattagctaattggttcacaaatttaactactccttcacaatatacacgtgcttgtggaatgcaaagaatacagcttgggtagagaaattaactttccacttttcataatatgccaaatttctaagatttataagtgaggatagtatcatataagttattaacaatatgtttttttcatacacacaatttcagaaatggaaatgaatgatttttaaggttttgttttttttgttgtttttgtttttgtttttttttttttttttgagagacagtctcactctatcacccaggctggagtgcagtggcatgatctcagctcactgcaacctccacctcctgggttcaagcgattctactgcctcagcctcccgagtaggtgggaccacaggcttgtgccaccacagccagctaattttttgtgtttttagtagagacggggtttcaccatgttagacaggatgttctcgatctcctgaccttgtgatctgctcacctcagcctgccaaagtgctgggattacaggtgtgaggaaccacgcccagcctaaggttgctttttaagttttttttttttttgttttcaactttattttagaattgagggtacacatgcagctttgttacagaggtatattgtgtgatgctgaggttggggtttgattgaacccatcactaaggttgtgaatataatacctaataggtagttttttaaattcgattcctttttgctggaagccaacataactccattctaaccaagagccacatgcttaccatgtatcaaccagtagctacaataatacacagatgtataaatttgaaatttataaaagagttttgcggtccaaatgaatatgctctcttcagcttgcgagttgtagactatcattatcctaggatattgttcccatcatatgattagctcttcaaaattctaaccactttattgagcaatatcaagtcttttttatattcaatgccatttcctattattaaattgaataataaccattattcataattccattaattacttactttgactaaaaagcctcatcgaagctactaatggatctcctttcaaggcttgttaacatggcacctcaaataaaatactcaatgcctgatagctagatgcacttctaacctttctagtattgaatatacctcatcaatagtatttttaactgctgctgaggaaagtaggagatgcttgaattgctgtatatttagtttaatcatcaaagtttccataaagctgtatacattctatcttattcacatccacatgaaactgccctttcctaatacactcttttaagagaaataaagtaatgataacacacttttcaacagatgactcttatatattatcaaagatgtaaaagaaaatcataaacacaatgctatgaaaatcatatgattaaatttcctgaggagttagaaaaaattttaataactttaaaagaactagaattaaaaaaaatccagcataataatattcatagtttttctaacctagttacaattagttaactcctatttatccaaggaaataaaggaaaaagtgatttggaagttattcccttggataaataggagttttctttagggaaaactataaaatacccactgggggagcagtcttataagtaaaaggtgaatgtaacatataaagactatgccatctgttttcttttttttttttttaattattgattcagagagtaaatgcgcaggtttgttacatggatacactgtgtaatgttaagacttgagcttctagggcacgcatcattcagtgaacattgtacccaataggtaatttttcaacgcttacctccctcgcgcctttatcattttgctttcttaagtagtttacaattatgtattttttaaacatcaccccctcaaactagatgtttgtctttgttatcaatagaatacttgttttgggaaatgggagtaaaaattaagttagtgccttgtgaagtttatcaccaaatcttagagaaacaaaatgggaaacatcgaaaataactgataagatctgaagattatttttaattttaaatcgtatttgccaatattattgtcatttaacaagttaagcagttgcatgtggcaaacactgagcagagacaacagagacctgttatataatgtacttctgtagtgtgattcaggagctcccaggtaaggcaaagccaccccagaagtcatggtgtttcctcatgtttctagcaaaaaggtctaaccttggactcctgtgaattgagagaccttaaaacacattggcatttcttggtgggaatggggagacatattttcttgatttaagagtttataaatgatgtgattatttatttatttatttgaaatagggtctcactctcttaccaagtctgcagtgcagtggcaccatcatggcttactgcagcctcaaactcccaggcataagtcatcctaccagctcagcctccagattagctgagactgcaggtgcatgccaccatgcccgaccaattttctctattttttgtagagctaggatctggctatgttgtctatggctagtcttaaactcctgggctcaagtgatcctccagcctcagcctgccaaagtgctggcattataagcatgagccactgtgcctggagtgatttttaaataatttattttctaccacatttaggcctatatgacaccgtataaatttatcaccatgtatgtaatacttaagacaaatttctataaaattgaaatatgatgatttaaaaactgaaactttaaaatgttgcaaatggctgcttttcagtgtctttgagagtggcggtgtttattttgcaacctttttctggccttttacttcgtgatatctggtaaactttactgataatcaaggctgaataacataacatctacaatcagtatgtaatcaaatctgatgaaaaaacatttacacacacttatcacatatctatatatgtttttaaatgaactgtttttaagtactgctatttaagaccttacgcagtagctcttgaactggaaaatttattttttgttatcaatgtcctagtatgaatgggaatattcaaaattattctggtattcatgatgacatttagaatctaggttttcctgtttattttgcttgtctttgtctccagtctgatactaatttggaagttaatatgaatatttgtaggaaaaaactgcattctgaggagtcacttctaaatacttgcatccaaaatgttactaaatgaaaattaattgcttttcatgaaaaagggacattttacaagactgtgtaatcatattagaataatgactggcctcactaatggaaattaaatgtgatgctgggtgttctggcagggtggcctgggagctaggtttgcatgtaaaagtgtaatttctatccccgctgagtagattttgaatctcaaaataattagttctgtcaaataattaattttgttgacaggattaagtagagaatatacaacctcacacacatatattataattatttggaatgacaagatgatataaaacaataatcttcaattctggctctcaaacttgatcagatcatttctgtgagtacttttgagattcatgttaataaaccttgaatgtaacatataagtcatcatctatggcgccatttacatatggaattcttatcatagtcattaaatgtgctttatatgtgggtgtatgtgtttgtaggaaagttattgtttttataaaacactgcagttcaccaggaggtagttctaagcaaatgttaattttctgaaactctttaagaaagtgcagctatgtaaattgtgtgtttcttttgctctccgaagttagataacatttaaaaagacatattgtttaaaaatgcgtattgtttgcccttcaaatgtaattacatatctaatttaactttccacatagattttctagaacactagaagaaataacatttcttaacatacacttacatatgcacacaattaattttaataaatagccagtgtaattctctataaaactgaaatgttggtaatattccaataaaaatcacccacatgtatcctatttgacatattctgtgatgtcatggtcatttccataagatataaacataatatatatttcagagcaattatttgtagcagacagctggtaaaccaacatatacaaattggaaaatcactaggataaatatgagtgttcaagaaatttagattatatcgacccatgtctatatttaaatctatatttatttataaatctacatttatctgtctgtctctttctcttaggaaatatctctggggatggctcacaaatggcaatttttaaaaactcctcagatggttcttttgtatagccaggattaggacctatattaataaataatatattaataaataatatagatcctaagcctatatataatatcatattatgttattcataaataataaattgggatctatattaaaaatcatagaattttactcaagaatgaaacatgaagccttagaccattgaaaatatagtagccacttttccagaagacaaaattgattattgtaaaggtgtagatttttttcacaaactattttgtaatttatataacaatccaatcaaaataccattttttgacaatttggcaaatgacaaatgattctaaagtttttaagagtaaatagttatatttctatatgctattttgaaagaatttcagtaagaagaataaacgtttacacagatacatatatgtgtacatgacaattagcataatctttacatatatgtgtgtgtatatatatctatgactatataatatcttgtgggatacattgcagtccattaactgatcaaataattattcaataagtagtgctagaacaactggctacttttagaagaaacatcagatgtagtctcactctgcatgaagaagaaagtctataaatcccaagcatcccttgaccaagttctttttattctgagaacaaattctgagactaaaaaaccaagatttatacttaattgctatttgcaacaggagaaaaataagcaactctaaatgtccaataataattaaatgcttgtgataggagataaacctataaaaaatagaataaaaaaggtttctttgtaaaaagatgactaagaaataaattggaaagaaaatatgacaagagttaattatatttgtcttgaggttatttttcttcctgtgtgttttcagttttcccaatctccatgaataagcaaatatgaatttataatgagacaaaacaaaacagaaaaaaaattataccaactactatttattggagttaatttgttcataaaaacttggaatttcatcgagtattgtaaaattacctaaataatggcttgataaattttgctgtatagacatacttaatagtattgaaatgcccttttactttaattaatatatttatttctgcttcaatcaaagacccactctttaaaaaaaaaaaaggaaaaataatttagagtataatttgaagaataaacccgaaagaaggttttgaaaggaaaaatactggagaatcatttgaataatcagttttagtaatggaataagaagaaatattggcacgggaatagagaaaaatatactgataagtattaaaaattccagagcaaaatctatgtgagtttttaatatgtaaaaaggcaaaaagggcctcactcattacttttctttctctttttttagagacaggatctagctgtgttacccaagctagagtgcagtggtaggatcatagctcgctgcagcctcaaactcctgagctcaagggattcttcagcctcagccttagactcccaagtagctggaactacaggcacacaccaccatgcctggctaatttttttttttttttttttaacagacagggtatcactatgttgcccaggctagtatcaaagtcttggcttaaagggatcttcccaccttggcttcccaaagcactgggattacaggcatgagccaccattcatacccacttcacttcttttcaatagaataaataatattgttaatagataacattgaaatattgggccatctgtcagaaatcaattttatttctaagcctatagaaaatgaaagcaaggccgggcatggtggctcacacctgtaatcccagcactttgggaggccaaggagggtggatcacaaggtcaggagttcaagaccagcctggccaagatggtgaaaccacatctctactaaaaatacaaaaattagccaggcgtggtggcaggtgcctataatcccacctactctgaaggctgaggcaggagaatcggcttgatgatctcctgctgaggcaggagaatcggcttgagtgcagtgagccaagattgcactgcactcaagcctaggcaacagagcaagactctgtctcaaagaaaaaaaaatgaaaacaaaccaaaaatatagagaagattataaagatccaaaagtaaagacaaaataatcaaatattagaaaaaatatagggatattaattcagacagacatgaaatccaggtgatttaaagaaaaagatgaccatacctgattgcttgggaatataaattccttgcagatgaaagtcaccataaggaaagagagagaatcctgggagatacttaactaaaataaaatagttactataaagaacaacattaaaattgataggaaaaataaagttttaaaataggtaaatgttgtttaacaggcaattcaaaaaagaaggaaaagcaaatggatactaaagagatgaggttaaatatgtttaatagaagaatataaaaggaaataacaatgacctattcatttcaccaatcagattgatagaaactaaatttttgttcatattgaatacttttgtgggaatggggaaattggtaccctcatgtaattttcgtggaactgtgaaatgctatgaataataataattttggaatttaagagagcagcatctaataacattttgactgtgcatataactttaccctataattacttttgataatttttgtacataaataaaaggccaacatattaatatacatgtcaaatattctaaaaatattaattctgctggcaaaaatcaagaacagtttccatggtggttacatagggaatggctaatcaaataatattttatctcttataggaaaaaggcaagatttaaaaagaatgagtaactgtgcagtagcctgaaaagatgtccatattacattgttaagtaatgtaagcaagttgtacataatgtatgtgatatgatgctccagggttttagacactttatggagtgttgagacacacagatggacacataccaagtaaagctatattaaatttcaaatttagttagttaaggataacaaatcagtgcagaggagtaaaggcagaatacttcagtatgtatactcttggccccagggtcacaagctgggagattgaaaaagctcaattattgctacgcccgcacccctatttttctcaacatgtaagtcaccaatggggaagaatttaaaccatccatctaagtgatgctgtgtatgggaatgttacagatattgggctgtcttgcttgtgtcccaaatttagtatcagcaatacttcactctcatcttagggcagaaaggggagtcagatgccatgagtgcacgaacaatacacctgcctccatcttttcagcatcctgagattcctatttgccatcaatctgcaccttacctcggtttagtatccagttcattttctttctcatatcacagtttgatctgggctctgagattccagaaacattttccttatgtgacaaatttttgccttaaaatttgataccttcttatacatgctcctttatgtttatatgtgcttcaaacaagataaacaaatactcagttcatattttaatctggggaggagagaggcatgttagtattggaaggagtcatttttatttatacattttctgtgttgccatacatattatttaccaacaataaattgtgttatttttgttggttaaaaatatttagaggaaaggaaataactaaaataaaaacacatacagaataatgtgaacattttatatatttttaaaatttcaactttgattttaggttcaggggatacatgtgcaagtttgtcacatgggtatattgcacgacactgagggttagggtatgaatgattccatcacccaggtagggagcatagaacccaataggtagttttcgatgatttaatattaaatggaaacaatctaaaactgcatgtgattagacatatttttaaatggtaaagttagaatagcatgctagaagttagaatagcaagctagacgagcaagcattaaaattttaataatattattagatggtaaggttaaagatataaatttcataaaaatgttggcatattacctggtatagggtgacttttgatttattttgtcatttttactcatattaaataccatgtgtgctaagtttttctgatttttgtactttccttacacatgctagtgtactgtgaaatagaactccataattagtattgtaatggtaggattgacaaacctaacaccgattaaattgatcacgacattagaataccattctctggaatttctggtttatttctaagcatcataattacttttccctgttttctaactaggtcaccatgctgtcagtaatattttcagtgttacagctacccaggttttataataattgccttcatctccactgcagctttataaagaaagtgataccattatcccaattatattttacaaatagggtaaatgaagatcaggaaagttaaataactttcataaagacgcacagcttatagagtacattgttgtcatttgaaccaaggccacctgattccaggttctatgatatcaatattctgtgattacatccataagttaattcatagaaaaatgaagttcttctaaatttgctttctgtaatataattactatgaagtttataattcaaattactgttttctaaaatgctaataatcaaaatattttgtaaagtattcggttattggatgtttcaggcttggaaatgtatttagttgttctaaatgaaataatggaaaggaacttaagtgtttagtttttctgaatatcataaaaattttaaaaataattttaaaatatcacaacagactaattttgagttactttttattttatctaaaatatgataaattttaaattatttagcatattaagaaatcttcataatatccctgtactgagtttattttaaatagtttagttgaactagaatacaagtaaaattttacctggttgaaatattatttttttgattgacccctttaagcctaagcaactgtgcactttaaattttccagataacagatattttgctctcttctgaaggtaacaaaggtaatgaaagtttttacatctgaaacctgtcacggcacagcccaatttaaccataaattgtatgtatttatgtaatcagagtaagactgtcatctagctggcacttacctagaaagtaccatatgtactttcacaaagtgcctagaacttactataatcatttttattgacctggtaaattgacaatagtagagtttttattgttcaccactgtttctactctgcacttttcctgccccatctccttttcttaaacaacaacaaattctgcagttactaggatactatcaccaaagcctatttgtccatcagatataaaactacaattatttgtgcataagtttctcttttgattttttcttattgactgcaggtacacagaattaaattcataataattctgggtttgtgaaacatgaacatcattggtccatgcatgacccattttactataattaattatttaattactagataccaaagtataattatgaattcagtaggtatgcagttctaaagtaagacaacgcccagaaattgtggttcggtgagataaacgatcaggcttttagtctgaaagtcaggctgtagcatctggttagtatgttgcaattaggaggaaataaaaaggtctacctaagtacgaagtatattaatttgccatcaagtataaattgtcaagtctcattaagcacgtagagtttttgtttgctccttgttgctctgtgacacaggagataagctcaaatgactttatagctaacagaggtttatttttccctccaaaggcagagcacatgtttggcactgagaagatctcaccttgtatccacagaggtttgcactagccaatggctgtggacactgttgtcaataattacaagcagtttatttgagtttacatttcatacagtgattattaggtcctgaggacagtacatttcacaattagctgaaagacagttgtagccttttgttctggcagaccctaaatacattgctaatcctttctgaaggaggaaaattaagtatgtatttaatgagttgatagctggaagtagataaatgactgacatatctaagcgtctatgtcaaagaatcgaaataaacacttgttaacttgatgcattagagtcaatatgttcttttcactatcattgtaaagggaaataattagaaaagaataaaagaagttatattagacacatgtaaaggtcttacagtatttcaaagagactattttttagagattattatccctcagatttgaattataatagcatgtgttgttcaagttcacatgccttgaaaaaaaataagatctctaatttataaacaggataaacactcatccccctcaagtgcttgagactatccttagcaaacagtgattgagttaaccctatggcttatactaagctgcatcacacataggaaggctgtgtaagtgctaagttaggtcttagttggtcttggacttagccctttagctggatgatcaatatctccaaatattttagccttagttcctttctgtaaaaaacagcaccaacaatacaagttccatctacttcacgaggttattattagaatcaagaagataataatggtgaagtattttgtaagatttgagtgctatataaatataaaacataatttaaattaaaaatcttgaaaggatctgtagtgtggcatatatgctgattattaaaacttcttaagttagtactgcatgccaagtactgcacaaattatatacatatatatatttttttaaaaaaagatgaatttttccaagcgtttatgattgggttttatcaaaaaaagtgttaaccatttctacttggaggaaattgagaatacaacgttgttaaacattttgccttagattatgattctcagacttctgctattccccttataccaggctgatgatgcattataaaaattataataaaaacaatcttttcaaaaagtcgtgtatatttttatagaattgaaggattaattgtcactaggtttttagaaaggaatgaataatcattaatatgtaaatgaacataatgactgtttcttgaataactaaatttgcgattccaaaaatatttttctgcttatacttttgcttgtttgtatactttaaaaaaatgtacaaagcatgttgactacatacatattatatcaaaaaagatattctattggagaaagagaaattcctaaaaataataccttgtattgtgtactacgtttattgaagtaagggaatatctgcctggatgaacacattctttgatgtatagaccacttgggttcatgcatttgatttaatttgctgggtagcaatttttttcccttattttcaatgtgtctttgtagaaaaatggggtgcctcaaagagaagaatcttctgagaatgagaaaaatatcccttgattaaatgcatttatgatgctctgaacccttgtcaaatcctccaatattgaaattttgaaataaattgtactgctgtatgaggccataattgcatgatggaattgcagacttttgcgaacattttatcctaggctttggtttgtcttctcattctcttgacaatgtcttctgcagagtaggggtttttaaatttaataaaactcagcttatcagttatttgtttcctggatcgtgccattggtgctgcatctaaaatgtcatcaccaaatccaaggccatctgtatttcatcttaggttgtcttctaggtgttctatagttttccatttcacatttaggtcaaggatccattctgggttaatttttataaagggtgtaaagtgtttgtctagattcattttttgtatgtaggtgtccagttattccagaaccatttattaaaaagactatgttatggtctatagttttgcttttgctactttttcaaagatcagttgactgtgttcatatgggtgtatttctgagctctctattctgtaccactaagctatttctccattcttttgccaataccagtctttattactgtagctttatattgagtctcaaagttgggttgtgtcccttccaactttgttcttcaatattaggttgcccattctgggaacttagcctctccatgtaaagttaggaatcattttgttgatatccacaaagtaatttcctggaatttttattgagattgcattgaatctatggataaagttgggaaaagttggtatcttggcaatatctatgaacatggaatatttctccatttatttagatcatctctgatttctttcatcagaattttgtggcttttatcatataagttgtatacatattttgttcgatttatacctatggtaaatttacacttgatcttagccaaaaggctgagaagcgatccctatggcaaatttaaatactgtatttttaatttcaactcctctgcactgatttgttatccttagctaactaaatctgaaatttaatgtagctttacttgatatgtgtccatctgtgagtctcaatactccacaaagtgtctaaaaccctggagtatcatatcacatacattatgtacaacttgcttatggcttccaagaaatcctcggtagcaatttttcaccatgctctgatcaaaaacataccagcttcagccaggcacggtggctcacgcatgtaatcccaccactttgggaggccgaggtgggcggatcacctgaggtcacgagttcaagaccagcctgaccaacatggagaaaccccatctctactaaaaatacaaaattaactgtgcctggtggcacatgcctgtagtcccaggtactctggaggctgaggcaggagaattgcttgaacctgggaggtggaggttgcggtgagctgagatcacaccattgcactttagcctgggcaacaagagtgaaactatctcaaaaaaaaaaaaccataattgtataaatttatggggaagcttgtgatgttttgatatatgtatacaatgtggaatgattaactgaagctaattaatagatcaatcacctcactcacctatcatttttatgctgaaacatttgaattttacttattttggaatatacaatcatttattatagtcatcctgctgtacaatagatctcaaaacctatttctcctgtctatctgaaacgttttaccctttgataaacagctctccatttctatcttttccctagcccttaagcctcttgtaaccatccttctactctacttccatgaattcaacaacttattctgctttcaggcatcaattttcttcttttaccatgggaaatagcaagcactgtgcttatcaaagatgtgcttaaagtttaggcttctagtgagacagaatatcagactctcaagctgaattgctggagttaaacttaggcatttgcttgaaatatcttcagtttgcattcatgcataataggtatagaattaagtgaattaataatgtcaagttattacaacaatgcctggcacatagtacattttcaataagtgttagaattctcttattttttatttatacatggtagttgtacatatttatggggtacatgtgatattttgatacatgtgtacaatgtttaatcatcaattcagggtatttagaatatccatcacctggagcatatataatttgagtttggaacatttgaaatcatttctactagctcttttgaaatttacaatatgttattgtttataatagtcattctactgtgctatcaataattagaatttccttctatctaactgtatgcttgtatccagtgaactacctctcttcatctcacctctccccatacccacatatgcccttcctagtccctggtaagtatcattctactctctacctcccttagctctcatgtatgagtgagaacatccaatatttgtctttctaggcctggtttatttcacttaacataatgacctctagctccatccatgctgtgcaaatgcaagatgtcatcctttttatggctagatagtattccattgcgtatgtacaccacatttcctttatccattcatctcttgctagacacttaggttgattccataactttgctattgtgaatagcactgcagtagacgtggggatacaggttcccctttgatatgctgaattccttttccttctataaatacctactagtgagatcgctggatcatatggtcattctatttttagtttcttgagaaatctctgtactattttccataatggatataatcatttgtattccccccaatagtgtataagagttcccttttctacacatcttcatcagcatctattttttgttgttgttattgttgttatctttttgataatggccattctaactaggtaagattatatctcattatgattatgatttgcattttcttgttaatgatgttgaatgtttttcatatacctactggccatttttttggttttcttttgataaatgtctattcagatcctttcccttttaatgtgattgttttctttttgctattaagttgtttaaattccttgtatattctggatactggtcccttgtcagattttatcccattcaacagattgtctccccactctgttaattgtttcctttactgtgcagaagcgttttagtttaatatagtcccatttgtctagttttgtttttgttgcctgtacttttgaggtcttagccataaaatatttgccttgaccaatgtccaggagtgattcccttatgtttcctttaagtggtttcatagtttcagttttacatatatttatttaatccattttggtttatttttgtgtatgataatagacgggtctagtttcatacttctgcatatggatgtccaattttcccagcaccatttgttgaagagggtgtactttctccaatgtatgttctggcacctttgttgaaagtcaattggctataaatatgttgatttatttctgggttatcaatattgttccattggtctatatgtgtgtttttataccaataccatgctgttttggttatcatagccttggaatatatttcgaagtcaggtctgtgatgtttccaactttgttcctttttctcgggtttgctttggctatccagggtcttcttttggttccatataaattttagtattccatttctgtgaaaaatgtcattggtattttgatagaaattatattgtaactgtagattgctttgggtggtataatcatttaaaaattaacttttcattcaatgagcatgaaatgtcgtccatttttttgtgtgtgttctcttcaatttctttcatcagtagatgtttttccttgtagaactcttttacctgcttggttaaatttattcccaaatattttttgtagctattataaataaatgctattgctttctttgatttattttttagctagtttgttattattgattttttgtgagttgattttatatccagcaaactgttagcaatttttgtagctatttgtcagatttggttaagattcttgttcttatttttttaatttttaaaaatattagacacaaaaattatttaagaaaaagccataacacaattgaaatattaacctctggtaagcacattcaattatgagagataaacatgtaatctcaagtaaaaatttacaccttgattaaggactccaaggtttaaatccattggaatggactttgttgctgacatttaattaacatttgtaacttttattatcttgttatatttaaataaacgtttagtttttttaattagatgcatattctataattgtttcctattgttaatcactataataggtaggtaacattgactcttaagatacaaaatatagaagaaacaacatgaatgaaatggtacctataaataaactcctttgaagataagaaatgccaataggaccaggtgcagtggctcatgcctgtaatcccagcactttgggaggccgaggcaggtggatcacttgaggtcaggagttcgagactagcctggccaacatggtgaaaccttgtctctaataaaaattaaaaattagccaggcatggtggtgtgtgcctgtaattgcagctccttgggaggctgaggcaggagaatcacttgaacctggaggtagaggttgcagtgagccgaaatcacaccactgcactccagcctgggtgacagtgagatttcatctaaaaaaaaaaaaaaaaaaaaaaaaagaaagaaagaaagaaaaaaagaaaagaaaggaatacctaaatacctatgttgtgacacctagatcttctgactcactttagctttacaaagtaagaaagtgtgttgctacttctaaaagtaataacacagtaatctgttgtcattgaagagtcatgaaaaccatgaatgtgttaagatgttttgaatgttacattttgtttggtctccaatatgtttaaaatttaacaataggtaagtggccgtctatctatgctggtataacaaagtatttgagatagagtaatatataaatgatagaagtttgtttctcacagttttagagtctggaaagtccatgattagggaaccagcaagttctgtgtctgttgagggcccactctttgcttccaagatggcaccttgaaagttgtgtactcacacagtgaaaaagagagagaagcaaaagggtctagtttgttccttccaactatatcacaaggtcactaattccattcatgagagctctgcctcatgaatcacctcctaaaggacacacctgttaatactaccacatacgggtctaaattccaacatacaaattttgaagagacacatatagcagcatcagtttattctcaatctaagaatagtcattatgtgcccttagcccgaattgtgagtagactttgtgttgtatgtggattgttgcttgtaggtgtgggccaccccagtaataggtttttgcaggtgctagtattattaaagatgagaaagtcctctagagagctcttatagttctagcagttggttccctagaagtggctgttataggtaaagtgttttatagaaccttagagataatcagataacactacaaataatgcctgctgagtatgcagtaggttagagagtatcagcactcttttaaaaatcagtttggcttctggtctctcaagcctataaaatctacttatgtagttgcaataattgtgtttttctgtataaatctctgcaaagttaaagtcattactgtttatgtttacgaccctaagcaatattccactttattttaccaaataaacttcacagtgttcacctagaaaatagctacatagtgacagtgattatttctaaatatactttagtaaaatacaggctttttctttatgcatgaagggaatcactccctgtctaattttttaaaaagctctattttcctgtgtaattaattatattgtatatagtgggcactagcatgtttttgcgtggaggaatgttatatatactgtcttaaaatgagattcatttgaaataggaattacatatcccttaattcagtaccacagcatatattcctttcaatgtggttcctaaaatttgtgaaaaggcttaaaataacaccattaacaacagtagtcaaaactattttttacatatctctgaatctctgattctcaaaattgtgctcctgctctttccagaaatgtgataatatcttctagatggtgtctttcaatccatttaatttacatagtctcttctatttgatttagattgttggtcttgccagaaaggacagtgattaccatctttgcatgtatagtacaaaaaaaattattaatatactctgtctaaaaatggaataaattttcagttgacacaacagggaaaagaaaaaaatatttttccagcccaagaggtatgacagatccttttacaaatgttaacctaccagaaagatttctcctctggtagaatctgtgattgctcctgttcggaattttgactctcaacaaaattcatcgtatgattattaaaggcaatggatttaccagtgaatgctgttgctataagattatctcaaatgataaaaagaatatattccagatgctatttgcctggtttgtggtggtcgggggcagggtagggggcggtgtggggtggggctgagagtgggagaggtgggtggggatatagttaattcaaattggcaatatcaataagaactaaaaataatagtagacatctgggtttccagtcatacattttagatggttgtaaacacatttaatgaactcagcaataattaatatctaatatgttcaaaaccatgagctaaattatatcacagggttaaaatgtgtatgacatatacacatagagtttataatatatttcatccatgcacttaataagaaaaataatatacctaatatgcataagtggagagatatacaccagaagtattttacttttttttgtataatatttccttaattaaaagccaaatccatatatttaaatttcataaatgaaaccctagtctgaagaagctactttgtggctcgtttttagagctgtataatatatttaagcactacagtttgaagcattttaaataataatatagtactgtaagaataatttatgtatgaagttcattttgaaactctttggtgacaactctattggaccaaaattgatatcaacaaaccaagcaaagttgtatttttaatatgaagaaaggataaatgaacttaaatataagcaggagacttcacacctttctccactttgctggggtgaacatccctggttatcaagtctgcattaagatatcccaatgcaagagggtatctgtctctgttcagggtggatctctcttcagctggggattctggtttcttattctgctgagaggtctagagctgatatgggtattctatcttcttattttaataccgatatttgtaaattaaaagccagccatatcagtgtgtgagtgtaatttactgtttgaatactactttctgtctcatcagcgttgaagttaataagacatacattgaatatttctgcaaaaataaaacagcctgcatagaattggccaatctctggaatctgacctctcctgagtattaaccctacagactgtctcattatttgtattgtaatggtatcaaatttgtagaagaaatttctgacataaattctcaaaaagataactggccaaacactgttacctgagtgcataaaatatacactccagttgaatcatagatccatgcagtcattctggccccaatgcaagctatcacaggatttgcttgcaaaatcaaggagtcaaagagaatatgcataaaatatggaagtcattcctgagagtatatatatgggccataacaaacaccaaagcttatataacatcataacttgattatgtatatgctggtgatacccaaaggctaggtcataatactgaaggaaagatacctgtagaatcacaactgctcctgagtacaaggtaaatatcaaccaaggctgttatatgtcatttgtgaattaaaacactctccagcaatgttgatccacaagaaactgttgagaccaacatgcttacttcaacattaaaattatatcagataaaatactagaggctgtgtcatatatccaaaggaaccagcaaatgcatctgggaaggaacttatgtaaagcactagtaatcaaagtccaaattcagcttcagagaagttatcagattgctggaaaattgcctgagaatgtggaagtattcaaaagggagatgtaaaacgtccttggataaactcaatgtacctgaaaacatttccactgaagaaaaatagtctagggcatgaatttctaacttatccatgtattctgaataataactaagctaatattttaaaattacctcttatatgccaaatactgtgcttagtaccttagtgcatctcatttaaatttcttaaaaatcatattcatagtttctatcaccatttttaaaataaagatgggaatctcaagatcagagagcctaaataactgccaaaagttactcagctaaaaagaagtagttctgagcctggaatccttgttggcataactctaatggttaaacattctaaaaaactaaggtagacttattctccgaagtttgaaaatcttctatgttatactatttatgctaacattaaaatctagtgcaaagtctaaggcctaagtggagacaacaaatgtctagtgaactaagacgtagtggtatagttatacctatagtcaaccatctccttactattatttctggagtaagatcttagcaaactttaaccttgactaagcttaaacattagcttttattagagaaaaagcatccataatttttaatttctacatttcttagaattttccaaagttttagggaaattctgctttctatagctaaggggaagggagaagtggaaactcactcatggatatcatgatagactattgcatcaataggaataagatttattttaccaatgagaaattacattctaagtcagtatttgcaataatgcattgctagatgctatcatttatgacattgcatctacagtcatagcagttgaatttaaggaatgtgtaaaaaggaactttatcttatctagacatacagtaggcattttcactgtatcatttttgtttgctgcctaatgcaactccaaacattcaagttggtaggaagaaattcaccattgcatctattgtagcacgtttatttttatcttagaagaattcaagaaatttcaggggattgattatgggatttaagacctttcactttagggccagtcttccaaagctgcatcagtaatgactgaaagttgtgcatctctgtggccagtatagtagcctacatgaaatcacttagcgatcttaactcctgagggagctgtcatgattgacagtttgaacaaagaggacaagaatagaatggacctattaactaggactgagtgaatttctcctgtgggcatgacaatgtttacctcctgcaatttagctctttgtgacagagagttttaaaatggagaaagatgttttattcagtggaggaataagagggatacagcagagtttgattccagtgaatatacaagaacagtcttcttattctttctacattgctgtcttcatatactacatcaattataaatgaatataatgatgcttttgccttgactctccagatttgctttgttcaagttcattaatgtgaactgtcataccatttattattaagtaacagaagaaggtgaatatacagttatatgtcatatactctattttacatattttagggaaatttagctggagtttgtagatttgcggatcttataatttaagaaaaatgataacagtttctgggcattctcaggatactttttaaacggccatcctctctcttaatatgaatcatataaatcacaaagtcttagcagtttgtagctattctcaacatgacataaataggtttggcagtaaataagtccctcattgtagactccttgggttctgtagtgattggtgtcttctctaagtaacttagaacactatttgaaaataatccagatcccagaggaaacaaaagaagtgaaacccttccctcactgctgtaagtgaatgagtatttcataatcacttagaccaatggcagatataccctaagtgttttgtgcttattaaatataaactaagcatttcagaattatttttgagatagttttaatggcttctagaccttcttttaaaatgagaaatctcctaaatggaaccccttttagcaatgtctacaacaggcactaaaacaaggggatgatatgaataaagaattaaagtgtcactgatttcttcttctccactttagtctgacttcccagtctcagcccagtaagggatctttccaaatgggttttgatttttacaggatgttgctgaccagtcaccaaacaatgtaatggagtcccatggtcctcggccctctgccaaatatgattcaaatagcaatcagtgacacagggttgcatctgtgcttggtgcacaaaccctgatagtgtagacatagcaccagtcacaacatcaccaatcactaaaggaagcttgtttattaattgcttcatttctcaagatccttatatcacaagtgggtactgaccttgactgatctatttcccgcagtaaaacaaaacaaaaagtctaattattgttcatttgacttttctatataactcaaaactatcttcttactaggtcatcttgatgagcggaaagttatggaagcataattgcggtcagtgtatttagacaatatgtatgatttaagctttgttttgcagaggaaaaatgcttttcagattatcacatgtgctacatttcctagaattatatcagtttggtcacattccagagaatatggagagaatatgaatgtactttaggagaatctcttgaaatgaatacttcttagtgataccaccgtatgatcttacttctttaagtctcttttatttttaaaattgatatttaacttttcttctttgtaaaaatttcatcggaatattttatgtgatcttagtgattggatacatagacattctttagataggggtccctaatccctgggctccagacaggtatcggtctgtcacctgttaagaacagggctgcacagcaggaggtgagtggccggtgaggcaccattactgcctgaactctgcctcctgtcagatcaacagtagcattagatcctcatagaagtgtgaaccctattgtgaactatgcatgtgagggatctatgttgcgtgctccttacgagaatctaactaatgcttgatgatctgaggtggaatggtttcatcctgaaaccacctcaccatctctcacccttgtcccaccacctgcatcctatggaaaaattgtcttccatgaaatcagtccctggtgccaaacagtttggggaccactggtttacacgagccctcacagaataaatatagcaacaatcacattgcctcttatggctcagagggagcttattccatttccccaaagcttcaaaacgaaaagtgggttcttactgttggataatatgaactgctgtggattgaaatatgtctcctcaaaattcatatattgaagccctaacccctaatgttatgatatttgaaggtggggcctttggtagataatttggtttagatgaggtcatgagcgtgaagatcccataataggaattgtgcccttataagaagtggaagagaggccagagctctttctctcttacatgtcagacacagtgataaggcagttatctgcaagtcagaaagagagctgtcaccagaacccaaattggctgtcagcttgatctgggacttcccaacctcaggaactgtgagaaataaatttctgttatttaagctactcagtatggcatttttaaaaatggtaatctgaacagactaatacatcaacatagaaaggagttccattggttatttgttccattggttatttattctctatttttggcctgacccagccagttgtgttgtttcatctgcatgaatgtgtttaacccccttatgaaccaaggtgatggttccttatagaatagaaccctctgccaaattacatttggatcttcagcacttcattaaatgttccccaagagatagtttaccacttattattactctttgtttacaaaatgtcagtcatttaatttatatttaacaaataattgtttaacatggaagtttattaatattccaaattctcaactaagttttaaatattgacttaccaatatccattgatttccaattttgtagttaaaataaccaataagaaattattaactttttataactatagttgtaacattatctacaattatatatttatttttgctttccaattacttaatctcaatctccagatgaaaacacctctttcttagtacctaattgttctattcaaacctagtctctcctattaagatatcttagctaacattatttgctctaacaaaaattaatgcattcccattattctacagtaatttcatttttatgttgcttacgataattttaataaattttgatgagctgttgaaggaaatactatcatttgcctaatttttaaaatatttctagattccatttagtggtattttaagctatttttatttataaaatctcttacattaatcagtttactgtgaaatttatcatgtgacctctattttcagcgggttcttaataaaatattttatatctttaatgctttatacacaaaatgatagaaaggaaattttttttttttttttttgagatggagtctcgctctgtcgcccaggctggagtgcagtggcgggatctcggctcactgcaagctccgccttccaggttcacgtcattctcctgcctcagcctcccaagtagctgggactacaggcgcccgccactacgcccggctaattttttgtatttttagtagagacggggtttcaccgttttagccgggatagtctcgatctcctgacctcgtgatccgcccgcctcggcctcccaaagtgctgggattacaggcgtgagccaccgcgcccggcctagaaaggaaaatttttataatattgtttaattcaaatatcactcactttaagagattttctctgatatttttcaactggatatgatcactttctctttcaaaagtgacaactttagtttgtatttattgcagcattttccatggtttatcttaaagtactcacttgagtaatagctctagacttcagcagattataacttttagtgtatgatccattctttcttagtcatttttgcctccctttcatcctttcctgggtttttgaatagtgtatatattaatattgctggtggactctcatgaatacttgatgtattattccattctcatgctgctaataaagacatacccgagactggttaatttataaaagaaagaagttccatggatacacagttccacataaacagggggcctcacaatcatgacagaaggctaatgaggagcaaaggcacatcttacatggtggcaggcaagaagccaaagttgcttccacattttgggtatctttacagcagcaccccactcccagtaccaatttactgtattagtccattctcgtgctgctaataaagacatacctgagactggaattgataaaggaaaggggtttaatggactcgcagttccacatggctggggaggcctcacaatcatggcggaaggtgaatgaagagcaaaggcatgacatatggcagcaggcaagagggcatgtgcagcgaaacttccctttataaaaccatcagctctcatgagacttattcacactcatgagacttattcatgagaacagcatggggaaaaaaaaacccactcccatgattcaattacctcccactgggtccctcccataatacatacagattattacaattcaaggtgagatttgggtggggacacaaggacaatccatatcacctgggtgttttttgatatttctgttgttgttttttatttttttatttttttattttttttattatactttaagttttagggtacatgtgcacattgtgcaggttagttacatatgtatacatgtgccatgctggtgtgctgcacccactaactcatcatctagcattaggtatatctcccaatgctatccctcccccctccccccaccccaccacagtccccagagtgtgatattccccttcctgtgtccatgtgatctcattgttcaattcccacctgtgagttagaatatgcggtgtttggttttttgttcttgcgatagtttactgagaatgatgctttccaatttcatccatgtccctacaaaggacatgaactcatcattttttatggctgcatagtattccatgttgtatatgtgccacattttcttaatccagtctatcattgttggacatttgggttggttctaagtctttgctattgtgaataatgctgcaataaacatacatgtgcatgtgtctttatagcagcatgatttatagttctttgggtatatacccagtaatgggatggctgggtcaaatggtatttctagttctagatccctgaggaatcgccacactgacttccacaatggttgaactagtttacagtcccaccaacagtgtaaaagtgttccagagtgaacaggcaacctacaaaatgggagaaaatttttgcaacctactcatctgacaaagggctaatatccagaatctacaatgaactcaaacagatttacaagaaaaaaacaaacaaccccatcaaaaagtgggcgaaggacatgaacagacatttctcaaaagaagacatttatgcagccaaaaaacacatgaaaaaatgctcatcatccctggccatcagagaaatgcaaatcaaaaccacaaagagataccatctcacaccagttagaatggcaatcattaaaaagtcaggaaacaacaggtgctggagaggatgtggagaaataggaacacttttacactgttttttattttttatacaatgtaagtgtcttagtgactctatcatttagatggaaattcaagaccactaaatcagcagaatggtagagtttactagctggtgattttgtctgctccaaaaaaatattttatctaaagcacatttttgagctgcctttaatttataataaatgtatcatatatggatccaaaggtaaaaatctctctcaaatagaaattaaaaggctttatttattctgatcacatttctttataattttacagagcatttaccacctcagcctgatatttccggaatgaacccttaatcttttaaattagttatcatatgacagatacttgaactttttattcttctgaaatacagctacactattgtatctttcctaagttttcaggaccaaaaacagccgttctctaggtttgaatgaaacataaatagctagatgtatttctgatttacttttatcctatatgtctagaaggcaagatccctgttagcctttcggggtagagcaattcattaaaatacggcctcaattttaactaagtaaaattaaaaatacagtgtcttaatcatactagccagatttgaagggttcaaaagtcacatgtggttattgactaactttttggatagtatagatatcaaatgtttccaccatcatagaaaattctttggaacaacagcaacagtagtttacagtttatcttttattttacaggagttttcatagatagacactttacatgagctccatccaaacttctaaattaaaaacagacagtttgtttgcactgaaaaattcattttcccttgtcatttgttttttagttgtaacatttctttgactgttatacaccatttttgtgtcaaaatatagatattttttccaatgcctgacagctctctattttttctttttatcacttgtttttagtaattttattatgatgtgtctggtgtggttatatacatatttattctgcttgaggttcattgagattcttagatctgtgggattatcatttttatcaaatttggaatattttggccattaattttcttgaatatttttctactagctccttggagactccagatttatatatgtttaacggcttgacagagttaaatattaactcactgaggctctgtatattttttcaatgttttatccctatactacattttacatattctctatttctacaacttcaaattcacaaattcgttcttctgcagtttcatcaccattcagtgatttaaaaaaaagttttagatattacagtttttatctttaaaagtcccatttgattcattttttaacatctttaatgtctcttctggtcatgggtcatatttcaattcttaagatctgtaggagtttttgtgtgatggtgaaaatagtgtattttatgtgattgaatgacttctattttctcttttcttttttcttttttttttttttttttttttgagacagagcctcactttgtcactagaatgcagtggggcactttctgctcactgcaacctctgactcccaacttcaagcaattcttctgcctcagccttccgagtagctgggatttacaggtgtgcaccaccacacttggctaatttttttgtatttttagtggagatggggtttcaccatgttggccaggctagtctcaaactcctgacctcaagccatctgcccacctcagcctcccaaagtgcagggattacaggcgtgaactaccacacctggcccaattattgtttttaaagaagtgttatacttttctttgacagacatttgggttgtttctggtttagttggatcatcttaagccttgttttcaacttttgctagggtggtcacagaatacctttacctattggaatctttaatctccattactaaggctcacccttctgatgcctaaatttaattctccaggtagtcaatttggactctgcactgctgctggtaggaacttgaatgattcttggccttctgcagttcttggaatcattcagttcacaagtttgcaataacttcttgcccagcctcgtgaaattatagcgtttgcatacatgacttagaaatcagcataggttcaaaggactttaaagcagatttctagagttctttgtctgcatagctctcttgtctcaagaaacctgtcacacaaattccaactgccccagatgctctgaactctgatctgtatctcctcaactcagtagggtcactgtctcagtttgcaatatcttccccactccacggacactgctctagacctgaaatatgttttacaggcagaaagcttggctgtcctatgttttactttccttgtctcttctttctcagatgtaatggctctgtactgcctgtagtttaatgtcttaaaaacagttgcttcatctatatttccctggttttctatttctttgagtcaggagggttaatttagtcactgttactccatcgtggctgaaagtggaagtctttcttcaactgatgtaaaagtttatgtaatagaaaagatattaaactatgaattgaggcctaacttttagagaatgttgaaatgacagaatacaatactacaacaaaacttactcttataaacactgatagaaactgacaagtcggtggttgtgaagaaaattagatatatagatatgtatagattttaaggtaagtaagagttattaattagaattacacagttgtcagtttggaggtacaggtatgagtgtcatctacacagaataaaagaacagagcagagtccaagatagcatgttgacattcacagtgaggattcagagtacagctgtaccctcgaattaaatttgaccaagggttatcaatggcagaccaccgggctctgtaaaccacaggtctgatctaatctagcaattcttgtgtttgcattttaaccaatgtatatctgtccaggaaataaaatgtcaactataagaattgtttacccttgaaaataactctatggtgtttctaaaaatatatgtcacatgagatcacaaacaaagtagtatgctttctgtggattgtattactggtgttggcttggaatggtaagaaaggaaactgactctaaattacctatcttgatttttcttgtttcattaattctcagagcatttgtcttgagatatacaatatctcaaattgcaagataaaaaaatatatatcaacttttctttcttcaactctactttgaataattcataaaggaaccacttaaaggtagctaatctgaatcaatacaaggcagtgttataatctttgtttctaatggtgttttactcttaatttttatgtaaataactgaatgtattgtttattaaactgatcttcattataaggagatatttataatgttggctgtccaatatgaagtaaagctttaaaaatcccagatgtaatattgaacaacttaatttgaaacattttatgctacttggttgctcttgatttcaggagtatctgttttaaatgcataataagtacattttcaagcatatccaatttacatgccttaaagacttccaccgccttaatgcttaatttagaaatatcattttaaatgattcttaaaaatcagatgcacttatttttgtagctgtaatattttaagagagccttcatataaaaatatagttgtcactgacaaactgtatcaattagctaatgttcaacaatgatcatcaatgtcagggactgttaccttgttgaaattttagtttagccttaatggtgtctataaattaataggtactgtaaatgatgcatgacaaaaaatgggttgttagcaaatgttgtggaaggaagaaaggaaggaaagaagggaaggaaggaaggaaggaattttcaaggccttaagaataaatctatatgtgctggaatacttagaaataaaagttttgtttaatttaattaaacacagatattctaccaagctcacaaaatgatttttaaaaatactagcaatcattaggcaacataggagcctttagttaagtgaattagaaagtgaagttaagaataaaatttcaacagttacctaatctactaatttgctgatcattgatgaacactggctcttatgttttgttttgttttgtgtttttatgaagctgacatgtactattggttcaaataaatagcatatatagtattctggctaagtcgcttatttttaaaattgtggttttcttatgttaaatttttgaattgaatttctaataccatttttccttttccacagcctttaatggaacaaattgttagtttctgacagaagggttctgatgttgaaatagacagtatgtctacctattacagaaatatagaaataaaaatgcatgtactcaaacagaagatggaggttacatttctttattacatctatcatcagaccttagccatgttggatttttggttgctgttgatagaataaggcagattttcctcaaactttcttttgcaaaatagttagacttaaatataaaaacaactgcaaaatattcagtcattaacaaatcaagaatctttataactgaatgttaagtgattatgttttttctactgtatttagcaatgcaatacttaccttttatattactaaatatattaattttattctcaagaaaatcattaatacttagggattggaggtttcctgagtgtaatattgaaaaactgttaaaaagccactgatacccattcgatctaatgatttaccttttgattatttgttttgtttgtttgtttgtttgtttaaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttggtaagtcatgctcagacatggatctcacgttattgttcatatatctggaaattgttttatttcacaaaacccaacaccactgttgtttctacctcttctttaaccaattagagtgattttatatttattatttatattttttcatcctcatattgttttgtatataggtatcttattttctgtacaaatttataaatttgagatcaaggctactttgcaatacttattacctccacccatcctaacacagccaggcaaataataaatatgcatcaggtttaactttatttgacttgagatagcatctgtcttccaggaaacactatcctatgcaaaaaataacttcacttgtcatacttatagcatttgatctgagcctaatgcattttcctcatttcctatgttttggaggagaaggggtagaaaatagcgaaagaaagtaaatttttagaatggggaaaggaatataattcacattttaaaaatctagttaaggattttgtgtattatacctgtataatcatgcataataatcagatttctgtctaatgttcaagaaataatatagtttttttcaaagaaaggaaaacaatgcagtctgaaataaaaagacttggaaaaatattttataattaatgtgtagataaaaatcaaaattagataattatttagatgtttttctaccttaggaaaaaaatatggttaatatattaatgattcctcaatttatgtttcttgttctgtctagattaatatatcaaactcattgtacagcatcttctcatggatactcaaaaggcatttcagcttcatatgcccagaacaaaacccatgattttccataccctcaaccttctccactcccaaatttcctcatcacaataaagggaacccccaatttatccagtttaaaaaaaaaaaaaaactttgattcttaacttcccccatcatcaagttcgcttgtcaatatattacaaatatagtccaaacccaatctccttttaaatgtgtgctgaaggccatctcatacagcccatggttgtatctcaggggcactgaaataactccctagttggtccgcttctttttactcttgccagagtgtcttttaaaaacattgatcagattatgttcttaacctgcttttaaacctctaatgcctttctcatacagaataagattcacattctataccatacctacaatgccctatactgccacatcttcaattctatctccttattctctctcccttcttgaaccactctagtaatgctggctgccttgataatgcctcaagcattccaagattgttcctacttcagaggctttgtatttgctattccctctgctcagacaacaggtctttgctaattatttgctcctttctttagagtgtgctgtgctaaaaatttacctccagtgagaggcctttactgaccagcctatctaaaatagaatagtcatcttcctccttctttcactgtctattctattactgtgtgttaatttttttcatagcacctatcagaatctggattacatagttcaatttataatcttacctgtgtcatgaccacaaatataaagatgaagaagcatacaaaagaagcaagttaaaagtatagagaaatcaagctaggagagtgttaagaatattgtgaatattatcaaatgatataacacaattaaaactatttgggaaggtatgaattcattaaaatgtaggagaagtcagagggaatagtcttgagggaaaaaagcaaaagatgttttgggtaagtgcctgatatttaactgcaaacaaatcactatcagataggaatatagtttttatttacattggtcccatcgaactttctatattttaaagaaaggaaagaaaggaagtgctttccaacagacattggtatattttccacttgtctttttgttttccttaatgtctccattctgcttgcttactttgatatgggaattttctgacatttgtgttttcctttttaagttgaaagtcttaattcagggccatatcccagcagatttcagggcaagctctatttactgtctgtatcctgattgttatgaaactaacaaatacttgaggaaatgcatttaattatttttgttgtttgaaaaattaattatcagtttaagatcaattaaaagcctgattcactttttaatgagctacagctaattttctggagttctgtttcctatcactactcagttgattgctgtctttttgagaagaatgcaatgggcaaagataaataccacactaaaaatgtagtgccttacatgcacaaacccaaggaaaaaaatgatgacaccaaattgctttgctttgagaggcacaaagttaaattgtacctcttctaagataccatttctcattctcagtcattcctcttagatcctctcttagttttgtcctcaggtaaatctttagagcatatatcctaatcatctataatcacactttgtgcctgaaaccaagtcttagactttatttctttagttcaaatctcgtctttcactacctctgtccaagctgaatgacttcatacaaagcaagtacattaaaatttatctaacaactttgcttttcaggtcaagtgcttgaatatacccagcggtttttttgtttgtttgtttgttttttactatgttgctagaaactcaggcaaagacatgacttccaattgttccctatagaagttagttcatccatcaggtcccgaagaagaccctcagtttgtaggatgtatatacatttctagctttaagtattatacctttgtttttgatgatttgagcaaaacttaggttcaagtatattaatcacttgcttcttgagttttttgattcccaagtaaactctttctaatctgccctccaacaaaccccggccagttcttaatatgaagtgcatttttatggatgaaataataggctattattatatgaagttattattagtgtcaggtaccacgacctatctaagcattctcctttctcttaagagtgagaaggaaattaatattgattagatcatgcactgcattagtactttacctttattaccttatttgatctcaaataatgcatatttgtacatcattttctgaaaaggaacaatcttttatttactgcatgtttaaaatatttatatatgatttagagattaaaaattaaacatcagtagtaccaggaaaaattaaacactctaatgtcagttcttaaagttttatgaagactatagataacttggccataatttaatttactttcttatacatttccagttgtttggcacgtctttcgcaccatgatagagggtatccatgtttattcttagcttctgtctttgatatataatagaagactgctaaaacctctgtggaaaaacaaaaaagattgcattttgactcatattacttagggattcctaaaatgtcagaatctatctatgaaattattcattattcagaatttttttaaatcacaattcctataatgtaaaaatcctcataaaactttacgtctatatttggttatttaattgattttaatacaatttaaatataagcaggtgaaatttaacatatcctcttaatatttaattgagtttgaattctaagtttgttaatattggaaatatttattgcatttttcaatctaagtgtagtcattagaacttttttcctcaaacacattatatgcgagataaaaacattttaaatgcttaatagagacaatttttatgagtagtcacatacgaagtgtccttttacacaaaatgttatgcagaggttagagactaagactagacagtgccaattttatgtatctattgattacattggcttgattacagacatgctataaataaacatttgcaatgtctttctttatattcggattattttactgttacaatgcttgtaaaagatacaatttatgaacttgagaagccagctgtggatagtaggaggaaccaaacactgaaaaataatttatctagagcaatcatttttgttctgaaacccatatgcaggcccctgtccttaagaagcaaagtgtgctttaggaaaagaatatataaagcagagaattaaattaattgtatcacattgtaagtgtcttgcaaatgcagaaagaattcaaagtgggaacatgatgaatagggatggtaaattttaaagtaaatatggtgaatatacttaactagatcctgaaggaagtaatggaattgtcttagtagagaggaagatgtttgagagagatataagaacaaagaagagaacattcaaatgcttgtaacaattcccgtcaagcatgtgctgagagcaatggatttcaaatgtcttttcatccccaactgttttgcatccagagtgatcttttcaaaatgcaaatctaatcatgtcactgtcttttaaaactttcagggatttctcattgttctcagaaaaaagaatgaaacctttgctgtgggctacaagtttctacctcatttgtttctttgtcacctgcagactcacatcatagccccatcagccttgcttagagctacaactacattcacttctttcagttctttgaacaacttgtgttctatcgcccaacagggcctgtgcacatgctatcttgactgctcagaaagttcttccctatgaagctctgcaccacctcaccctacttccccacttaatcccttttgcctggctaatcattcttcagatctcaaatgaaatttcagtactttagtgaaacctacttgtgtccctcaaagctagctggagtgttttacttcactttctagcaagtatcttcttttcaattgtatttttatatttattattttgtaattgatatctgtcccttctccctctaagctataagttttttagggcacggaatatatatgtttttactcatcttcttagcacctaacaaaatgctaacacttccatggcaaatgctcagtgaggatgtactggatgaatgattggatagatggttagtaggaggaatggatggacttggctaaaggggtccctcacatggaaaagagcaccacaggaagaagacaaagaagcaggaggaggagaaataagaagagaacagggagaagaaggaaggagaagtggcaattacaagttccccagaaagtgaggcgatatagttggggttgctgctaagcgaaggcaaagtgatcatgatcagcttgctaaggagactaggtatttaatcttgaaattcttcaacagacattccaaaggtaactgtttcgtaggcctgatttcagttttttataaatataatccaatctttaataagcatgaaatattaacacatatatactttattcaaaagttagagtgaaggatatattggtttgaagaaagatttctattcatgaaaaacttcctacacattccttaaaatgtcatcctttcatagttttctcttattaatagctggatatttgcatggcacttcatcattgtcaaagttctttcatgcacatattatcttctttgattttcacaacaatgccaataaataatattagtatttacgcccattctgctggttaggagccaaagcacagagaaatgaacttagtctatatcacacaaatggtggtgcaagattgttggctcacattttctgaccgtaattatttttactatttctctttccagaaatttattccatttcagcagagtgatcatcaactctgtcatccaaacagtaatacttttgagagtaaaaagttactctcattgattttgctttgtttgtggagcctgtcctgtgcatggtaggatgttagtagcatccctgcctttttttttttttttgagacggagtctcgctctgtcgcccaggctggagtgcagtggcgctgtctcggctcactgcaagctccgcctcctgggttcacgccattctcctgcctcagcctcctgagtagctggagctacaggtgcctgccaccacgcccggctaattattttattttattttattttattttattttattttattttttgtatttttagtagagatgggtttttcaccgtgttagccaggacggtcttgatctcctggcctcgtgatccgcccacctcggcctcccaaagtgctggattacaggcgtgagccaccgcgcccggccgcatccctgacttctacctgcaagatacctatagtaccccttccaaatagtgacagccaaaaattgtctccatgttaccaaatgtctcctgggaggcaaaatcactccagttaagaattactgttgtagggtaatcataccaaaataaactccattaattttcagaattgttctaatggtcttaggataaactatattaaaacaatgctttgaattattttgacagtaactcataatttataataagaatgtatcttttccaattgttcaggaaataaaactcagtaagtgcgtttcagggcaattttaatgtattcatgaccatagcttacccacttatatcaccagtttgttacaaagccttctgtctcttcacatctttaatacactgacttttagaggtgtgatttttctccgttagatccctccattcaaacatgtctaatcgccactagaaatgatgaagaaaaagaaagtatcatggaagagttaagtgaaaaatacggagtaccaagattactcagaggctcaggacgatcttcaaatatatattattcaacaacaacactaaaaacttgttaagacaaatacagaattgtagtatccctagttgatgttgtctctaacaaatacattagttttaccaagcatccatcctatttcactttggtaagtattattcttctgcatatgcctccagcttcaaattagatggagtatctgagcatctagcaaggacagattgacagacagcctggggtgaaatgagtatggataatcatttttgacaaagtagtctatcacagaacccctaaagaagcacatgaaccttatggagatttctaagtcatgaaaaatcttgtagaaaacatccaaagaatgctgcaggtaataaatagcactttcagcaatgcaccattatgtaattctattaccatttggactgagaaaaaagaagataatttttagcttttgcctcagtgtctaaagaagatattgttatcataatttcttaacttgataggttaacaaaacttccactctcgaagatacaaatcaaaagttagtgcttcagctactttaaatattcgctgcaataagcatacaaaaatatttgaatatgtaaatcttggaatttttcttaacaacctttgaaactattcatcattctagctttttccactaactaaacgttcaactcattcctatattttaaacatccaattttcctaccatattttatgttatacagattatgcaaagtagttcatcaattgcagaatgctatgtagagatggctactatatttgttttaaaaactctattcagggtgtatacgtgcacatgtaccctagaacttaaagtataataaataaatatatatattaaaaaaaaaaaaaaaaactctattcacgggccgggcgcagtggctcacacctataatctcagcactttgagaggccgagacaagctgatcgcttgagcccagcagtttcagacctgcttgggcaacatggcaaaaccccatctctgcaaaaaatacaaaaattagctgggcttggtggcatgcacctgtgatcttagctattcaggaagctgaggtgggagaatcacctgagcccgggaaattgaggtagcgggctacagtgagctgtgatcatgccactgcactccagcctcagtgaaagtgaaatcctgtctcaaaaaaaaaaaaaaaaagtctgttcacaaggctgtggagggacttaaatggtatacaaatgagtgggagtgtgaaaaattacttacgagatggtattcagtacaaatcacttttgtttcatcttttctgagattcatagaaatatattgccatcctgtatcagtggcttgtagtaatgttttttatttatatatcattttttcctcatcaaccttctcaaagaagatcaaggtacacttcattacatttttaaaaaattatctttccagcatccttcaaggaagttagatagtagatttaattaaactcattttacaaataaggggaattctataatgtacttaaagagagcaggttttatgaaaacaaaaatctcagaaatttcttccaatattgtgcataattactgtaagtttccttaattctacttccaaggtttgtatgtatgtatgtataaatctggtaattgtttaagaagtcttcatcctcatctttcactgtcatcaattaataagtaataaaaacaatactatgtgggttataaagcacaacagacatttaaagttttcagtaattaaacagagctacttaaaatgctgtaaacaaatgctaattagcaagcctccacgatagagtgaattgtagaactaacggtctgtcagccagggagatacatggccccacatatgatagaaagcccgggggatttgctttctatttctaaaattgcttatttgactcaatcactgaacctaaattagcgaaagcagtggtagagactgtaaataatttttttcattaaaactatcattggaaacttctgagcaacatttaaagattgtattagttctaacttgcttgttgttacttaattcctactacaaagctaaataatatataaaataaatagaaaaaatcagtgtctcaagttatcctttaatgtggggaataaaatgtctgaaagtcatttatgaactaattttagaatgctctactactggaaatatttattctttcaacactacatttgttgttttagatgcttgccaacatatatgttaaattctaaaagagaataaaaacatagtgcctccaccaaaatgaaataacataaaatataaagtaaaataataaaacaaaatagattacagctcttggaaaatattctaattgtggagtaaaatatttatacataagataacatgcagatgaagatgataaatacaagataaagcatgatgtaatacagatcaaataccataaaaggatgaagtattgtaaatttatttaagaaaggcttatgcgccagttgtggagtaaaatgttcacctataaaacaacacacaataggaagtgggaaactcaaggcattacgtaacacacatcaagtgctaccggaattttaaataaaaagtattataaggttgtttggaaatgtggattataataaggcctgttaggaaatgtggatttgaatttaactgttactctaaaatatgtggcaaacaaattgagtataatcatgaagaaaatctttataggctgcaattcttaagtaattttaattggaaccaaaacacagaattgaaatatagcttgcaatgtttgtgaaagttggtggtttcgagttaggctcaggactcacgattcctatgttagaatcctagctctccacttaggacatgtggaactttggacaagttactaaaggagcagctgctgttgtcttgtctgtaaaatgtaggtatcagaatagggcccacctcatagagttgtgaagattaaatgcatcaatatgtgtaaaatggttaaaaacatttcctgggacatacaaagtgatgtaaaaacctaaaagaaggcaaaagggctagatatccaattaagtcctactgtttaatgccttctaaaaatgaatttagaaaactggagaaacaggtcctagatctttagctttttgaaggtgttggtcgtgttacaagaatttatgttctctggctctaattttctcatttgtgaggaagccatgggactaggtgatcagtaagatcccaaaaaagaccaaatagtcatgatggtttctgctttttctgtcttgttgaaaaaaatctttgcctcttctttggccataaagacatgcttctgtgtttccttgtaagggacttttgtattggttttactattcacatttagactttactacctctggaattgaattttttggtatggtatttgatagtgaaaaagattcactcatttccatgtgaatatcaagtaatcccacaggatttgttgaagagactcttgttttttaactgccctgaaatgtctctctgaatatatattaagtgatcaagtatacatatatatatatatatatatgtatatatatatatatatatatatgtatatatatgtgtgtgtgtgtgtgtgtgtgtacatgcacagacatacacacacacacacatgcacattttaatttacatgtaattaaacgtatgctgcaaatatgatattgtaaataatactgataaatactgtaaatgacaccattttggacatatttcctaattgtttattcccggtctatttattgatgtatttatgaccttctaaaatcacgtattaattttaagcttactctagatttttaaaccagtgtatgtgtacaacaatgtctcttgcaaaaaattgagttttatttattatcttccaatacgtactcatttctttccttgcttattctagaataatattgaagagcaatcatgatggtaggtagctttgtctcattacgtgagaaacctgttaatattttgttattattgtttatcataggatttgtgtgtgtgtgtgtgtgtgtgtgtatgtgtaaactttctattaaattaaggaagttatcttctatttctagttggctaacaacttttaccaggaaatcatgatgaattttatcaagtatatttcatgcacgcattcaaatgaatttttattttcccttttattctgttagtgtgatgaactacaacaattgatctttgattgtgaaatcagtctcatacttctggaatcaacccatcatgataaaaaaaagtgttgtcttgtgtgtttttttttaacctctatgttcatgataaactattggcttataatattttttctggttatgtccatgccatttgtactgtcgaggagatgctggcctcatagaacaaactaggaagcattcctacttttcctgttatctggaagaatctgcatgtgattggtaacatttcataacatttggataatccatcaatgatgccaattgggtctggaatattttgtggaactatctttaatacagatctaattgccttcattgaaaagtactattgagatttttaaaatattttcttgtgtcagttatggaaaaatgagttttcaaaaaaaagtgtacatttgatacacattatcaaatatattagcataagattaagaactttaagctatgtctttttgtttttttaatcagaatagtgataatttttcccttacctctttcattttaagtcagattagtcatctattcaaacacccaaattatggctttgtgtattttctctatggcatgtttgtttttgcttcattactctggaataatatccttttttttttcttctacactttgtgggtttaatttgccactcttttcctaacttcatgaatgaagacatagatcattgatttttagcttctcatgttttctaaaacagcatataagtctgtaattctctctgagcacagtctcagcctcatcccacatgttctagtatgtcatattttcagaatcatttagttgataaatattttctagttcatgtctatatttcttctttgaccatgggttattgagaggtttgttactgacattataattttaaaaattgattttagcttaatttcactgtaaccagaaaataatatataataaaattaattaaaattcaatgagaacttttaaatagccctagatatggtcagttttagttagtgttctatatgcagttgacacacagtacatatattctattgttgttctgggtatccttctttatatgtcaaacaggcaaaaatcgctaactgaattactctgaccttccgcatcgttactgatttttgtcctcttttccatcagttattaatagatgtgaattacgattatggatctttctgtttatcttcttagttctttattttgttttatatatttgaagcaatatttagtaaatacaaacttggaattggtgtatcttcctaatgtagtcatcctttcatatagtatgatatatctatatctttagtaattatttctgtcttagagaaaagcttggtttaatcttaatattccttaactcacttcctcttgatttgtgtttgtatggtatatcatttttcatccgttttaatttcagtgatcctgtgtcttaatatttaaagtgttcttgcaaggaacatagaatcttccaaatacagtaggacaacctttgtttttttaattctaataacctattcacatttaattgcggttatatttgaatttgtgtctacaagtttgctgttttttaaatttgttccatgtactgcatgttcatttgtggccatttttagattaatgtttcttttattgttttgccgtttccactctgttagctcctaagttctgtatactttactgtatacatctcagcttataccattttactttttttatacatcatccgtttcctcctcagtacctggattgttttgaagtaaattccaaatctcagattacatcatttaatctgcaaatatttcagcatgcatgtgtgtatatgtataatatatgtttcagcatatatgtatatatgtaaatacatacattataatttcttaaataaccacaatattattatctgatacggtttggctgtgcccccacccaaatctcatcttgaattgtagttctcataatccccatgtattgtgagggggaccatttgggaagtaattgaatcatggggggcagttaccctcattatgttctcacaagaactgatggtttcataaggggcttttcccccttttgcttgccacatcttgctgccaccatgtgaggaaggctgtgtttgcttttccttctgccatgattgtaagtttcctgaggcttccccagccctgaggaactgtgaatgaattaaacatctttcctttattaattacccagtcttggatatttcttcatagcagcatgagaatggactaatacattatctcactgaatataattgctgtaatcccttagtgtaaatctagtaacaatcgtgttttcacagttccctctcataatcatttaattaatttgtttgaattgaaattcataaaagatacagagattgagattcattgacacgtcccttaagtctcttagtttaaaagctctcctaatatatcccacatccccttgtattttatgttgaaatacattttgactccattgaaagaacaaaatcatttgtcctatataattgtacaggtctacagtttgattattgcatccttctggtatcatttaacttgcttctctgtgtttcttgtacttcctggaaattattaattatatctagaggcttgattagattcaggtggaattttttaaagatttattcctggtgactgtgaacttccatcagaaggtacatgtctgattttctctccttttttggtgctaacagccagtgaatataaaattcactcctgtcttttttattgtttttttttgctggaattattctaaaaagagaaatatttttcattacatatttgattaccatgaattatgattgtatagaaaaataaagtaacttactatttcccctttatagtagtattcaaaatagtaaagtggtggtgtatcactttacaaaatctcacaaatcaccactaaagaacttatttatgtaaccaaataccatctgttccccaaaaatctatggaaataaaaaaaataaaaaaaaacaacttagtaaagtggtttcctagtattttctaaagactaaaaatgagttttaaaatattcttaataattttatgagctcagggattaaacatagtagatatatttcagtaccttgccattatctcaattaatggtcaaattattatgactttggctttgacaccatatttatgttggtttctgggtcgttttgacataactctaagagtctttgatagtttcctttatttctgatatgacaaaatgtttctgagtcataatttcctgccccatgttgggaatcaaccagttctctaaaatactctggtatcatttattggggaatactatttagatccaatattctgggtgctaagaaagctcattaacctcatcaatcttacagtgacatcgatcagcattgtcagaaatatcacttctcaatgacactattatgactgctcatttgctttatcccacaatacacctataagtctcagaaaaacagtaccaccagcaccaacatcattatgatatctgaaaagagtttaataattttttatttgagggctgcagaatattccagagaatattctgttaggtaagaacaacaaaattattatgttttaaagtcacttggagtggttctcctctgtgaggttatgtcaccaagtaaatacacagttttaatgtttgattattatacttgcttttctttaattttttacaaccatatatgatacttacacgattccaaaatcaaattaaaaatatatatattcaaagaaatttagctttttttccctctgctatcctctctctcttcccacttgtaaacttttatttttttaaaaatctaatctatttttctatctacatactctccattttagataaatcatgatgtgttaaacatacttttatccatgtcagattttttatttgtcttttcttgtaaaaatttcatatcttttggagatactctctttttatcattgcatagtattctattgtgtagatgctccatgtgccatagtttattaaaccagactactgaggtgatgactgaccttcaaatgtttccagtcttttcttatcattagttacactgcagaaaataacctgatgagtatgctctttcatattttacatagggtacactgagatagattccaagaaatgagtgtgggatcaaatagtaagaacatattacattttgccagatattttcaactatctatcatattattcaacttcacattttatcatgcaatgtttgacagcatctgttttccatatattccatatatccatatatttggaatatattttacaacacaaaatatatttgtaaaacttgaatttttccccatctgatggatgatgataagtagtatctcatatagttttaatttgtatttctcttattataagtgaaatcagttgtatttttcttatacattaagaaaataattaaattcattaaccttttcactgttgctccttgaatcatatttctgaaaaaaattcccacttctaacatctataaaaacttgcctttttttctcctcatgcagtttatgtctcttatccatgtggaatttacactgatatgcaatataagaaattgatcaattttttaccatatccatacagttatccagctacaccatcatcacttattttataatccatcttttcctctatagtttaaaatcctgcctgtgtggtatttaaaatttccgtaagcaaccagttctatttttggatttgcttttctgttccattggtctgtctgaactaaaacctgtcaatactaaatgattttcattggagaagagtagttttatcatctggctggacagtcctactccatgctgttctctttcaaaactgtcctctctgtacctactagatttttctttcaaataaaatttttattcaaaatttttagatacagaacaatattatattctaattgggcttgctttaaatttgtaaataaacataaagggttgacaactttgtgatattggaactctgcaactaagtacataatatgtatttccatttgtccagatctacttttgtgtcttttggaagtgttttatggtttacttcatgtatgatcctcatgtatatttattatgtttctgttttaatacattcttttaaatttgttagcataaatagagtattttctcacattatatctttttttctttatatcttacaactgattttgttttcatatatgaatgctactgagctttgggggagtaatattataatgacatactttacaagttgtctctttcttaagtggtcctgttgatattttctgcttctcaaactatatagtcatatctacaagtaaagatatcttacattttattatcaaattattatgtttttccttgtcaaactgtattaactgatagctccaaaaggactttggtattagtaacagtgatgaacattcttgtgttgctcctgattttgcagtaaattttctaacatttccacattaaaattctgactttgggactgagtttatgtgtgtgtactgtatgtgagaaggaggaagtggcagggcgggatgagacagtggagagagacagaaagagagaagagaaaaagatatatatttttttttgacaaggtctctgttgcccaggctggagtacagtggcgcaatctcggcttactgcagcctcaacttcccgggctcaagtgattctactacctcagcctctggtgtgactacaggcacatgccaccatgcccagcgaatttttgtatttttagtagaggtagggttttgctatgttgcccatgctggtctcaaactgctaggctcaactgatctgcctaacctcagcctctcaagatgttggaattacaggtgtgagccaccacgccgagccaagagagaaatcttaatgtaaatatgtacttatgtactgaattttgtcaaacgtctttttagcatcatggagatgaccatctgacttttctccacaactctaccaatgagatagatgactgtgaattaatgaatttcttaataataaatgccacttggctgtgatgtatttgttattatgttgctgaattctgttagataaattttacaatttttgtttataagtgagttgattagttgtttacttttttggagaaatcttatactctggcacaatatgaattcctaacatttcttattttactatgcttgggttatctgatctttaaagaatttgataggattcccctggataaccaagtgtatctagggattttaggggtgggtagggctcttgaatgactttatttcttcagtaataattgtgctttcttactctcctttcccagttattttggttaggatagatagtgctttgtctattttgttggagttttcaaataataagctattagatttacatcttagttctaattttaatttttttaattttaccttaagttctgggatacatgtgcagaacgtgcaggtttgttccaaaggtatacatgtgccatggtgggttgctgcacccattaacctgtcatctaggttttaagccctgcatgcattaggtatttatcctaatgctctccctcctcttgccctcccaacaggccccagtgtgtgatattcccctccctgtgttctcattgttcagctcccacttatttttaaacatttttttccatctttttaagtgggtgttactttttattcttaatttttattttcaaattaacataggtatttagcgttatttctggcacttgatatgctatatttttctaaaattctgtagttttagtaattcttttatccaaggactgttgttattttttttctttctttttacttatttttttaatttttttttgagacggagtctcgctctgtggccaggctggagtgcagtgatgcgatctcagctcactgcaacctctgcctcccgggttcaagtgatgattctcctacctcagcctcccgaggagctgggactacaagtacctgctaccacgcccgtctaatcgtttgtatttttagtagagacagggtttcatcatgttggccaggatggtctcgaactcctgaccttgtgatctgcccacctcagtctcccaaagtgctgggattacaggcatgagccactgtactcagccaagttttttccttttatctctaggaagaccttttcattgtcattaatttattgtattattgaagttttctttgtgggataatatgccacaatttggtaaacattcatatgataaaagttgatatcatttttgagagttgagttctctggtaaatgtttaccatgggtccttacccaggtttccagtggttttcattgtctgaagcttgacttttagtatattccccagaaaggctaatgggaataatattccctgagttgttgcttttatcctcaaagttgtagcctttatccttgaaggtcacttttacttgttagctgttctcggtcaatttctccaggttaaaaatgtgttcccttagtatatattttcaaattagattttttttcaggaatgtgttctcaacttataatttatggtagctaatttatatcgtttaacatttctttgctaacttctacgtttatcactttttctcaaatcctttttatctttttttaaagtttatttttgatctttaaaatttacttcctttccatctcgtatttttcttaagtatgattttctgtgtttgtttgttcacatgtctcttctagcataggctttctttatgaaattattttctgtaattttcaaatatttcgagttctgtcgcatgtttacagatacctttttctccactcatgtcattgtagggactttcttattctaattgctatacttatttaatagttactaccatttccttaaaagttttagcacatgttgaaattatgtgttataattttgtttttttgtggccatgtatttccagtgtgcttttgtcatctgtatggatgtatttccagttcttgtttactttcattttctcttaaaacctatttggagacttgaatgtgatctattcctgttgtacatcttaaaaggaaattcacttttcaatgttttcagaagggataaagtaaggcagaatagattttctagctttaaatcattagaattctcacttttgttgttttcaaaagtgattttaaaatatgtccttttagaacttgagttctctttactgctctttcttcctcaattttatttgagccattttttctctttttcttttttctttttggacctaatttgctttctgttcaacttggaatttattctatgcaatttcttttcactgtgatgtttcgctttgcttggaaggaaattactggttgttaattgagagtttaaaaagtcaaaacctctctagaatgaagaactttcctcaaaatacagaccctttttatgtactcgcaaattggatcatgagagccctctgcaagttttggatgctgtttccatatggatctactacatccaaagggagtagctgtttgaactgtcctgttctcagagaggcccagttatttttattcctctttctcccacacagatacagctatgctatgtagaccttgcagcgggtaataatttctctccatgtgcttactcatctttgagggttcatggcatatttttgtcaggagctcagctaagctggagaaagtagccaagtaaaacaacaagccgaaatgaagataacagtcaaccctttaatcacttactgtgatagtgtgagctagaaacaaaacagaggaaaacaatgccacccccttccaatccattttccccatggattggtgtgatggttgaggttcaggtggatcaaaacagacttgagggtcatctttttgatgacatagctctaaacaaaatgagtttgccattttatggatccaggaggtgggagaggacaaggggctagggctagaagtggaaaaatgctgagtactgagtctgaacagagaaaactccttcaaaatgttttgcctctcccctgataaggaggtctttgcaaaagctctgaggaaggcctctgggaaagagctaaaataagtaaactactgaatggaaacacctgatctaggaatgcagatatgcatgagagtatggcaggccggggagcctgagtccttaactgcaactcccttcagagactgcagtgccctggctgtgtatccagtctagggtagggagggcagctttcccccaggaggcctgtccagtaaagcctttgtaattgcctatgtttgagcctaaaaaattcacacacagatttttttgatcagaagctaaactcctcaaccttgtcaccaatatttgttgtatatattggatttggattttttttatttcaccattgtaattgtggtgtctgtttttatgaggaacatttgtggagtactgccaccaccacctatccagaacactctctacatacactttagcaacaggagaccatattgtcattgtttggtggagccaatactcattaacatttacccagatagctaccctttctgctactcattgttcttttccttcatttccatgtttctttccaaagaactttttagtatttctttaatattaattgagagcaaacatttctctcaattttgtgttaatctgggtctctctctctctctctatccttctccctctctctcccctccactttctccttttcctttagcttcactttcaacattatcttcacaagctataaaaactagattggcagttattttctttcagaattttaaagatatcaaagaagttgctacaattaacagtaaagatattttctaagaattgaacagccttgctaatgtagtagttaaaatttaatcaacacatgagcaaacttattttccttatgttcctctcatgatattgaaaatatttataagttctagactgcaaatagtaccatatttttctttaactactaataatgaaaagtgaagctgaaaaattacccacatagacttagttaaaataatgtttctttaataaaatattatatatttgatttattatatacctttttattttattttataagagcaaaagtaggcttatattataacagaaatatgtttgtcctttagaaacttatgacagtctatttcagagtatagccattatgaacgcggttcctataaatactattattctgacaattttctgcaatgttgaaagtaaattaaggctcattattaaaaaataaagttttccaaatttcttagtgaatttttacctttgattactatctataaaataatcataaaatcaccatggaaacagaaattgttgtttcaatattaagaaaacaactatttcattgcgacaaaatctaggtctataaccattacccaaggtataaatataaacttacattaaatagagaaattaagaaaataaagcataaacaagattttttaagggtagtgacatttacacacaaactaaggaggcacagaaaagaatatggcaggtttttttctatttttccactgaataactctagtttttaaaaatagaatttttattggtattacatttattacattgtaattttctgttttatgttgaaatttaaatttctactagataaaggctagagaagaatataaacggtacctggaatcagtcttttaaagtaattgtaataattatgtcaagtttctttaacaacataacttttcactgtttccattaacatgcatttcttttaaaaaatgatttattgaccaacataattgtttctggtttgaagatgggaattgtgtgacatgaattctaactcagaatcatttgaattcaaatctggctacagtcctggagtgcacaaattattccatatagatgtgctagatgaagatggtataaataagagaggaagttgaaatggagttaattagatcaggcttttcctctttaaaagacgacttttgagttgaaatattaagtaattagagacttgatagagttgataggtaagcacattctagttaagaggaatagcttgatttaaaaaaaatgaggaaagagagtcagaagtggataataatagaaagaagtatttaatagcagtgagggattatgttggaaaacagcaaaagataattctagaaagatagtgggaatacactgggggcagagagccacgtataatttattcttggctgtatttctatctcctaggctggtgcatggtgctgaataaatattcattgaaataaagctatgccatttttaccctagcttggaccaagatggtaactgtataaatgaaaaggaatcatttaatctttcatttatcctagactttgctctgaatgcctattgcaaagggaataaaacattgcctcagtactatagatactcccatttttccaaaggctacagaataacaggaaaaaaaatacacatgcatgtgcacacatacacatacagagagagagagttcagtacattttgataagttcaaaagtagagtgatgaataaagtggatcgagtaactctgtcagaaacttttaggagaggaagttttttttttttttgactatcagattcagaaaatgaaaaagaacagtgagaggaaagttttaaaatatctccaaagttgtgcagaactgggagaactgtggtttcagaaaagtgctgagaaaatacaaataagatggttgtatttccaatattttcaattaaatttaaagcattttctgttgttttacctattgtgtaaactatagtaggatgtgtgtgtatatatatatatatatatatttttttttttttttttttttttttttttgagaaagcagagacagcaaaggtagctctgtcaaactggtgccattgttggtgattaactggatgactctgtctccaatatgaactcactcatatacacacttattgcttagaagacaaggcaagcaaacctgcccaattttacagaggagaacaatttcacttataagctaaagttaacactcctgatactcctggttcatggtgctccaatatttgttccacttttcatgatttgaccctacttagtcttagactccttgctgttgatctaacctggtactctgattttggctctttgttttgactttggtttcctaattagaccccttttttttttcacattccaaaagttgacttcttgttgcaacttcatataatgaagtgcatgttcatgtcaattaaattcaccagcctcaaatttaaaatatttccatcaaatttttatagtaagtagcattcaaaatgaggaaattattatattaagatccttaaaataagacaaagtgataaataaagaagtgactagtcaataacatgattaaagatcctgaggtaggggttgaatgggcgcaaggagggaaaaaattcacacacatacatacataaatgaactagatgagggataaaaggaaatcttatgcaattatatggaaaaatacttaaatattgtaagtttacaaattttaaactactttgaatttatataaagtaaaaacaaatcttaatcttaaataatttgtttagggaaagactccacttctttcacttctttttctttttttgggagggggacagcatcttgctctgttgcccagtccctggagtgcagtggcacaatcatagctcactgtaacctctaatacctgggctcgaaggatcttcctgcctcagcctcccaagtaattgggactacaggcacacactgccatgcccagataatttttaaattcttggtagagactgggatctcacgatgttgcccaggcaggtctcttggcctcaggtgatcctcccatctcagcctcccaaagtgatgggattacaggtgtgagccactgtccccagccaagactcctcttcttattgacaagagttgagtaaaggtcaatggcatgtactggtgctgaggaaattgtttcttgcaggttccatctgccagcctcacaacatccctcaaacgagacatgttttggggactgagatctgtacctcaaattgtttcaaggtaaaaatagcacagttaagaattggaagtatttctaaaagaatatctattaaattattttgtaacctctaaagtaacattttcttattgtgcctggaaaaaaaaaaggagtgaaaatttattaaatatccaaagtaaaatcaagctacaggtggcagtggtcctttaagaaaattaatgtattttgcctatactgtctattttatttcttacgtgtatatctatgttaatatttaaatattattagccaagtgactttaagtagtagaagcagaaaatttaagtgttacacaaacatttgctgttaagatgaatcatctttccatacacataactattttcaaatactttagaatacaaaatgctttttaaaatgccttgaaaacaaagaattaatctgacataatcacatccctaatagagttttattttcttatatttctttaattctcttactgaattgaaacttaataggtttcttttagaaacttgattgtcatgatacaatagtagttttgtaataacaaaattcctaaaaaaattaagtaatcatggctgaaagacatttactcgtgtgtaggcaacaatgttctatcattagctcaagtcatctccatatttttcactttaagttaattagactatcacacatttaaacactggagatgtaacaatttacggtagttcattgtgttttgttttccaaccagaacatgttctcttaaacatgagagtgcatcttttgaagagaaaagatatcaaaataatggtgttaattgttgtctagtgtttctgttatatgaaaatataaatattacaaatctaggagccacatgtctatgtaaggagtattttcaaatgaataatccaaagaaccaaaaatattaaaacattccaagttatatttgaatcactgtatgttcatcaccaaatgtcaaagagatggagacacatagtcccagtaatacttacagcccctcagagcactccgtttctccagcacctggtaatttctgggattcttgctctcctagctcagaagaatccttttagccacaacacatcctatttccatatcacaaaccaaataccaatcattcgaattcccatttcagcaggtcctcacattcaacagtgcctcgtctcttaggacgaataatactatataaatgcaagtaaataaaataaaatgtctaaaatattctttggacccagtatagaaattttgataaattatttcttcaaaacaaaagagtatgacaaagtgtcagttttcatgtgagtcgcccatttttttattaaagaattttcaaggataattttgagtcataactctttttttacctttatatgctgactttagatcctagctataaaatatgttggcctggcacagtggctcacgcctgtaatcccagcactttgggaggctaaggcgggcagatcacgaggtcaggcgttcaagaccagcctgaccaacatggtgaaaccccacctctactaaaaatacaaaaattagccgggcgtggtggcacacgcctgtaatcccagctactcaggaggctgaggcaggagaatcgcttgaacccgggaggcagaggttgcagtgagccgagatcatgccactgcactccaacgtggcaacagagtgagactccatctcaatatatacatacacacacacacacacacatatatatgttggctcccacatgattacttgtttaacacttctctcctcatctagacagtaatttccatgacaatatgggaaacctctgctttatacaccagggtggctctgatgactggcaggtagtggcatgctacataaatgttcattcttgggctcttcattcatcctgtggaacctctttaggctgtttcatgccacagactcactggaagaaattgccgtcttctctttcactaactggtacaacttcattcaaggaaacatttcctgaatcagtgaacatttggataaataaaagtaatgtgaatgttctgttttgacattttaatttaataatacgttctaaagtttcctttaggtttttggaattatatttagcttctaaaattttgccacttaacatatgctagaaacagccccattctcaccacagagataatctcccaagtatatgataatcattgtagcttatataacattttctaaatttagatatcccatcagtatataatgatcaagctatttgctaacaatttagaatggaataaaaataataatatggaaatttgcactataaagagcaggtgaagggtagtgtacataattttcactgttttagataatttgcttttgcaatagagtcataaacattagaaagaacaccagaacttaaaataacctgctcacttgggcttgcctctacagcatgtctgtatggtctgcactctctccccagattaattgctttcatatcatgtacatttgcaggaacagtgtgacaaatgataaaacaaaataaggtcacttaatgtgattaaggacaagagtgatttgtgcaaaatattattgaaaattactatttaagttgcattttgcgtgtacttttcagaattttaaaaagagtgatatgatgtgtggagatgatggatgagggtgagatggaaagcatattaatgtatgaagccactgaaacttctgaaaagatactcaagagttttacattaagcatctcaatacctaaaataaagctgtgagataagcattattaatttattttcagatcagaaatctaaggcacagagggtttgctcaaaaccaaacagctagtaagtgtcagagttggagtcttattaaggctatttgactccaaagactaagctcctatcgaccatgaagaacttgtaaaagacaaaaaaaaataaaataaaacaaaaacacatctttattatttattcacatccctaacacattactctggtaatttttataacattggtctccatttttgacatccttgtaatgactttttgtagacagagttatttctctttcctgatgtcagtattggccatgaaacttgctttggctaatagaacacaagtgaacatgatatacaccacctctgagtggtgctttaaatgtgctcacgtggtttgattttaccactctgtttctactcttttttttgacaacagcatgttttgggaagagctgctctttcagcctgagtctctaagacacctagcacagatctgaacaccgaccacaccgaccaaagcctgaaacagagactcagcagaactgtcacagggcatattatttgaatgggaaataaatattaaagccactgatattttggggttacttgacgcatagcataatttagagaaagctaaataatatgcttttcaagcatttaggagatacagccgcagatctgaaaagctaattggtaacatttttacaataggaaacctaacttgtcacagttttcttctactgcatgtgaaaagcagaaagttgttgtagagatatattttcaccccgtgtagccagaatagttttgttgccctggtgccaggaaaagacttctttgtaaatatatatccccactatggtacgagatcatagaaattaattcatcttgcttaagcattgtttcctcgaaggagagagtttttataaataatcctgggagaagttactcagtatgtaagcaatgccttactgtgcatatgtttgtcaaagtaattttccccgtgactggacaggcctgggatggacccacagcaatcagcagttactgggtggaaaggaaataagagtctcaaagcagagggaaacagtgacacaggctgaggaattaaatgactattgtgacttcttttatatcattgattactttatatcgcaatctgaaatcagcaaaaatatttctagagcttatgcattctctatgaacatttaaacatttattacaatatgttaattaaaatgatgcatgcataatctgactcatactttaatttaaacatagccaccttttaattgtgtctatcacacaaagtgtgtatttacaatagagttggcactatttactatatttactatttattctagagtatttagaagatctatttactatagaaaattgttgctatgatttcctggcctaatgagaaaaaaaaaacaaatgctgattaataggccagtgaaaaatttgagtgaaaagacttcaagtcacactgcccaaaagaagattttgcaataattttaccagaaaagccatacaatgcagtcattaggagcattactttgggaagtaagacaatgtagaagtctacagaacctgaagcatacaagtaagtatgttcatcttgtaagctgttacttagtttcgtgatccatcccattaatgtaatgttgctgatttgaatttatggatattatggctttatttctgtttaatttataaatgagttttatagttgcttaaattataagtgtaaagaagctatacttagtttcacatttatatgtattttagtagtgcaataaatataatttaagtcaacactggggttagcaagaattgtacttttccttaataaggcttattcctttacaagaattgtgcttttcctttatattcattggtgaaaacactattttgaaagcataaacttgcctggtattagttgtacaaatttaaaaataaactggatctgacaagtttccaaattaggtattcatttactatatttggcatgtttcttgtgttttgtagtatctgtaaatcatctgcaaaactgacagttaaaagatgagaagttactgtttgtgaatcagcctagttgtttcacttgaagacttttttagttataagagattagggcatttctttgtatttccatttaagaacaatttttaaaaaaattgttgtggaatgatagtttctatttctgttagctgaactcacttctgtgctatttctgttagtttaaatcacttctgtggatttaatttatttcccagttttgcaattatgagggtttttttctgggtttatgttgacctatatatactaaaatttgaatttaaaatttctggtcgctggagaggaaaagttctcctacagagataattaggcaatatggatgtagtttttcaacatgtgctgtaaatttcagtgaggattgtcctctgtaattgcttttagcactttctgattttgtccttggcaccatggtttgagttcagggcacctgaaacacatcattctctttcttctaaagaaggtcactagcctttgtcctctgcactgtaccgagtctgtgaaggaacacaatagtaatcaacaatactacaaataatatagtaaaatctcattaagccttcatcacattttcatgtcattaccatcatgttttttctgaaaaataattccatattctttaacagagacccaaaatagcactttctgtttgtgtggttcttcctctaacattttttttaaattactgagtgatattttttttaaattactgagtgatattttttatttatttgggagaaaaagatgataaaataatgtttttctgttcatattaatttaattattgaagtgtttttaatagtgggtttataagtatttaatgtaagaattattttgaaatcataaaaagatacagtaagtgtgaaaacattaaaataattatacttagggaagtcagagtgcaattgtcttagaagcaattaagaactatatttattctcttattcaaccacaagtatctcttaggataatctcaaaaagcagaaaacagatcctttgtcctttgtttatatattttttaattttgaagtcattaacatagctttttatgtaacccattcagtgtctggaaaatacttatttctcatgaaattaaattcacatttcatggtgattcatttttcatgtagatgattgtgaatttagtttggtaggttggactattttgattcataattagaaatcaggaatggcgtaatagaatggaaaactagtaatatgattactaattaaagagtaagcaaagatctggcttgtgaaaataaaattatgttaatgaaagtgataacttatttcaggatttaaggggctcaggtgggaaaaaattagacatctcaggatatgaccaagctgtggttgagcatttcatatagataaaatcaggtcagagtagcagctaacacaggtcagcaataaaagagtaagaaacaggggggaaaggaggctgctaggagacactgggctgggttatgagctccaagagtactgtagaggcatagtacaagagagctctgaactcctacaatcaagtgtaggcaatatattaggtttttttttttttttaattgcctcaaatggatgctaactctgcctaacctaaacaaaaatgaacgtattggaagactatgtgagagtttataatttccatgagaagactggagaatcagacctgggaaatgataaatctaaagtaactacaaggtctgaaaagtctaactgcgagctagactttcattcttatgccattatttagattataaggagagagtgtccaaatatctgtgccaggttaccaatctatctcttggctagggaagggtaatataccttaaataaaatgttcactaggctataaacaataggaaaagagacaatttctcaaaaaaggggaaattatcaaaagaaggtgaagtagaagttaaacaactaaatatactgataataataatgtcagcaacaaaaggtagaaactatccagagccatgggtatttctatagataccaaaagcttgtgaagggacaatacaataacaatagagacaatgtagcctgggatataattatgtttttattccattcattgctatttcagtgtcttaattgtgattactatttctagcaatgctcccccaccaccaaaatttagttgttctctttgccagagaattctcttcttctgagagactcacctcttattttgcatccaaaaatattttggtttaggataatacagattagggtaaattattgtatcagtggcaaatgatactggagaccaaatttcaagtgaagaagagaggataaggtagacacggatgcttgggttgaccaccgcagagaggcagcccatcaccctgcttatctgtttggggaaaacattataagaggaggtttcaagtcagagaacttgtcaattaaatgcccttggctaactctcttcatagagagttacctattctctatttctggttctctgtaattatcaaatggatgttttctcctcactgctagattttgtgattgtgcagcaaaggaatcatcttttgtgttgaatttagggaaccactgaaatcctagaagtttgaatgtatttttcagaagctccttcctgtcttcactcattaagttttattgaatacaatatgccaggcattatgccaattaacaataattaataccaatctctgaaaatctaatttttcttaacctagggacctgacaatagtgttatttaggattgcatatgctgcctactacattttcttctataaatggcaattttatgagtgaaataagtcagacacagaaagaaaaatactgcatgatttcacatataaatggaatcttaaaaaagtataatatataggaacagagagtagcaatggtagttaccaggagtgagactggattgtagaggggaagagcaagatttagctaaaggccacaaagttactattatgtaggatgagtatgtttaaaaatgaggtccggtagtcccccctatctgtggccaatatattctaagattcctagtgaatgcctgaaatcacagacagtcctgagccgtatgcatactatgttttttcctatacatacataacaataataatcttcaatttataaattaggcacagtaagagattaacaacaattataataaaatagaacaattataacaatatgccagcatcactactcttgcactttggggccattattcagcaaaataagggttacttgaatacagccactgcaatagtgagacagtcaatcttatcagatctgagatggccactaagagactaacgggcatgtagtgaagacagcatggatacactagacatagggacgatttgggttctggaatggagtgggaccctgtgagatctcatcaggctactaagaatgacacacaattaaaaacttacgaattatttatttctggaattttccaattaaaatttttgaacaacagttgacctccaggtactttgaagtattactaaagccgatatatctaagaactcttttcaacctggccttttagatttccaccaaacagttgttctttgatttcagtatataagacttttttcctactgtcatttcacagctgagcaagccatgtgaacctttgaaagctatagtacaatttaacttccaaatgcttatgttagggattaaaaatgcaaactcagtagtctcttggattcaaatcctgaccaaaatacttgctgtaaaatcccttatgtgaatcccattgtgtgccagctatcatgtaacctcatccctgactgatatttattttaattgcatgtgatcttactcattatagttcatttgcataaagagagtgaactgtagccggccagcaagtttaaaacctgcagtatttttttattccctgtgataaactttggtcataccactgatgtcctctacgtttaatggtatcaaaaactcataagcaaatattaactcgttaacatcttcacatattgttttgaccaacacatattctcctaaatttgccaatttaatgtttctaccaatatattaataaaatttgttttttccttatagttataattaggagttccatcaagtaggtgaaagatggtcatataaaatgtatgggaaaagattcctaaaaaatggaacagatgggcatccagctttagcagtgaccactattcactaatatagctacttgccacttttgcctttaaaaatcactactaactaacaaccttcttgctatacaaaatgtggtctgcagaccagaaacatctgtctcacttgacagacactggggcccaactagaggcctactgaatcagattctgcattttaataaggtctctaggcaatgactgtgctaattaaagttagggaggcattacgctaatctaccaaggtgatcagagactgggaataccatgcagagagaccttgggcacgagactcaatcaccatatgtgcattatagaagcctgtggctttatggcatgcagtcctctggatgagggtctgaacacctagacaaagctttccttgcagagaaatgtagattctggaaaggaatggcagtcactcttacatgggcagtcctaggagtacctgatgacccctttgtaacagatgaactgcacaggagacctggatctcttctggctccgagaatatgacagtagtggctttggcagcaaagaaactcaggagtagagcaatttcctaagtccttcagtgaaggactggtggctttccaactggtgtatcacagaaccacagggacagatacagataatttctacataagattccatagcatcttgggttgattctcatgaaacataagctcatgaggaaacacaaaaacaaacaaacaagaaaacaatgccattaagagcattgagaaattatacaaaggaaaaagaagaaaactaaacagcacaagcatcttctaggaaagaagaactggaggaggcagactattacattggcactcacactcaatttcctgagaacctttatatgagttaagtacagtctcttcttagagtcttatcttagaagaaccagtagtttggggcagatttagagcctttagtgtaagcaaagctgactgattaaattggtaagtttttttttttttaaattaccagcggtcgatatagcacagcgaacctagatcttttctttgttgtttttatgtgcaggaaattgctccactagaaataaaccttcttttccttacactgtggttaaagataatgttttaaaaagatgtctccctgttattcacttttacgttttatgatattatgattctgtttcttattttggttacatgattctatatgtatttggggtttatgctttattatagattttgaaaaatgtaatgcttatttgctttgtttttaatttttacatttaaggaacattattttaacaatataaaaatatttcaatgtgatttcaggagtttctagaatgttgcatttatgtaaaatttttacaggtatgtaaaaatgtatttgagaatttccctgggggaattgaagacatatatacacaaaagaatacaaaaagaaacaatttcttcatataaactactttctaatgactaagtattatcttataatggttttacctctcttagatttaattcttatagtcatgtttcttctgtcaattctaacttcaatatcattatacttaattttaaaagtggtacaaaatataagttagctctgcctttctttatcatctcttgacataagtttcctcctgtaggtgctcttatgtacactatgaaatagaagtcttagaaagcaaaaagttattatgtatccttagcccaatctcatactctgtagaaacacccatattaatatatgtcacacataataatctggcttctcttgaacactttcaagaatgattattattattgggaaatatttcctggactaagcttcaccctgcattttcataatgttaacttcttcccaagcttataacctgcatctttagagaagcttaaggctcaatccatatgatagccattcagaatttttaaattgtcaacattttattgctaaagtcttttatgttttgctgtctgccacaatcccttcaatgtgtttcccattcgtagtttctagatcttttattatcttcctgctaatcgttgcatggcttctccctgaattgtcggttacttttgtaaagagtagtgattttacagacataaaggcttctaaaattattgtctgaacaccagaaataaaagctttcctaggtcctgaatgtcccaaactacatttcatcgtatttatattagtgtgacccaagtttaattaccttacttagcaataattttattttgtattgtaatgattgttcaatcaacaaatatatgaaaatattcatataaagattcatataaaataagttcataaaaagctcatataaaatactatttaggcaagtatctgctcatgccgcattcatgcaatttacttatctgaatgtaaatcaaggctttatatttatcaaagctgatattcattttgttaatgtgctttcataattttcctttacaaaaattattttaaatgtcttattctgttttctaatatattagcagcttccctgagatttgttttatccaccttctggtgaccaatgaatggaacagtattaaattatatcccaaagaatctctcttctggactatataaattacatatgtagttaatgacaaaatagattaattagctaatactatttgagtgcagaagctcaaccacttataaatttaccaaactatgtgttttcatagccattttctcttatgttgcccatttggctggcacaagatatttttattaaatatcttggcaaatcaagataatcaatttctgtaacatttaacttatgtagcatctagcatctcaacaggaaatatttatctaagtatcactgggtcttatgaaattaaagctagtttctgaagagaattcctataattaaataagattatgctgtatatgaaaaaggttttataaattttgacagtattatgcattgtaagggattactgagggttgaaaaaacgatctgcttaataatagtctatcctagaatttttttgaaaaattaaacaataggattattagttcaatggatcttcaacaactctcaggaaaagaactagtaataataaatgtcaataaatagttatggaattaatgtctgaatgcctgttgattgtgatgaagtgccaactaaagaaggatttaaggttacattaatttaggtgcaaattttaactttgctatttacttatactgtgaatcctgaataatttacgtaacttttctgagcatcctcaacttcctcatttgtaaaatgtgttaataccacctaccttgggggattaagtaaaataatgtatatgaaataaataaaatagtgcaaaattgtttatttccttctttcaccccatctcttcctccaactaaagatgaaatgaattaattgctttgtgccttagtacattggacacaaaaccaattcatttgaattaggtcaggcaaaagttcagtcatttggctactagtatcctttgataatggaagtattatggtgtgtattttttcacaggggccattagactgtaggtcatttggatgtcattaggagaaagaatgatgatcttgaattgcatagaacatttcgtgctttctcatgctgtgctctttactctttccctttttaagagaaaatctacaaaaaaattttaaactacattataataatattattctatactggaacaaaaaaatgacaaatatacaaacaaattcaaactatggaaaaagttggtggggcaggggtggagactatgaaaaataaacaatcaaaacagcagatatgttcctaaattaaaagaaaattaaatattagaatgactaaagacttcagcaagctacaacaaagccaaggattttttcttctctgtgcatactagagccacttattttctctttaattcacattatactttattatatagtagtagacacttttgctttctttgaacattttattcatttactacaaatgtatattgactctggatgtctgttcagaaatcatgcaactaaacaagaactcataaccgtgattttttttagatggttgaagacctttatggtgcaattatccaagttaatgaaggaatagaatcagacactaaccttgagagtacataatccaaaatttactggataatatactatttttaagaaactgaaataagagccaaacaatggacctctagtttttctaaaaccagtaattacttgtgggtaagttatctaaattattgaaacttggccccaattttcccagctttttaaattacagaattatgctgtctatgattatattagatttttcaaagtgactgtgttaatacatttgaatataattctctcatttacagtttcttttaaaatttttctaccagcttatcccatctccttgaacaatttcctcccattcctcatttgtattgaatatggaaagaatcacttcttaaagtaattaaagttatcagcctaagaattgaccttttttgaatagggttgtttattttgttgttgagttatatgagttatctataaattctgatcattaatcacttatcagatataatatgtgcaaatgatttctcccattctgtgggttttctagaattcagttcatattaacttttaaaattttgttttaattttagacagcatgtctaaatgcatgttcattacatgggtatattgcataatgatggggatttggcttccagtgtacccaaaacacaaatagtgttgtacccagtaggtaatttttcaaactcaccctctaccaccctccctttttggagtccccagtgcctattatttttatctgtatgtccatgtgtggccattgtttagctcccatttataagtgaaaacatgcagtatttgattttttgttctgagatattttacttaggtctccatcaccatctatattgccacaaaggaaacaatttcattttttatggctacatagtattccttggtgtgtatatataccacatgttctttatctaatcaaccattgatgagcacttaggttggttccatgactttgctattgtgaatagtgctgtgataaatatacgagtgaacgttgtttttttttttttataatgatttattttcccttaagtaggtaccaagtagtgggattgctggattggatggtaattctatttttagttctttgaggtgtcttcatactgttttccatagaggtttaactaactgagattcccaccaacaggtcataagcattcccttttctccacatccatgccaacatctgttatttgttgactttttaatggtagccattttgactgtggcaagatgatacttcagtatggttttaatttgtctctctctggttaaatgatgttgagcattcttttcatgtgtttgttggctgcttgtgtgttttcttttgagaaatgtctgttcatgtccttttcccagtttttttttaaattttattattattatactttaggttatagggtacatgtgcacaatgtgcaggtttgttacatatgtatacatgcgccatgttggggtgctgcacccattaactcgtcatttacattaggtatatctccctaatgctatccctcccccctccccccaccccacaacagtccccagagtgtgatgttccccttcctgtgtccatgtgttctcattgttcaattcccacctatgagtgagaacatgcggtgtttggttttttgtccttgcgatactttgctgagaatgatggtttccagtttcatccgtgtccctacaaaggacatgaactcatcattatttatggctgcatagtattccatggtgtgtatgtgccacattttcttaatccagtctatcattgttggacatttgggttggttccaagtctttgctattgtgaataatgccgcaataaacatacatgtgcatgtgtctttatagcagcatgatttataatcctttgggtatatacccagtaatgagagtggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccacttgttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcagttttgtcttttgttgccattgcttttggtgttttagacatgaagtccttgcccatgcctatgtcctgaatggtaatgcctaggttttcttctagggtttttatggttttaggtctaacatgtaagtctttaatctatcttgaattaatttttgtataaggtgtaaggaagggatccagtttcagctttctacatatggctagccagttttcccagcaccatttattaaatagggaatcctttccccatttcttgtttttctcaggtttgtcaaagatcaggtggttgtagatatgcgacattatttctgaggaccctgttctgtcccattgatctatattttcccagtttttaatggggttctttatttttttcttgttgatgtgttgagttttttgtagattctagatattattagtcctttgttggaggcataatttgcaaatattttctctcattctgtaggttgtgtgcttactctggtgattatccctttttctgtgcagacactttccagtttaattaactgtcatttgtctatttttgcttttgttgcatttacttttagggtcttcattataaattctttgcctaggtcaatgtccagaagagtgttttctagattttctttgaagatttttatagttttaggtcatacatttaagtctttaatcaatcttaagttgatttttatatatgatgagggacaggagtccagtttcatttatttgcatatggctagccaacttccccaacactatttatcaagtaagttgtcattttgccattctttatttttgaccctattgtcaaaaatcaatcagttgtaggtatgtgacttaatttctgggttctatttccttttccattgatctacatgtacatttttgtgctagtaccatgcttttatacctactgtagccttgtagtatgaattgaattcaagtaatgtgatgcctccatatttcttctttttgatgaggattgctttggttattctggctcttttttgcttccatgggaattttaggattggttttctaattctgtgaaaaatgacattagtaattggataggaactgtgctgaatctgtaggtggccttgggcagtataatcattttaacaatattgatactttcaatccatgagcatgggatttttttatttgtttgtgtcatctatgatttctttcatcagtatttttagttctccttgtatgaatctttcacctagttggttaaatgtattctaaattgttttttttttctaactattgtaaatgggattgagttcttgattttgctctcagcttgaacattattgatgtgtagaaacgttactgagttgtgtacattgatttcagtatcctgaaattttactgatatcatttattgatttttggagtctttcagaggaatcttagggttgtctaggtatacaatgatgtcatcaggaccagagataatttgacttcctcttttccaatttggatgccttttatttccttctcttgcctgatctctctggctagaacttccaatactatgttgaataggagtgaggagtgtgccagttcttgtgccagtcttgtgccagttcttaggggaatgctttcaacttttctccattcaacatgatgctggctgtgtatttgccatggatggctcttattattttgaagtattttcctttgatgcctggttttttgtgggttttgtatcatgaagcgatgttagattttattggatgcttcttctgcatctattgagatgattatatatatatttaattctgtttatgccatgaatcaaatttattgatttgcatatgttgaactatccttgcatgcatggaataaaacccacttgaccatgataaattatcttttcatgtgcttttggattctgtttactagtattttgttgaggagttttgcatctaggttcatcagggatattggcctgtagttctgtttgctagtattttgttgaggagttttgcttctaggttcatcagggatattgcatgtagttctcttttttgtctgattttggtatcagggtgatattgatttcttagaataagctagggaggaatccttcccccttgatattttgaaataactcttccttgtatgtttggtaacattttagctatgaatccatctggtcctgggattccttttgttggaagattttttttattatcgattcaattttattactcattattggtctattaagggtatctatttcttcttgattcaatcttggctggttgtaagtttttagaaatttatccatttcctttaggttttctagtttttgcaaataggggtgttcatagtagtctctgatgatcttttgtatttctgtgatatgagttgttaatgtcacctttataatttctaattgtacttgtttgaatctccttttttcttgcttaagctaggtagtggtctatcaattttgtttatcctttcaaagaaccaactttttctttcattggtcatttgtataatttttttggtctcagtctcatttagttctcctcttatctttgctatttattttcttatgcttgctttgtgtttaatttgttcctgtttttccagtttcttaaggtgtgatattaggttgttaatttgagatctttctcttttttatgtaggcagttagtgaaaccaacttttctcttagtagcccttttgttttattccagaggtttttgtttatagtttgtctattttcatttgttttgaaaaattgttctgatatctgccttaatttctttatttacccaaaagccattcaggaggaaattgtttagttttcatgcatttttgtagttttgagagctcctcttggaattgatttataattttattcaactgtagtctgagaagacatttgatatgaatttgatgtttttgagacttgttttatggccaagcatatggtaaattctggagaatgttctatgcatatatgtatattctgcctttgttgggcagaatattctgtaaatgtccattgggtccacttggtttgtagtccagtttaagtccaaagttgagtctgtttgtgtctttagcaattaggtgggtctcttgtatgcagcagatgtttgggtcttgttttttttgtttttgttgtttgttttttgtttttgttttttatccttttccactctatcttctaaatactgcatttaggccttttatgttcaaggttaatattgatatgtgagaatttttcctgtcatagtgttgttagctagttgccttgaagtttcatttgtgtaattactttttgggatctgtgatatttgtgcttacctgtccttttatgatggtgagtattatccatccatttccacttttagaactcctttgagtatttcttgtagggttgatctcatagtgataaattcccttagtgtttgcttgtctgggaaagacttaacttatacagtggtattggcaaaattaggcaaatcatctttcctatcattttaactcatttcaattctcaccactctcctcttctatttacaataacaaatagaatcctctgttctgatttattcatgtatagattttgaagagaattctgattttgatgcacgttagaatacgtgaaagagcaaaagaagcaagtgaaaaattttgcagtgacatacaagaaaatgattcagtcttaagatatctgcattttgaataataatgtacttattatggttacatttaaatttactatcttaactgccttcatttgtccactcactgttctatttccttttttttcccaatcttctcaataattatttcctagaatataattttatctctactattggatttttttgcttaatttttttatggtcgggttacagtttaaaatttgcaactttatataatcccagtgtatcttcaaatccttttatttcacttcatatataatgtaagaatcttacaacagtgtacttccataaccttttattgttttttcctattttcacattatactttatgtatattattaacacaatatatatttttttactttatcccttgtcttttaaataaatttaaaaaattttttattcatatatttataatttctgttattttgtattcctttatgtaaatggaaatttccttctagggttcttttctttccatctgaaaaacaccttgcagatctagcagcaaattctctcagctattttgtcctcattttaagaacagttctgccagatagaactttagtattatagtttttattcctatcaggtcctccaaaatggaatttaattgatttctgacttaatttttgatgagaaaactgtggtaatctttgctcctatgtacaaaatatgtattttctcctctgactactttcaaaattttctttttttcactggtattcaacaatttcattagaaaatactttggtatcgttgtctttagatttatccagtaaggttttttacagatcttgaatcagtaagtttatttgtttcatagaatatggaatttttttaagcacttatttttctctctttttgaactccaatccacgtatgtttaacatcttgatatttttaagctgtttactgaagttcctgtcagttctcaccatttatctttctctcttcttcactttggatatttgctattgctgtattttctctgatctcttttgaatagtgttaaatcagctattaatcccatccacagaattcttcacttctgataattgtctttttcacccacacaagttcaattttttcttttatatacttttcatttctctcttcgttatttttatgcttttcttttaattttaggcttgcttatattatctccacctgctctttcatttctttctaagatctttttctactaacctttctatttattacaaattttagattcttccacatgtctgttaagctttaattggataccggaccttataaatttatgttgatgtcattgttgagtttagtagtctttaaagagtttaggctttaatctgacaagcaactaaagttacttgtggattagcttgtttctttttgaggcatattttaaaagttttccaaaatggcctacttttaccctactattaaaatatgactcttctaatgtctttccttaattccttggttgttcaaaaaagtcttatcagaaccgatatatttccagtcctttgtgaattctgagaattggtgaactcacctttatagctcccacagttgttctttggctggccttctgaagtttttccatatatattcatggcttaatattcagttacactctcagggagactcctatgcagatttttggatctctttttccacagtgctcccttttctccagcactttgcccaagatattccatgtgcctcaattttcccaaacacttttctctgtctcctcgacccagaaagcctattatcactaattatccctctctctacctttcacacctttttttcactatgatctgaaaaaatcctggcagaaagcttggatgatatcataggacatacctcacatgtttcttgtctctgttttctcagtcttgtgctgcctacttttcaatttcagaacacgtttgtttcctatatatgtagacaatgtatgtagttatttactgcagtaggctcgaggtgattttagtaactctgtcatggctgaaagtagaattaagtaatgttttatttggcatatttctaaccattattaaagttaaatatttggttatatctccattcttatgacatcagactaaaacttatgaagaatcatatatttttgtctataatttttaaaaatagttgtttacgtgacatataaggtaaaagtttctggaatccacaaaattctggctgttttcactcagtgtcagaataatctaagattttactttcatttcttcccccttgatgatgcagataacttcaacctcagatttttgaattataaaagcaaaaaagattatggtttataattacagcattacatttttattctgcaatagaaattaaaaatatgtcttttctatttatttcagtgctactgaatctcccattaaaacccccacatgtgcctgtcacttgtttataagccagacctaaacatgtgtgccaattatttgtttataaacataaacataaaacataaacataaacataaaatcttgtatttgagatatatgtgttttatatgaaatagtgaagattattcaaaaaattttaaacataacttaagataatttgaaagacttactttcttctatagaattataaaagcagtataaatcttttgctttagtttgaggataaaatttttaatgaaataatttactttacatttttatgcgttactgctggtcaataattgtctagtgcagcatggaaagtgttcttcctcacaagattgaggttgacagtttagtcaataaaagatcattcttttggggcttatcttgctgacacagcaaaggctcattcttaatgcacaggggcataaatgggaactctgtgccttgatagattcagacatggacatcctctgcttttttattaagcatgtcgaactaatgggaggggattttatctcattggcatatccaagagtctctacttgaaaattaaggtaagtgattttggcaacctaaatctgatgactgctgtggagacagaaagtgattgaaggcagttctagctttgattaccctatagttttagaaaagagaatattgactgggcatagtggcgtgcacctgtaatatcaggtaattaggaagctgtggtgggaggatcacttgagcccaggagttagagaccaggcctgggcaacatagcaagattttgtctcaaaaaaaaaaaaaaaaggaatgacaatattggatatgaaacaagttattattctatcatatccttcctaattataaagtaaaaagaatattttacaatggcatagccaatggtcaatattaaaaaggagagtgtcacatatttgaccacaaaataaagaataatcagtgattttttttcttcaagcgtttacttgcttgtttaaaatcaaaacattaaaactgtattttggactgtgaaagtaaacaatattcatttcatatactgtgaaatttttatgttagtttctttatcctatgaatataaacaaaaaaagcactgaacataagcattactgtaaagaaattgtaagtaaaatgtgttttgattactacaaaaaattgagttttacagttaaatatttatatttaatttcaggctgcatgagaacacatggctggaatttagaaaaaacaattgtgccaactttgattttgtagacaaatcactagctgaattgggatggcagatgcatttgttttatgtggccaaaattgaatgccttaaggtaatacatttgctcttcaggttgacacaggtgccaccactccctctagcacacagtctccagaagtagacagtttaaatttgaatgccacacttcttgcttacatggcctacacctcactatacttatccataaggtaatgaaaatcacagtgcctaactcatagcattttttaaagattaagtaaatatccagatctagatctagacctatctgtctattgctggagacaaaatctgacatatagtaagttctcaataattgtaatagttgtagtaagagtaagagtaatatctggtctctccacaaatacgtcttacctccctggcttctgaagacatttgaatttgtgactgcaactctaaaccttaattagtcctttgcactggtccacagcaaaatgactgttggttattgacagaactcctgaccaaccttcatgttagtttacagtgcctatctctctcattgtaattccaccaccttgactgtcttcttgttcactgaacttttgactgtacatagaaggtgacaggtgttttcccagaagtgataccaaccacttcacacagcttttatctgacagtttttaggtctttctgaggagaatttatgacagaaacgccatcagacaagcaggccaacagttgcgtttggcgtaattacgcacttccttgagggaaggaaacagtcaatctcacagtttttagtcaggctgacactatccacatattttgcaaggtacattcacaaagttcaagtagttgattgactgaagctgagcaggaaaggctaaatgtcaggcttttaaggtgaaactagtggcagctctgtagcagcgtggcaggtagagtgaagtctggaattaagagtgacagacgaatggtgggtggtaaagaaaagactgtgtttgctggcagagaaggaagttgggctgtgctcagagcattcatggggtttgattagtgatagaaaggctaaaatatatacagatttaagtgttcaaaattatcttaacattccaaagaaaaactgtcagaattttactaaaataataacttttaatccctttacttttaaaatgttaatatgaattccccttttttttaaacagttttcaagatgttgagatttttgtctaaagattattgtacttattgcattttgtcactctagtctctgctttaagagctagggaaatgtgagaaaatataaattatatcttaaaggggcagagattagagtaaatacatttaaagataatgagaaaattaagaaaatttgtgaaaagttttgattcatcatatttttgtgtgaaaatgaaaaagatatcctaagccaatcaagattttgaatagtctaacaaaacatagtaaatagagcacccttaacttaataaaataaagtatctaatgtgacactggcatgggaaacttagggtattgcttttacagctggaaacctctgtggctggtggtgcctttgcctgagtttttgcttcggcccactgggcttgttccacccactcagcctggcaagtgcactcatctcatgccaccagtccagatcccatgcctgccaagggtgagccaggcacagagtggcaaggggtgcataagtgagtgagcaaaaggtctggccactgcacacagccatgcacactggctgctgcagtgggatgggcagctctgggtgctagcacaggcactgagtgcaagcctgcagctggattagatgcaccataagcggcttctgctgtgggtgtctacatctggacaaggggaatgcagtggtgcccagaagcttagagctgcaaccacagagctccaaagagggtgtcacagccctggctcagggatcacctaggtctgggctcccaaagggctgcagctcttctttccttctagttgcctgcaatgtggcaagtcaggggtgatgtttcagccctgtttgtgttacagctttttcagttgtcccacttccaggaagaatgaagtacatggacaactggtaggtgagaaaggtggagaggagctttattgcatgacagaacagctctcaggagacctgaagtgggtagctcattttcactagcaagtcatccagagtgtccagatctcagcagaaaggagacccaaagtgggtagctcctatccacaggcacgttgtcctgacaagtctccagctctcagtggagagatgaaccacagtgggtagctcctttcacaggcaagctgtcccaacaagtcaaggagacctgaagtggttagctcctttgggcagctgttagtcttaacgtctgtgtgagtctggctgggtctgggggttttatgagctcaaaagggaggaagtgcatgctgattggtccataggcggccatgggcaggcccagaaaaagcaccatacattctcactctgggccacagactccacgtagaactgatagctcggcccacaggcttcaggctgtccccagcttgaaggtggggcttcaccagggaccacccctttctgcccaggaggctgtctgcttcctcccaccatcaacatgtcatccatagtgcccaggctgttcatgtggaagggtgcctgcaggcccatgccaagcagccctcagcccccctaggcctccctcccatgattattggtgcccaaagtttggagggggccaaggcagcaggaggcagtcttgttggcaccaccccaagcatgcacacacgtggccaggttgcaacagcacccaggcttggccacaactttgctccgcccactcccgggcaccaggagtgggcagaggacaggcaatgggagcaggccctttcaagactgtgtgggcaaggggcttcctggattcccaagagtgcagggatccctggtccagagtcatggctggtcagctgcagctgtgcccaggagcgtggggctccagccctaatgacttggtagggggcagagctcctgcctgttcatggcacttgctgactctgtggagtgtgcaaccctggctgtgcctcctctgtgcaccctgcatcttagtaatggtggttccagacagggctggcatcagcagtaccatcagctttactgtgcatgtgtttttgacaccaagtcttttttgctttcttattttggaatgacaagcatctcaaagtcattattttagttacttgggttatataaatcattggataaactaatatctatcttctcactttttggaattggagaaaattgtggcaaaataaaaattattaatcagattctatactattttctttcactagttttagtattttccaagataaaataatggtcagtctagtgctgtcacatagataaacaatatgaatcacagatatgagctaccattacatttaacttttcttaggaaccaaaattaataaaaatttaagaaagaaactgatgaaattaatcttcatagtgtattttatcatgtaatcaatataaaaattcagatatccaaaatatcacttcaatggttaattaatgtaaaattattgagataattttacataatttttggaactgtcttcaaacacttgtattttatacttatggcacatctctatttgattgatagccacatgtggcttgtgttatcatataagacagcacaaattgggatagtttttatcttcattccattcatttattcattatgtgcatggaagtcaacaaatgaaatattaattaatggcaaatatatttttattgtctatgtcttaatccattttgagttgctataaaggaatacctgaggcagagtaacttataaacaaaacttatacatgaaggaggtttatttggcttacagttcagcaggctgtataagaaggagggtgctgacatatgctcagtttctgatgagcacctcaggcagctttcactcaaagtggaagataaagtggaccagcatgtgcagagaaaggaatggggtgtgggagtgccaggctattttaaacaaccagctcttatggttactaatacagcaagaagtcattcacctggtgaaggatccatcaccatgacccaaacattgtccattaggtcccgcctgcaacattaagaatcaaatttcaatgtgaaatttgaaggagacaaatattcaaactatagatattttcaaattattttcagtaatattctcctttcgggctaaacaatgtccagtaatagtaatgtatcttattatgaatattgtttaaattactaaaaacattgctgcaattactattgctgcataataagtcaccccaaattgtattagtgtaaaatcaccattttattatgctcataaattctgtggtcaggatatgaaaaggcagagcagaggtgacatgtttctgctccacaggttctacagccttgaaggtaagtcttgttggctgggaatggctcaatatctgggatctagaatcttctggaatcttgttcactcacatatctgttgcctaatctgggttaacttaaagacaaggatggccaactttaactacatgtggcctctccatgtagtttgacctcctcactgcttggcatctgagattgaactttccatgttggggctcaggactccaagtgcaagtgttgcagcaaatatgaccaaagttgcattgccttatcagactgtgcctttgaagtcacacagcatcatttcgatttccttccactggtttcagctaagtcattaagttcagttgttattcaaaggaaggtgacatagatcttccctctttacttaggggtcagaattttagaacatgttttacaatgatcacacaacttttctttctgaacactttgcttcacaccttctcatatccacggttatgaattctcctgactatatctattgtaacccaaaatattgactgtactcagagattcatcagagatttcatgtctatatgcccagagcctgatataatgccaccttattacacacataatatagaatctgaggactacgttaactgatacatgttaagtatcctgcagagagctggcacattggatgtgctcaataattgttagctttaagtatcttaaacagctattattataatgataagtctttgttcatgtttcatctccatgacttgtcatgtgttttgctctgattacattacttgaattcttgaagcctctgtttctcttttgtaatgtaggtaataatagtatattttataggatattaatagtatatcctataaaatgagataatccaaataaagcacttactgtagtgtctggtacatagtaagccaagtatcttatgaaaatttgtctagaaattttaactgagacaaatttctcaatgaattattctttttaatcaaccaagaggaggaagtagtaatttattccaaacaatagataaagaaaaattctggccagtttaattctgatgtattttattacataaggtcatttgtgttctggaaatagtctgagactaattaaaatcaagtaagtgtccagattgacaataataatcattgggtgtctattggaaacatttataattaattaaacaaaattaggattgttagctattttcttacatgtctgattcttaccttagtacagaacattaagaacaaagttgacacaaagttatattgtcattctcctatctatatatttcaatatattcaagtccttcctaagtggttaagaaattgctattcaaatgtgtttataattttatactccagtaatgactatcacagtttaaaattggttaattttacctataaccatgtggagagtatttgaatggtaatgagaactactgttataacaaacgtaactcatttttgtttaaattatacctttattttcacaacagttcaaatgcatgatctgtaatgaatcataccatattggaaacgctctatcaggctggtgtgttagctgcagtctttccccactctacaatgtaactgaaaaaaaaaggccagatattccacttaactaaatctaacccttgttgaaggatctctcattcatgatttttttcataccacccacttgatttgtatttcaaatatgcagtattttctgggacattgttattatcttcttacatatggttcacagatgatattaaaactcttcgaaagtctagatgaagcaaagctgttagaaagcatcactgagctaagttaggagagctgggatctagtatctctccattgctaacaaaataactgattttaggcatgctacagaccccttcaggatgatttgctctataattgttggtgtggtatagaatctataaggtcaattacctacaaatgtatttaatttcataaaatatgctatagatttatgtctcatcataatgaccaatgttaattttacaatgcttttataaactaaaagttagatatagtttgggatgctgtgagatactgatttaaattcctttattcttaagtaatcaataacattcttgacttatttcctgactccatctatctatacactaagatagagctgccttagtaacagagatcgatgatagtgatttggatctttgatttctttgtctcttcattttcctggttcaaaactgacacaacattttctttaacttctgataaataacagtgccttttaaataaaatacagtaatgttagtcctcttgtccttcagtgaacatatgaacttactgagatcagtatcatggatgattaggttaagaatgatttgagattggtgagttggaaggtttccaaaactaattgttgaattcctgaatatgactaataaaattaatgagtgagatctgtgcctatgtataatattatttcactttgataaaaaatggatcagataataaaatctaacatgttcaggcacaatgcagtgccatacttagtctatttgtaaacttttcagtacagccaagtgtattcaataattttcagatatcatgttcctaatacattaaacttaatttaataaataatcaaatgttagaatgtatttcagtaatttttggaatgactaagatttctagaagtccagtaaaatttaggttattttgtattaatgaaaaattaaacagcaaaattgctcagtaaactctttgtatttactgtcagaccttacagggaacttaaattattttatatttctggaagagtgaaggagacatccctgcacaattataaaatatattcttaaaaaacacatttttattatatagtatatgctaggcactgctaggaggctaaggtatcttgcattattaaatccttgcaacaacgttgagatgtaagttattataggactgtcataaaaacagaggcttaggaatagtgaaattattaacccagtttagaacctgaatatagccaatgattttatgatttagtatgaccacatatttgatgatagtggaatatttttaaatttttttattttaatttctgtgggtacatagtaggtgtatatatttatggggtacatgaaatgttttgatacaggcatgcagtgcataataatcacattatagagaatggagtatccatcccctcaagtatttattttttgtgttacaatccaattatacccttttagttatttttgaatgtacaattaagttattgaagtccatagtcaccctgttgtgctatcaaatactagtggacatattttaattggaaaaaatctggatgatataagaatagatcatatggcagaacatatacagaggaacttacggaaacaaagtaccacattcccacaccttttaccatttttaaattattgatatttaaggccaggcgtggtggctcacacctgtaatcccagcactttggcaggctgaggcaagtggatcacgtggtcaagagatagagaccaccctggccaacatggtgaaaccccatctctactaaaaatacaaaaattagccaggcatggtggcgtgcatctgtagtctcagctactcaggaggctgaggaaggagaatcacttgaacccaggaggcagaggttgcagtgagccaagattgtgccactgcactccagcctggcaacagagcaagactctgtctcaaaaaaaaaaaaaaattgatgatttaatagctataacattttatttgttcttagtcctttaaaaagttgtgaatatttaggtgtgtcttttttacgtttctttttccattaactaatattattttataataagaagacatgcagaaacaacagaaactttgctaacgcttgtgttaaagatgtgggatccctaagttgagaaaaaaagaaaatgaaaataatcacaaagagataatagaactgctaaaacataacttctttccatctcttcatatcttcttaggatcataaagaaactgctagtcagatgatttttctcttccactaaaagctttttatgagtggtttgccctagagcagccctgttctatgccatattattcaatatctagggtaatgcaacccttgtttctgcctcactagctgttcagtgattaatatattcagggtcctcacttgacgtgagacttttaggtcaaccttctcccagcatatgtgcttgagtccttgtggttgttatgggtattttttttaataatggtgataaattgcattaagtaatttagatctctcactttccttttaagtgtcaggtattgatctatatgccatgatgtcagtcattctttccctgaatgcattaaccttctttctctatgtttgtgtctgatctgcctgtctagtttggaataaaagccctctgggaaaagtctaattcagtgctgtgtatattcttaagtgattgtgtgagcccattaaatgtttattaataaatataaattgtcaacattattaatatttattactgattcatagtaatgacaatagtatacatgaattatgggaatcagataactagatctaagttttatttttgttaataaaggaagtacagttaacgtgtatatacaaatatataaccatataatatgtatacatattcaataattattgtttttcatgttcatattatagtagaaaatgcttcctcagtgactgttttacatttcatttaaatatactttactcttaaacaacataggcaaaatacaactaaatgttgtttgcattgacattgtagttaatcccaaaatgccctttttttatacattaacaaatattccaaatgtgctgagcactctgctacatgttggagacaaaaggagaaacaaaaaatggcccctctcctcaagttgcccaacatgaaacatacacacaagtaaatgggtgcttgcagtccagggtgccgaatgctgagactgggatcaggcgtggaaagttcatccaagaattccttaaaaaacgtgatgtttggccaggtgcggtggctcatgcttgtaatcccagtactttgggaggccgaggcaggcagatcatgaggtcaggagtgcaagaccaacctgaccaacatggtgaaaccccgtctctactaaaaatgcaaaaattagctgggcgtggtggcacacacctgtaatcccagctactcaggaagctgaggcaggagaatcacttgaactcaggaggcagaggttgcagtgagccaagatcatgccactgcactccagcctgggcaacagagtgagatgcgtctcaaaaaaaaaaaaaagaaagaaagaaaaatgtgattttcaagatactctcctgatttcagaaaggcactgtccttgttaaacactatcatgtactaactaaatgcaagcttcaaaagaaccttagcagatatttggtttcaattttcatgtaagaaaatgagaacttagagaaatttgtgattaatttatccaaagacatagagcagaaatttcattccaagtctgccaggcacatcaaggcttaaactctggctgtttactaatgactctctatttaaagtcttaagaatccaataaatcagaaagtgtacttggatctatgtaatagaaagtcttctgtaatttcatctattaaggatgtataataaacctacaatttgagtgactgatacttaggatccacagaagaataacaactaatattcaaatgcttagtctcacagctactacagttgagctagtacagttgagtttgaaaatcatactaagcaatgttttcccttctcaaaaaactgcatgttgctgatttctatatattcctagggttaaaggtcaatcccatatacttattaaattaaaaaaaaagtctcatgaccctaataatagtctaaacttattggagaagcatgttcttttcttctacttggaccaaccattgctaaagcaccatatgattttttgtgtgtgtgctctctacatcactgttagaaaatgactcatttggttcattttttctgggtcaaagagcaacatgggtgtctcaactgtccaagcctaaaatattgactgctactgaacgtatcattaaacacaacattcagtaacttcagccctggatttcagtggcagtactcacacttaagaagcagaaaggaacagacatagcccagttaaatacagctagaacacagggttatcaaacgaacctacattaaaagtggaccttttcttgacacattctggtggcaaaactgagatacaaacttttcagctaaatgttgctgtagtagagtttatattaatttctagaatttcttgaggttgaaagcttttttgaggcgtaatggcaagagagtaagtcctagagaattattcagttcttgaggaattgataattgactttaacttacagttcattatccctttacaatgatcatattgagtttcacattgctttatcttatgtattaaatgttatttcaaaatatgttttccaaattgtgttccagtgatatttgttctataagatagcagtttatgtagaaaaatggaacaatgtcaaagaattctggggaaatctaagttaaacaaaaagtatgttgttttaataatattttatagagcttttcattccccagataagagttattctacagcagcatttctaaactaatttgatcagaaaacctcttttgattgaaagccaaaattaaggattttttggacaaagtactacaatatgcatagcatactgtagttactaaaattttaaattaaatatttatatgaattaaaaacatgtaaaatacaaagagctgttgaatgagactttccatgtgtctcagtttattgctgaaactccaaaactgagagcatcagattatgagtagcccacattctactaaggatggctggacacattcacaataactgagtacatgatgacatgaaaatgggtatgctcagcaatttttagccttcctcgagcacctataatagaaggccaaaaattccaaaggatggtagcagagtgctgtggaagtagagttgtcagcctcctaaagagtatgatggcatttcatattttctacccacacaccccacacataggaggtaacctctgctccctcccctaacccaagagaaacattgacagaactttggggtttgcttgaaggtccagggtggcatcactctcctcagctggtgaagtgctgggctgtagaaatgtgtaggaccagtatgtgcatttcaggggagttaagcaagataatttttgagacagccttacctaggttgttaaattaaggaatgtacatggacatctgattcccctgtcacctttttgccaagctgtgagctgttatggtaaaacacctttctttatgccatgataaggaaagaaatctgtgtttctgcattttcagattatgtgttggctcactcagagggcctacctaataaggcagaaagaagccataaggtatgccactggaaatagttgccagggtgggaggtgtgttcgggtatatataatgcacttaggaaactgcagtactatttatgtgaggtgtgtaacagagcaatgttctctgaagacatcacaaatgtgactcacaaaaaagccagcgtttccagatatgccatggtggagggtgtaatgctcagccagtattaatgccaagtgagaattatagcagaattagtacataagacttttgatgtctacctgaaattcctcttccactgcattgaccctggaaaaaccaaaagaaataaagaggtggaaggagagctaaagactgagccaaattccctcccactgggagtaccagaaccacagccagacctcaaatggagggaaaggaacagcagttaactgaatgtaaatgcgaatattaaatgtccccaagactggagttattcataaagaagagaggtgttttttgttttgttttttattctttcccctgtctcccaacataggacttgttttttttttgacatggagtttcgctcttgttgcccaggtggagtgcaatggcatgatctggcctcactgcaacctccgcctcctgggttctagcgattctcctgcctcagcctcccgagtagttgggattacaggcatgcgccaccacgcccagctaatttttgtatttttagtagagatggggtttcaccatgctggtcaggctggtctcaaactcccaaccttagatgatccgcccgcctcggcctcccaaagcgccgggattacaggtgtgagccaccacgcccggacttgttttaaacatcaatagtgattatgaaactacagaatctcaatgcgatgtcttccaaggatctgaaagggattcctgaaagaaaatcttaaacatatggataggagaaaaatgtagcttttttcttactgtatcctgttagattcagcctgtccagtaagccagttacagagatcatgtttaatttccaggtaattaactttatgttgaattaccagattactgtattaatagattaaaacaatacaaatttactaacttactgtgagattaattacatgaaaaccattgcagtagcatatatttcatatgtataatttatatgaaatagcttatgaaatattaatgaacataattcactgtgaaaaatatattttagaacttcaggttatgtatcaggaaaatacttttaaatagctaatattatactttattatcttaattcatagctaaagtccaattattatattaattattttcagctgatcatatctggtaacatcagaaccagagggcaaatgccaacctaaattaactctctgtgtcacattttaagagaagagcaataagaacgctaaaaggggaaaagaaacatatgaatgtgaaataaactcagccactctgttgtttaaaattattaaaaagtcatatataatatttctatatcatgtagcttgtggcaaagacatcagtcatcacattatctgtacattgaacatgataaattgattgtgttctaatgagaggatctaattactcagagaaatgaagagggcatatgaaagctttttagctccaatagccatatattatcattgataacactgaatctggtgtggtttaattcctttgttctgtacattttggaagatataatcttcctaattcatttctttaaagagacatcagatcatcaatttatcatactcctaaaaatagcaaaaggaaatatcacaggaatatgaaatctgtgcaatggtcatcagaggttttgtacttgggttccaccccgcccatgccaggctttgctaaacttccacaggtagcaaactaaagcttccacataattattgtttcaaaatataattgtaaaacttattcagtaatttctacaggatatctcatgatcataaaattatgttggaacccttctatagtcacaaagtagaatcaagattcagaattatctcaacagtgtgtcactcaaggtcaaaataaacaagatgaaatataatagcagaactgaaaacttgtgtatttgagtttcaatgatcatttgttcaaacgtagcataaggagatataaggtgtgaaatgagtgactgaatgagctcattctcagttgagaaggaaaatattgcacatttgaaggacgctcatgtggaaggaggattagatctacaggcaggtgaacctatggaatttaccactacacagtttttaattcaagaaatagcatgttaacaaccagagctatcaaataatggaattgactgctttgtaatggggtgagttttcttcctggtgtccttggatactgccaagcaataactgtataactatgtcgggaaagttgattatataaaaagcatttctgcagtcaaacctggaagtaatgattatatgacttctaagctgtctcctctgactttaagacttccagcttgtattttttttcacttatgtaacctttcaactctctcactggtatttatatttcgtcttattaattataggcataattgcacatgtctttagttcctttatagatgtttttctatataacaaattttataagataagtaactgcattgtttttatattcttctcttctgtgggaagtctagaagccttggacttagaacatgccgaaagcatttgagtgtatggtgaaattaatacaggatagtattttttaaaatagcatataagagaaatatttattatagtattaaaataacattttcctgagttatctttcaaaaactgtgaagagtctgagtttttacccaactggcatgttaacaaggtaacgtaagtcagttttatggatgctgattgaatacctgagacatcagggtcagaaggtaccacagtttcgtggatgttaacagaagactcaagactcctgagataaagaaaaatgactttattatttataatacagcaaaaagcatagacatcagcatgtttgggtcgcttcgccttgccaccagatctcaggggtaagatgcagatgggcccagatagtgcttacacactcagtaggttgcattacagaagataaacctaagtttgcataaggaacccaatttttaaataacagatagtaagcacactttccctcttctccaagggagaaaatatctattatcctgggctgtttgttataccaatatccttggaaagatggtccaaaacaaaattaggtcattgcctttctcacaagacatgcagaaacatgagagagccatggctaatcgtctcccaatatcactcataaaatacttctacatcgtgaactgaagagggcaggacttgagccagacctggtgtaggactgtgtgatgatgatggggaaaaagaaagaacacggaaaagcaaatgaaattcacagatccagtgtgtcgaagtgactttgaaactataatttacctttagttaaataatctgtatctagaattggcagtggctatatattgatatctatgatatttgtggcttttatttcttgataggacgcctgattccatcttcaccatagctcttttctttttgttgttcaatgtgaattttgtactatagctcttttatattttattgtttctatgtgccccacacatgagcagctaaccagtgcattttggtttattttttggccaggcgattctaaccaggatgggtgacttaacagaaaaagaaaagcaaggacaatctacataacccataaaacccaatttccaaaaggccaggtcctctatttaacattctcataacttgctctgtttccataccgcagggaatagcaattctgtttaaaaaccataaggaaatggtagcagatattatcagaaatatataccaggacaggacccttttttactttaaaagttttaaagataataagtttcctttcaaaaataaccgtgctcactctcttcaggaataaccaaagctttcattttctttgctttctttcttttttatttttgctgtcttttgaaaggcaagacttgtagattgatacagatctgtctatataagatatccaaaatatatagtttaaatttccttaaactctgtggaagtttctgccataattactaattttaatctcaccaaatctgttgttatcattaacaccaaacactatttataaagcacttaattgaatgtgggcctgtgaatactattgagcaaagctaattaatgcataccaaaattaagtaggctattataatgggacatatcccacaatagtacatggaacagaggaaatatccaccaatttatggttaaaccaagaagactgggtttataagcacaaagcataaaaatgaaaagtttcagaaaatgtttcagtaactatgaaaataaatgaatatcatattttctttattaaatttattagttctgccttcattactctcaaatttgcacacaaggataaggatattgcccactaatagataaagttatctcatctaatatacacatatttagcttgaaggttgtttgagaatcaaatcactaagacaggcttctttgggtgaatatactgactgcactggtgaactccaaaagtatattagagcaccagcattagactctgtattacattacaacatatgactgcttttttcacattacctacttatagtgcatttctaagtacattagtttggatcttatctttttaatctttgtatatggtgtaaggtaggggtccaaattcattctttctgcttgtatagtcccttcttcaccaacaatctactttaagctctcccctgtatgtctggtcttccctatattgtgagttctattcactcataatttgtgatttcttatagtttctgcagttcaggctttcaggtcttccatattgtctgtgttcttcttaagccttcttagcttctgttctgtcaactgataaactttcctcatgcgtcgccaatcttcaatttagagtcctgaataaaaaatctggctgacactaaacactgtgatctctatttgggaagaattttcaaaaagatctctagtggcttatcaattggcttttgtccagtaggacacaggctttttgcatttaacctctaacagggtatcatatgaaatagaatgggatacttataacatgtagccatgtgccttctcacagagtagaagactttatgaaggtaagccttagctgtgtcaggcatttgtggttttaagagtccagtgtaaatctctgtacataggccatttataatttcacagattgtgtcttttatctccaagttgattcatttaaagcagaggtctgaatagtttattcattcttcaccttagacctaaaggaactctgcatatattcctttggtacgagataaaacttctcctttgcaaagtgaacaattacctccataactgcctaaactcaggtctagtctctcttttgtccagatttaacacaccattatatgcactgcccttcctcagaacctttccacccacttgtttatgatcatcttccttgtagctttgcctcatggacaactatttcttcactgcctcactcatagtagcatttgtgtccactttaatgcttcttgtagctttttccacatcagcttccaccatgttttctgtcctactgatctcaacattttctatttagcctcctttacctgcatttctctacctaaatcctcattcagttcatatttctggcttctgatttcccatcccactttaagtattatctgtccatcaaccccaatgcctaaaaagcattaacatctctgaaatatgtattttcacttaatagtgtagttcacttttaggaaataaaagtcacagtgcagtctacaataaattagacaaaataggatattataagcaatataatcatgttgcctagcatataaggatgtattaaaaacaacataatttattaaattattgttcataagacagaaatgttctttcttttttgatccaaagtgagaactttttaagggcttattttataaacaagattgtactgaaattcatatatagataaaaatgaacatgatttattatgaacaatttcagtattcagcatatttatattgttattaataagattgggagcagagagctaaagcattttactttgccttaaaaaatgcaccaattatcagcctgaccattttaatataaaaaatgtttatattatagtataaattattaatcaatctgccacaatcattactttagttaaaactgaacgtacttgtggctagcataggaaaggagacattttcatgttaacgtgaatttttttaacctaaattattgcagcctattgatcctagatctgaatcttcaaagaaaactgatttatttcattaattggaatattttaaccagagaagtctatcaagttggggtttcaacctgaatgaaccttttccatttagaaaattgatcttccagtcacacttttatgaaccttgagcttttagagcatggttgcttttaaagacagatcatctccagtaacatcttatatcattgacaggttggagtatggatgttagagcaaactaagtttgtgatatataaccacccacatacagacaaaatgaacaaggcatatatttaaatatgcaagctagacaacatgcagagcagtgagtaaggagtaaatactgagtcacccttagaacataatatatgctggtaactaaaaaggtgggcacggggcaggaactccataaaaataataattctgccatgatgtcttttatttaccaaattacatctccaaatacattgctgtaccatctatataaagaattgaaagtgtctttgaacacaattacttgtgttgcctattgactcattaagagaagagcattgttggaatgtgatttacttagattaacagtggtccctacagttaattgggcacagagtgaatatctcaaagtgaacagctcacaaagtactggaatatttatcagagaactaaatgactgatgtacaatgagtctacttgttagagtatctacagtgtaggtttggagtcccaaaaaacaagatttgaattctggcagcagcacttaaagccatgtgcccttgggtaactttaaaccacctttagtttttaaaagtgtgaataacgggcacttttaagaatcttaatgttaaacaaaatgtttgaaactgttctttcaaaaaaggaggccctctacaaataggtcacaataaaatatgaaacataactgacaagggtcatagaaaatccattttctagcaacattattttttcctctctagaaaatcacagagagtgaagttaaaaccataagttttttttttttttttttttggcatccaagaaatcagagcaaatgggatttgtagtatgagcctgatcattaaggcatgcatctccataatggaagaaaaccacacgctcatgggaacagcaggcaggatcctgagcaagagtaagcccttccagagggcaaggtgagagaaacttgcattccttctcaaaccactcattctttcctttctgagcaccaaatttcaggtgacacacacacattctttaggcatgatatgagatttgctcagctaagaatttcttagatattctatgagtttactatcaaatggacaagaaatcaactacataaattgtgacacctaagtcacaattctgtttacttgagctcagtgtaaattttgagaagatgtcagggtttttggttctacataaatatattgacactcaatcaagtcattattggtgtgtccccttgcccatttatccaaattgctgctgttggcagttttgctttgtattcccatcactatctatacttcagttggtccatattttagctcttcaattgtgtgagttttttctcagcaactgccatatttgaaaaccatatccctcttctgtgtcgcaaagacttattatgcatgcttctctgacacctggttttaaattctcaggaaatactggacaggaaccatcagtttttcagggttaagagaaaccatcttgtccagcaaataatcccttctttttcttttgttaagctaagcctcttgccaagaaattctaatttaagaagtctaatttgctggtcttagctgtttgattgcttctggttcccctgtgatgagtctgtggaaacaagggccacagtgaagtcaacccaacccaaactgcagaagtgagttacttttctcagtgtctgtggtttgtcttcaagcgcctgttagacacctatggaaaatttttcctgatctcaactctcctggataattctgaatcagctaattaggtgactagagaggtagcaaattcctgggtttacaagcatttttttcttccattgattttctttgatttgctcttgctctaacttctttccttctatcctgggacttgatttgtatatagcaaatatgacaaatcttactgatatcaatagagcagaaagggggaggctggtagagtctctctgttacttaaagaagcaggatgagggtttaggtgacaaaaaaaatgatagttgatagaaaacaagaggctacagattcaacagaatatatgctttaataggaaaacgaaccttttaaaagctagcttttctgaggaaggaaaatctaaaataatgcaagtcatctgactaagacagtgaagtttcttcacttctcacaaaagcaagaagaacaggcagaagtttttctaaagtaatgaaacatagtccagtggaataagtcctttatcaccgtggcgcttagtttcctcaaaattctctgaatctatcattttatgatttaaggtcctaaaccagactttcttccccaattctctatgatattttatggcaccaccatctacctagtcattcgctccagaaaacttacatagattttgtgattcctcccttgtgctcacctcttaattatcaaattctgttttattgtccaaacattcttgatttttctccctcctttcaagctttactcccaatatccttgttcagcctcacatgagtcctatactgactgactgaaatagcactgtaataggtttctgtgactccagtcttgtctccttcaaatccatgctccatggatttcaccctaatgatgtatctaaagtagggatcagcaaactatagcttacaggacatatctgggcttctgttcacttttgtatggtccataaacccccaaaaatgttttcttcatttttaatgatttcaaaaatcaaagaggaataatattttgtgacacatcaaaatgacaagaaatttaaatttcagtgtccataaataaaggtttattggaacacagccacactcgtttctttatgtcctgtccatgggtgttttgtgctataacagcagaattcaatagttgcaacagagatcatagaatccatgaagtttaaaatatttaatatctggctctttacagagaaagtttgttgatccctgctcttaagcacaaagactattgcatcatttctcgaatcaaaatattttactgatattctgtcacctgcaggagaaacctagcctcctgagcatgacatacaaacctctgctatctgagccctattctctccagcctcacccttgtttatactgttgccttgcactagattgttctgctctgccttggttcctatgcttgtcttcatggaatgccttactcctccctctttatcatgtaactttcgcattacttatttatttttaggggcagggtcttgctctctcacccaacctgggttacagtggtgcagtcataactctcactgcagccttgaactcctgagctgaagcaatcctcctgccttagcctcccgctacagatgtgcacaatcatgcccagcttgtactacaggtgtgcaccaccatgcccagctctgtttctcatttctgtagaaggagtattgagatcatctcctccagggaaactctgtagacctccatgcagaatagtaagtcctccctgacttctcttgtcctacataccacattattttatgaatatcgatttgtgcttgtgtctaaactgcaagctctggattttgagcccatcaatacttggaaaaggatctcattttttttaatcctcagcaaatatcattgtctcacacttaatagtggctcaatcagtgtttgttgaataaattaaaatgtcttatatatatctcaactaacaatagtcttttaggtttaaggaggactttacataatactataaacagtatcatctgataacaaaaatgtagcattaaaattatttgtaaacatttctaatcttttctactatgaataatgctacaataaatataggagtgcaggtatctctttaacattttgattttcttttctttggaaaaatatccagctggatcatatggtatttctgtttctagtttttggagaaacctccatgctgttttcaatagtggttctctctccacgttctagctagcatttgttactttttgtctttttgatcatagccattctaattgtgatgagatgacatttcattgtggttttgatttgtgttttgctgatgattagtgatgcggaacattcaattttggtatgtcattacaaaatatctgattttcagtttagggacactgtaaaacatataaccttaagattatttagatgtaaaaataaattgctctcatagggctgaataacacatttcataaatatttaaacaactctgcttgccattctctttattatcatgtatcactgaccactaaaaatttcatatatgtgctatgattatagaataaattaaaacctcatacatgtgaaatattttatatatttaatattagctagaagaaaatatttagcatagttaaatttagcattaatatgtcatagcatcactttgtacttcttaagtatatatatacaattgtaatttgtcaatatgcaataaaataaaaattcaagataatactttgtatttattttgtaagtcaaaaaacaatataagaaaataggcttcttcctcccatagaagttagtagaataactgtagcaaacatatcactaattaaacattagtgaaatgtcatttttaaagaatctaaggcaatatatatctattgagcttcctaccatggttaaaacctactgttaattattgagatattcaaaggatttactccctttgatcttgctaatgagaaaaaaatatttaattctttaagtgttttatcattcattcttttcaccctctccctcaacaacaacaacaacaatttggattgattcaattgcatttgtaaatgtatgtgtatgtgtttcttaaacaaaggaaattttattttagctatacactttttagatctctttttcttcaaactagttgttccaaaaagaatattttgcttttgttatttgcggagggatgtgagaaacttgttcaggggttagcaggaggtgttttttttttttttttcttctgccattatctgtaaaagtatgaactctcatgacctagcctaatctgatgatgggtcactttctgttttgaatctaatttttatgttgccaatctttgccagactgatcggtaatatcctaagcacatacacttatagattttcacagtgctgtctgtcaatctttgacttatttcatcccaaaacttttaacttgggaatttgctgttattatttttgctttaatattggttttactattttgctttttcccttctaatacagaatagtgtaatgtttaattacattccatcccctaatactcatcctcagttcatcaaatatcgtccttttctttttttaatcatgtgaaattagaacacctctccaagggctaaggtgaagcatttggttctttatatataaatacagacaaatcactgattgtgagctattttctgacatttttggtttatgctagactgtctcttggctggacttatttagtttatcttgtgaccatccactttctgttatttgcctgctgagcacacatttttgcttttgcagcctgtgtagaaaggtctgcactttaaaaagttaataggtaaaaggaggttggtatttgaggcaaaatgttttcctaggaggatccccatagctgacatttgctttccttctagatctcacagactgaatttgcaggcctttgggactctgtgcacagcccatctgttagagcaaagctatgccaagctgatctggatatgactgagaggaatgaggaggggatttttaaaaattacttttatagtcattttctttttctttaaatacaaagccacattgttaggatgaacttgattctgccatccaaggcaaactgacagtgtggtattagaaataaacatcaaacagaacctgttgaaatgtcgggttatattggaaaggtgtcaggtttcatgtcatatgtgtttctgttcaatgatttccatcatgatgctattggttatcaacaataactgaattaagttaaacaatatgttcaggaaacatttagtaagtgcctataatgtataaactatgtggaaaatcttagatatgcaaagatatctgagatgtggttccttctttcaagaagtttgcaaacaggggatagcagagcacagatgtatccagagaataaaataaatgtcatttaatatgcacaaatagcatagttttaatattgatgccacttatatcttagtactatggataagcaattcactaaagtgtgttatgtatgacctacatttaatcttataacaagttatgtccattttagaagggaggagatgagatgcagacaagttatggccccagatatgagaggtcatcaggaggataatgctttgtctcaaaacctgtgtttcccaaaaagctacaatgcctagggaaagcaaagacagagaaagagaaaatcaaaaatgtacttaacagtggggcagatgctggcctctatgagaaattacctagaaactaaacatccactttctcggccttcctgggacagtggccttggaagagtttctgccgggaagcctactaatgggatttaaattaggtcagatgaagctggttttgctctgcttcacctaattccatcttcctgcctttgaacacagatgcagtggccatagctgctgccaccatcttgcaacatgagaaaaaaaaaaaagagaattccatgcatagaccttggctcagttgagttgtgaacatagcatagccagcagctgtcttcctcccatgtttattgttaggagaaaaaaaaactaaagccctgatggtttaagccattggaaaatcagattttttgttatttgaagcttaatggaaacttaagtaacaaaatctatctttaacctaaactattgaggctatgatgctattgtattcttcctctttttcaatattttagcttccttgatttgtataactccacttacttttgattttggaataactgtctggttagtcacactttattttctctgtagactgttctttcacttcctacatcttaacgctatttcccaaagttcccttcttgtctcgtaattttctcactgccttcagcatttgtactgcatactctctcttcgtgacctcatccttctccttgttgttaaagaggcatgtagtgttgccataaaaatgccttaaccatgacatcatatgcagtgacttcccaagctgtatttctagatctttccctcgagctccagactgaaacatatccaataattgcatcaaattcaaaatatccaataactgtttttcatctttccctacaaatcttgttttctaatctattcacttgcccaggtcagaaatctataagtcattttggacttctctagattgtctttttatttctagtcagacaccacattctgttcaattgtaataacccttgactctatttattccatctttatagccactaacttagcctaagcttttgcagtatttctcatctgaattactgcagtcagacccttaatggatctccctccctcagttctctcattccagtcaattcccctacattcttatgagagtgattttccttaatagaaacgtattggaggcatttgtccactgagatccttcaggatttttccagagttttaaagatttagtgcaaacgtttagcatggcatttcctgaccttggtttagttatctaatctcttctgtatctatcctatcacttgcattcatttccatttatccagttaataaatagctattgagtaaatgatatgtatggaaaccaggctaactaactgctggggctacagactttgtcctggccctcgttgaacttactgtcaagtaggagagacagataataaagtcagcaaaataagttcagcctgtgattagtaaaataaagaaaatagatttctgtctttgagaataatggtaggggagagtgatttatattacatcatctgtgaaggtctctctgaaaaggtaatatttaagctgaggcttgagagatgaggatttagcaatgtgaagtgttgaggattgaaatgtcctagacataaagaacagaaaaataaagaatataaatttagatatattaccactgaactgtacacctaaaaatgataaagatggtaaattttatatgtatattgtacctccaaaaaaagaacagcaattataaatgtcatgaagaggtaaagaatctggaagtttctagaagtgatcaggccagtggggtaggagaataaggaatgagaaaggtggtgttaaaatgaactatttgaaattcttaattcccccaaaacatgacacactgactattgcttcttgcttatatgagcttgctattattattgttgttattattgttactttattataattaatattacctaaaaagcttcctccttttgtctttgtcaggttaaatgttactcttcttttaaattcctttgggatttaaatggatgaatgaatgaacaattggcattgtattattattattactataaataattgagaaaatattaaaagagtcagaaaaggagagtgggaaaaaggcctctgaggtaggtgtgagatttcacttggcttcacagtcacaccgtgaggcttacctcctgcccactgtagacaagaggcaggagaagtgaagtaacacattcacattggcacatgagtaagtgaaagagctaggtaatgactccctgcctggctggctgcaaagcaagtgcaaactttaatttaaaaaacagacctaaataataagtaacatttaatctgacatacatggacatttgcactatgggctgcagatatgttggtgttgttatggtttgattaattgtctgggtggcttactgtcacttcatgaaggtgtctgctaaaatgtcacttcctgaaaaatgtttttcctgaacctgtcttaaggaaacttcaccaccactgctctggacccttttatcaggttttttttgtttgtttgtttgtttgtttttaatatctgacaatttctattcactttcctactatttataagagcagagcctggagctcaaaaactttatggaaccaatgacttgaatacttgaataagaaagctaatcatagcttcttccaccctcacagttttatcttaccaattaaaaatgaatggatatttttctccttttataaaattgagtgcgcttctgacagcacagctttagattaatctatttgaatctcttacaataaataatcagcttccatgccctatctgcccaaatattgtattttaggttgcttgtaagccgtgaaattcaggaaagtatactaagtaacatgtggcttattgttagtctatacaagaaagacctcgattttggctgccttttgtttatctcaaccacttttatcttaagcctttgctatctacacaaagggcacatgtcaacacatgcaataaggtagatccagaagttccctccgtgcaactgtgaggctgatgtgaaatgtactgacaactgtccctaaccctggtgccaaaaacatagtcccatctcgctgctgctgccggcagggtgggctgtactttgctgcaagtattcctacatacttctaatttgaatttttgcaaagcatttaaagtatttctgtaaacatatcagaaatacaggaaagcttgccacaccctgtttaagaggttattgtctctgatactgtagtacattttaatagggttgttttccatctattcttattccctcccttaacctcatatcaatttgagatccatcgatgtgtcacattcgggatttgttaccaagagaaacttaactgtcaggtttcctgttcttttttagaagacgaagaatgctctgtagcttttacttattatatgtgatagatgaaggaaaacagttgagtgcaacaaatgtataaaagcagaatggtaaatctttgaaaagctctttggtgccaccatgtggataagatttggtagttttgaaactatgctgggacattctgttcttcaaacaattctacttgcatacacaatttttgttccactaccttcctaaaatctagttctcccattacccttgaaaagatgaatttttattataaagtaaatcaagggaagtctcagaaattgatctgaataacatttaacttttcagccagagctcacttgctctttttttctccctttgaatgtgaaatagggggtaagacctcatttataagcttcatttgaggattttcaataaaagaacattatatctgaactaaatcaataacttttacttgggttttcatcctcatacacagcctcaggcctgagtacctctgcattctaatcaaagaacatcgtctttttatttacaaacattaatatggcttactagaaactattctaagcaatccacaaaaaccaacatttgctctttttgacaaccctttgtggtaggtactgtcatcatcataagcattaccaccaccaccagcagcagattctgtgctcttaacctctgtgctccattcacctggtgctcatttcaatcagccgatgatttgaggagcctctcacttaacactcatgttctcaatctataggctcaaccctgttcagttttctaggtgatcctgactcaggcagataggttctatgcccacagccatggcatcattgtgtacattgggtctattattagtccatttgctccaaacctagattctgtagtgccatgggcatgccctgtaaatccccaaatgtactggcaatctttttctccctccctattgtgttggcccaaccggtatgaactcctgcctcagtaacctagcacaccatttacatactgggggagaacacaaccccggattctgacctcctctgaaaggctgaactatgatgctcgtggctaagtagcataaatatttccattgaaatgcccctgcttccaggttaaacctaggagagccaggtttaagtatagccagagttatttgtgagattcattaatctgcacacattccctgtacaaacagccacacacttgggtccattctgcgagcccctgggccccatcctaactcctcctcagtgcatgttattaagatcacaggaggttttcaacccaaatcagtccagctcttttccattgctctgctatataataactgtacttcttttggtattcccctattcctatggtgctcttgcactctcatacacacatcaagtatctcccctcagtttctttaaaaaggtgccaatctgttccacatttgacaaagctttctctgataattggtctgcagcagagagtttactaatttcttcaatcataggaaattgaatgaatcgttttcagcaaaaatcccccagttatttgagcaggaacatgctttggtcactactgaccttgagcttgtaaataatccttaatgttagtctttggtttcatgtgtgtctgcagaattgggagacactgtcggtacttttttacattgttttaatttaaaaaacacaaggacattgctttagagcctggaaccattctgtgaaaacagaagacaacttaatatggagtctttaataatttagttgaatatatttaatttaattttctcctgaagacatcaatatattttaagtttttctctaaagaagtggagggtctttccattgcatgcacgtaattcaaatatggctggtgtgtgcttctaagtgtctatccaacctgatgttgaatggctgggaattcatacatggacctttgttttttacaattagtaggtgtagtcttgtgataaatgaatgttttttgaaaactgagtattaaaaaggcattaaagggcaatataccatacatatatttgtttaaggtctttatataagggaaaagctcagtgtagtgtagaggaaagatttggagtcatagaattgagttccaattctgctctcaactgtattaacaacttaataatatttttatttcagtgaaaactttttatgtaaatggagaaaataatgctgtccttctagaagtggggtgtgtgtgtgtgtgtttgtttaaagatgataaatctaaagtgccacattcgggactcatacattttaattgttttataatgattatttgtgttatttttaactcaataaaacccaaacaatatctatcttttcttttcctgtgtcttttccagattttcttcttccttctcttttccccccccttttcttcctgcttctttctcccaaaaagcagtaaagtatggagaagaagcaatacatatcacattcttacagaccaactgcttcatttcattttgaccctctctggccaaagtgcatttataatttacagtaatgcaataataaatttaggataatttacaaaggcaattttggttagagtaattaaatatgaactcagagtaattataaattcaaaatgatttttaaactgtgagttagagaaaaatcagcaaaatatttagcaaaatcgtaattcaaaatgaaggaacctttgcatattttcatttaaaatttaaaatcagtttagatatctgacagttttctccaatgtgtcccaacattgcccataggtagaccacagaatccccaatcagtgtcttgctccactcttaaccattaggaaactgcagaaagcagagtaattcggtccacttgggcatctggatcgcctgccctggacactgagcattagagagctctgctctgctctcttcccagcaatattttcctctatctgtatgtccactaccaatgaggaacctattgtgtatatacttagatcctccgcccttcttgtcaacctgtgtttctcaaaccctctggggtcaaggttcatttttctctttactgttttgaggatcaatatgttgataaaaatacaataaaaataaatttctaaaaagacaaaatgtaatttaaaagaaatataagcatctaggtttttttttttttattagcttcaacagacatgtaagtactcaatcgagttgctgtgaagtttctgagtactcagtcaattgctgtgaagtttctaagctcttattctcaattttgtatatatcttgttgcggtctagaaacagtttccagacaagctgtttatggacatgctttgagtagcagtgttctaaatcacactcccaatattcaggccccccgaatttcctgcacaaaggtcccaagccagccacaattgcctagagcatctcctccaggatcattctcccaagagtggtgaaggaatcccttggccctcgggataacctagggtaaactgttggtggatgttgtgggcttgtggacagaacttggacgtatgggccaatctgtccctgcagggagacatgggcacctcatgcaggactgggatgggaatgggaagaaaggggcccaggatcctagcaattcctcctcttaccctcttgctccattcccaggaaacatttgagtggagatgcgattgctgttttgtcagctttttctatatttctgaaggccctgttgttccttgagcctggactccctggatctgctagactaatcctgagctttgctcctgcctcccactttgcccttccccagggctgcgggttttcatgttcagtgcatttgctccatattactcctgtttccttttctgaaaatgaatcttttaaactattaggataaagtgtgcctatcctaaattcatggatttctaagatttttataggaatgacacagagtttctgaattctagccactgtaacatctcattgccatgccacctctgaaatgtctgtgttgatgaccctgatttaggacccagatctgccacgaatccttggttcagtttagctcagcagaaatgtgttgcatatctgcagttgagcaggcaccacgttgcgttctgggattacgatgctgcataagaccaaacccatccactcaaagagtgtaacatctaataggctttttttttcttttttgtaaatgtggaatctgaaatccagagagttgaagcaatttgcccccaatcccacagctagtgcaaagaagaagttgcttcaaaccagattttttggctcagtgtccagggacctttccagtatatcattcttcctcatatgtctcagaacaaagctagtagacatttctgaaaaacgttcacctttgctgcattgctgctccatacatcaaagagatttacacaatcttgaggttctataagatctattgaatccctcccaatgtgtaggaggcacagagaattggaaacagttaaggggtctgagtttaattctgaggaacttaaatttatagtttttctttgatcaacttaacctgttgccttcagtttccttgtctgtgaagtaggaatcatctatgtcatagagttggtatgaaaattaattatatacgtgaaagtattggtaccattggtgctacctcatattaggaactcagtgcatgagaattccttcccctttcttgtctgttttgtgaaactcaaatcctttagtcactagatgtaaatgtacacattaaaagtattcattagaaggtgcaaattcactatagccactgcctagttaaaattcactataaccagtgcctagttcaaaacttgattttttaaaacgattttttgaaacaatttcagtttaacagaaaaattgagcagacactgcagagttcctatataatcctgaatgctctgcatacagtttcttctattattagcatcttatattagcacaatgtatttccggtaattattgaaccaatgttgatgtgttagtctgttctcatgttgctaataaaaacatacctgagagttggtaatctataaaggaaagaggtttaatggactcacagttccacgtggctggggaagcctcacaatcattgtggaagacaaaggaaaagcaaagggatgcctcacgtagtggcaggcaagagagagcgtatgcaggggaactcctctttataaaaccatcagatctcatgagacttattcactatcatgagaacaacatacgaaagacccgcccccataattcagttacctcccactggatccctctcatgtcagtcacatgggaattatgggagctacaattcaagatgagatttgggtagggacacagccaaaccatattagttgataaaccattaactaaaatccaaagtttattaagatttttttcttttagtttttaccgaatgtcttttttatgttccgggatcccatttagactaccatgttatacttagctgtcatgtcttcttaggttctgcttgactgcttgactcccagactttctttgtttttgatgatagttttgaggaatactggtcaggtgttttgtaagattcttttctgttgtattttgtctgatatttttctcatgattagactgcagatagagttttttggaaggaacatcacggaggtaaggcaatttttagcacatcacaacaaaggatacatatatcctttatgtataactgttgatttataactgttggtgctgatctggatcaaccagctgaagtagtgtttgtcagatttttccactgtaatgttattcttcgctgctcttctttgtgtattgtgctctttgaaaggaaatcattatatacagcccacattcaaaaagagtgagtagttatgttctctcctttagagaggagtatctacataatttatctggaatcctcctcccgcatttataagtttattaaaccacttgtttatatcagtatggaatgatgggtatttgttttatttgggggttattagccatgatatattttacttattttgttactcaaatacttccagctttggccactcagagctccttcagtgggttcctgtgcacttcgacgtctctccgtcaatgtacatgtgtgtatgtgtgtatattttgtttgtttagcattttcttactttgtggcagtacaagatgctccaggttcagtttggatatttcctactccagtatacaatcagctatttctgcaagcatccctagttgtttctaaaggagaatggcatttgaaactaagatctggacactaggcatgcttgtttctactgcagtaccatttcctttaggcatttggattttaatgtccacattcatggtgttattattatcacagtttatcctactttacagaaaactaaaagtggtataataagatgccactgagtgcattttggaaattttttattcacataactttttccagttttttgtgatttgattgatgaaagtgtcattaacttcctaaaaattatgatgtacatcaaagaggtgaagtgattatctttacagcaaataaatgtttatatacacatttttcccatttacctaaccattttcttcctagcattataaccatcccattttctctaggactgaggcagttcacagttttaaaaccaagaaagtcctgggcaagaattaatcagccactctattcacagctctgataaccattataattaggtattaaatagagacacttagagatatgcgggtgtgtgttcatacatgtatatgaatgaacacatacacacacacaaaagttgacattatgtctgaatattttcatcatagtatccctaacttattgactggttcactctattaatatttgtaagttaaatgagtgacaaggttaattgaatgaattcatagcctgtttgattaacgcaataaatatatggtcgtacatcatataagtatttacacattacatgtctgtttttagaatacttttcacctactttctcattatcattgtatctccactttccctaaactgtagtaatgttgtaatatttgggatagtttaaaagctttgtttttatagccatgtctatagtgggttcactcccccaattacacaaagcactctcatactagtaaacaaagtgttggaatttgcatttgtggatgtgaacatttttttctgtttttggttatttgtctccatttttttaaataaatttactgttccggtttttttgttaatttttgtatttgtatttgtcttactagtcacagctcttttcatagtaatggtattagcctattttctaacatatactaacctttttctcttagattgtggtttgaattgtttgctatgtagaagatttatattttgggattttgggggtttgtgtgtttccagtagtgagatttatttattatttcttcataacttctggctctggtgtcatttgtaaaacttaaaaaatgctatttgttaaaaaaaacagcatgaaaagtggtccatgtggttgtctgtatattacccaagtcatgaatacctagcaatatcagttatcagaaatgacaaatatcataaagtcacatcaggagagcatagtaaaggcaggagagcatacttaagttgtaacactttccctgtgacaaactcccccttttgtaggctttgttgctggcatataccgtatttatctatgagccaggacaagaccactaatgaatcttataaagcttgagaaagtgactatgcaaaagaaaatagatccagcctgttactctactccagaagagagatgtgcaaggactttaaaaataaacagtcttcaatattcctttccggagataatacgattcttttatgtgagatatgtaactttcttttcctttaattactacaaaaataatttgaattttagacaactctgtgctatttgggagtattactttgtgtgagttggtgcaaaatggaaaattacaaacatcatttaaatgtcctctgaataaactaggtataaaaagagtaagaaaaccaagttcaatatccttggaacaacattgctaatgttatttttaaatgcatgtttatgaatccatagtgacactgcacaaagaaaaaaatcaccactgcatgtaaattgcttgcattttccagtaaataccactttagttttcgtagtaaaatttactgtgcaaaatggattatactcactcttccctttgaaggtggttgcaaagtgtgttttgtgatccaagttcatggattgcagaagctcttgaaaagattacgggtttatgagttgctttaggtaaagaagttaatcaaatactagaaaaaataaaatatctaggtaaacacacaatttcaatataaaaaatttaaggtaggcagagttatgcttgtcttatagaattacagtctgagacctgaaagcctcaattttcataagaactaaaaatgaatcatttcagaatcaagtttaacacagtaaacttagttgcaaataaaggaaaaacataaaatatatacttaaagaaataaacacccttgaactttttactgtgttctttcacaaaataattgatgctaaacataatcacaaaatttgggcagaaagctcatgtgacattatcctgactcttaatgataataataatgataaccatagaatccaccggatgttgaaaatgtgcaagacactgacacaggtacctcgcatgtggtaactaactgcatcctcttagcaaccttaggaaggaactgctattactatccccattttagatgagaaaatttagacacacaatggtgaaataagttatccaaagtcacacactaactgaagtaggcagaaattcaatgtagatataataggtaatatccatttttatcacttatagaatcctgttgatcccatacaataatgtacagggaaaaaaagccttttgaaaaattgtaatgcccaacaacatagctaaagcattaacatcattataggttttttagtctctcaaatattttcctaattcatgcaaaattattacttaaggtcagaaatccgcagtttttactttaaacaattttcttcagatttatatatatatatatatatataatacacaaatcttgccatttatatttcaatggctacagaacttgtagcctaccagccaccttctctcgttggtctaaaaagtatagaatcttgagtcaaggggtcttctcttccaaattcatctccacaatttataagcttttacagaataactaaattgttaggccttagcgtcctcatctgtaaaatgggatccactaatagtacctatgacactgaattactataaagattagtgtttgttagcatcaattttcaaagataattagttgaagcatattgtgcctggcacacagtaagaactcagtaagccttagctgttgctgttgttattaatataagtacgagtatcagtattactctcagaataggtattattgttggtgttggaagtagtcttataagaacaaactaaaagttctccctacactcaaattctgagctaatattataggaatgaaatcacaaaggccatctgacaacataaatcttcctgacttgagattgcttttcagaatctagaaggacacataagagatggatctcctgcatggaagagtggtcactaaactttagattacatcttccctatttctccagaatgactgtgcctccagcccttcaatctccctcagtaataggctgtttaacttacttgtggaatattgtatagattctcaggtatttaaggctggaaagaaccttagaagtgaattattaggttggtacaaatgtacttgtagtttttgccctatttttaatggcaaaaaccacaattacctttgcaccaacctactagttcaactggtgggctctacagagggctgtaaagtcaggatttgctgctatggaaagagctaagactacagtcagattgttcctcccttctttccttttttttttttttttcattttctttgtttggaaacatttgcatattttctaaaatcttataaaatatgctggtagatttgaacccacagaacagtttccccagaattatccaggaggatatggtacaggcactgtacatggcattttacgacctcaataaaatatcttcctgaaacctgcccttgaggaatgatggcataaattactgtaaaatgaggctttagaggcagaaaccacttatttccttatgtgctactatatgttcagtccttgtcacagtgcctgacagctaataggtatttcaaaaccatataatcaatatgtgtgcttttttaagcagcactttttcatgaagttgcactttaagatatttgtagttttttacggaaatatttctaaaatgaattgttacttttttgctctactcttttattaaactgagtttacctaatttagctagtcccagaggactgttagagattctttctctcctgttagctcttatttcccagttgtatcagctttaaagagccccctttcctgctatcatgttaaatacattgaaaaaaaaaaaaacagaacgtccttatgcgtagcatgggcatctgcatacaatagactatcaatgtcagtatgtatttatataccatcttattccagaaaagaatgacacctgcttaaatgctcaataaaggtattgcagagttaaattaaatgtgattaatcagtttaaacagtgtactacaaatataagtcaatacgttctaagagagcctgactatagaactttcgtcttttttttttttttttttttttttttttttacttattattatactttaagttttagggtacatgtgcacattgtgcagcttagttacatatgtatacatgtgccatgctggtgcgctgcacccactaactcgtcatctagcattaggtatatctcccaatgctgtccctcccccctccccccaccccacaacagtccccagagtgtgatgttcctcttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatataccccgtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgcctagtcagttttcccagcaccatttattaagtagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgactcggtgatgcaggctcttttttggttccatatgaactttaaagtagttttttccaattctgtgaagaaagtcattggtagcttgatggggatggcattgaatctataaattaccttgggcagtatggccattttcacgatattgattgttcctacccatgagcatggaatgttcttccatttgtttgtatcctcttttatttccttgagcagtggattgtagttctcctgcaagaggtccttcacatcccttgtaagttggattcctaggtattttattttctttgaagcaattgtgaatgggagttcactcatgatttggctctctgtttgtctgttgttggtgtataagaatgcttgtgatttttgtacactgattttgtatcctgagactttgctgaagttgcttatcagcttaaggagattttgggctgagacaatggggttttctaggtatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtggatttgtcatagatagctcttattattttgaaatacgtcccatcaatacctaatttattgagagtttttagcatgaagcgttgttgaattttgtcaaaggccttttctgcatctattgagataatcatgtggtttttgtctttggctctgtctttatgctggattacatttattgatttgcgtatattgaaccagccttgcatcccagggatgaagcccacttgatcatggtggataagccttttgatgtgctgctggattcgttttgccagcattttattgaggatttttgcattaatgttcatcaaggatattggtctaaaattctcttttttggttgtgtctctgcccggctttggtatcagagtgatgctggcctcataaaatgagttagggaggattccctctttttctattgattggaatagtttcagaaggaatggtaccagttcttccttgtacctctggtagaattcggctgtgaatccatttggtcctggactctttttggttggtaagctattgattattgccacaatttcagagtctgttattggtctattcagagattcaacttcttcctggtttagtcttgggagggtgtatgtgtcgaggaatttatccatttcttctagattttgtagtttatttgcatagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggacagttctgtagatgtctattaggtccacttggtgcagagctgagttcaattcctgggtatccttgttgactttctgtctcattgatctgtctaatgttgacagtggggtgttaaagtctcccattattaatgtgtggcagtccaagtctctttgtaggtcactcaggacttgctttatgaatctgggtgctccgtgttgggtgcatatatatttaggatagttagctcttcttgttgaattgatccctttaccattatgtaatggccttctttgtctcttttgatttttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagttacttcctagtctcgatggtctttacattttggcatgattttgcagcagctggtgccggttgttcctttccatgtttagcgcttccttcaggagctcttttagggcaggcctgatggtgacaaaatctctcagcatttgcttgtctgtaaagtattctatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacaatttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcttgcagagtgttttccaacttggttccattctccccatcactttcaggtacaccaatcagacgtagatttggtcttttcacatagtcccatatttcttggaggctttgctcatttctttttattactttttctctaaacttcccttctcgcttcatttcattcatttcatcttccattgctgataccctttcttccagttgatcgcatcggctcctgaggcttctgcattcttcacgtagttctcgagccttggtttgcagctccatcagctcctttaggcacttctctgtattggttattctagttatacattcttctaaattgttttcaaagttttcaacttctttgcctttggtttgaatgtcctcccgtagctcagagtaatttgatcatctgaagccttcttctctcagctcgtcaaagtcattctccatccagttttgttccattgctggtgaggaactgcattcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgctggagtaccctgccgtgtgaggtgtcagtgtgcccctgctggggggtgcctcccagttaggctgctcgggggtcaggggacagggacccacttgaggaggcagtctgcccgttctcagatctccagctgcgtgctgggagaaccactgctctcttcaaagctgtcagacagggacatttaagtctgcagaggttactgctgtctttttgtttgtgccctgcccccagaggtggagcctacagaggcaggcaggcctccttgagctgtggtgggctccacccagttcgagcttcctggctgctctgtttacctaagcacgcctgggcaatggtgggtgcccctcccccagccttgctgcccccttgcagtctgatctcagactgccgtgctagcaatcagggagactccgtgggcgtgggcgtaggactctctgagccaggtgcaggatataatctcgtggtctgccattttttaagcccgtcggaaaagcgcagtattcgggtgggagccacccaattttccaggtgccggctgtcccccctttctttgactaggaaagggaactccctgaccccttgcacttccggagtgaggcaatgcctcaccctgcttcggctggcgcacagtgcacgcacccactgacctgcgcccactgtctggcactccctagtgagatgaacccggtacctcagatggaaatgcagaaatcacctgtcttcggcgtcgctcacgctgggagctgtagaccggagctgttcctattcagccatcttggctcctcccccgactatagaactttcatacagtacatgaacttcataaaaacaatttctctgcttaaaaggctttttctaatttacttcaaggtttcctatcctaatgtagacttaggttagctgtagccttgtaggatttaaagagagaatagattgtaagagatgagttctaaattcagacagattctcaagggcatgattcttatgaatatgtataatgtcaactctagcctatgtggatttctagtcctttgcagtgctaatttagccattattttcaagctctttttctatgaaaccaatttactatgactttttggtaaggcttttataacatttgctaattacaaggtgacatctgcataattattaattatgaagttacatctgcataatgaatattaccaataatttaacttaaatgtttcagttaaaactttaaatgcatggaattaaccagaagtcacaatgagttgctactgtatcagttatagaattgagaaggaaacaattcaagacaaacatagtagtgaatgaaaatttgagctttaacactgcatgaatgagaggaaagatgagtttgatgccacaaagaaaaaggggtcatacgtggtaataacctggtagagagttaagagaaagtctcatcccaaagtatatttcagcatgaagggcttgttaaaatttattctaggaagaatataaaagtgtttgctttattggtaatgttaaagaaatctacactgtgattttctttgagctcagaattcagcctcagatatgagcatcgtttactaggccaggctatgttctaagtatttaaaaattttggaatcttatctgagccactaaattttgagcagattttacagagagtggcatcatttcctagaaaaacagcagcaacaaatgtggggaaaagagggatgtcctcagggttagtgtgtccagggatcaggacaacgctccacagagtcgaggggcattagtacatataattattccagggaagtctctctcagaggccataagaccaatttctatttagtttccttgctgtcatatggaagagattgaagtctgctggcatcaatgaggtaaggactctgccatcataaagtcctgtggattatggaaagcccatgtagaaaataatgggaaataaaggaaacaacaatactgtttaatttgaaaaatagacatatctgtgtctcaagatgtaagaattgacgagtacacaccaagtcgttgttatctacgtggaaaaaaatagtaaatgtatttattattagaggatgtgaagtttggttgtgacaaattaaagactgcacctttttgagatagtcatgtaacattttcagtgactatctcttaaggcattgtgcacaccatactgcttaaaattcaagatccttgtgactgaaagccagttctgattataatagacacaattctcaatgctaagttctaacaaattaaatgtgtccctgaatgtgacagtaaaacttctaagttttattccattttcaaagattagctcagttccacttgtcagctgggacatgctgttagatttgttgttttattgtattgtttaaatgttcagtgggcacaagtttttcataggtaaagaattaatgtgtcatgttatcgtgacacattaattttagatacatcagtctaaaagcatgaaagtttattttgatccagttcaccgcataaaataatcactacccattttcacttcaaagggcatatcttgatatgtatagaaggatagtgttgaaaataattgtgtttatgaaattaataaatctccaaagtagtggtccaaaaaatattttaccccttaggtcatcctactgtcctgtaagttaccaacagtaagtagaattaaatttacatactcttaatattgagatgattgctgaccttgagaataattattttagagaggtagggagaggaagttgtcaattggggtgcattaaggggagagtatgagatgagaacatgaaatgaaagaatacaaacagcaattcgaagaagtttttctctaaataggagcaggaaaatcatgtgggagttgatggtgaggagggatgttggtacaaatagttaccctttcacatgatgaggactatcacaaatatgctgtgggaaaaaaagagtgagaggaaaaaaaatttaaaatatccttgagcaaatcaaagagcatggaatccaagcctaagcagaaggatttgtttcaacaggaagggaccaatggccccatcatgaacgtggaaagtctgaccatcctaggtacatgaggttggtaggtctgatagtgggagatgagatacttctctttcgactggtactattgtctgtgtgaaataatcacttgaataaacaagtcttgacagaaaagagttgaagttttcactttgggttattgttagtctttagagatcatcatattcaacatccctctctgtccaggaatcagatgaatagtgctcagatattttgaacatggccatccagcaatgagcagcttagtttttcaaggacagccctttctgtgtttagacatcactaatttttagaaaaccttttcttactgtactagttctctactgcagctctaacaaattaccacaactgagctgctagaaacaacccaagtgcattatcatacaattctgtaagtcagaagcctaacgtgggttttactgggctaaagtcaaagtttcagtaagttttgtgttcctttttggaggctataggaaagaatccttttccttgtcttttctgatttttaaaggccatgcacattccttggcgcatggccccctttttcatcttcaatgccagcaccattgcatctctctgtgtgtttctgctatggtcatatcttcctctgactgactgcacttagaaaaggttctctgcttttaaggatgcatgtgattagattgagcacttctggataatcaggacatctccccatctcaaggtccacaaccttaatgccatctgcaaaggcctctttttgtcttgtaagattacatattcacagtctacaaggattaggacatggacgtctttggggaacattagtctgcctaccacacttgttttaggtttaaatcttttgcacactgcctcttgacttaccctatcgaattgtgaaacaaaatagagtcattctttccttttccatagaataatcctgtcagatgtttcaatgtaaccttcaggggctcttgtcttttacctcccaaaatttctcctaaacttctgtgcccataagtaaacataagtcatactgacatcattgacatcatatagtctttttatacatatagagaaatgcattcatagataatttgaaagtcacagagtacacagaaactggagtttatttgaatagtgttacagtatatcttagaattatgtcatagtgtccttttcaaaatatgaaaaacaagtttacatgtaaaattatgttgaaaagaaagtgatgaaactgtctttcaagcaagttgattttaatttggttcaatttcacagtccttaattgaacattactggtaccttatgaaacaatctctaccctaatgacctggggctaattgggatgatgggcacaaatggttttattgtattatagtaaatgaaatgatatagtaattataggatgcaataggaaaatagcttcgggcagaagtaaagaactcttcctggaattgtctcctgtgctaaattttagtagatgagaagttaggaaagtgtactgtatggcaagcactttccagacaacagaaatagaagaagtaaaaacactgtgaagcaccaaacattatagagagagtgtatttggtaagtatcaagaagctcatgaatagtactagtagtagctttaaattctgattagcatttactatttatcagctaacttttctaagtgctttattattttaaccttcatagagatcccataaagtagataccataattacctaaattcattagttcagggaactgaggcacaaagaggttaagcaacttgccaacaatgtatagcaaatccaaggtttaaaactctggaagtctgaaatcaaagattctgttacaccatacaagctctcaggatgaccagaatataaagaataaagcaaagagtggtgaatgataaggaatgtcagcaggagtttttgttagagctggaaccttaaccagtggtggaggggctcccttgatggggttaaacagaagagtgtcatggtcaagtcacatgtcactgtggttgtcattgtggttgtggttatgtggagggagtgggaagtgataaaaagagaaacacgctaaaaggtaattcagagacaggggcacttatccaagtaaaatatgacaaaaatatagcagagttagcaaagaaaaaaaaggctgaaaatgataaatatttaggaagtaaaataacaggatgtgatatttgtatacaggagtatgtgatataataaaaatgagataagagataacactcagtactatagtttgacttttgaacttttgtaatttactaagttagagaacacttaataagagcggaaaatacgtttaagttgaacatactgagataaagctgcatgtgagaattccaggctgtgccactaggcggcggcatttgtgcgcctgcattgtgcgaattccgcccaagctttactctctgcatgatttgtcagtgaaattctgaatgtctaaagacctctcattctccacttctgttgtattattagtttctgaccacacgatggagtcatttcttcacatttcctcacactgattttgtttattaagaaaatcaatccagtcaaacactagctggaataaaagacatttaaattttcagaatattcctctaaaaatttaggttctctttgacaaggaacataaaaattaattcagtgagtattcagaaccagcttcagattatttaaaatgaaaattgagattcctgaaaaacattaattaatccaggaatattgattttaaaaattgtttagagacactgaaaaagcataaatatataactacttgagaaactttgttaagtctgaatcaaatttggaattcatttaaagcaggtgattgactgtacacaagtatattgtcaagctgcattctattttgtgtatgatcctgccaagttttaataaatattagtcttcaacctttaatcaataatgttttagaagagagtaacaataaatggtattggtagagcaccttacagtttgctgcgctttcacagccttatttcgtgtgacactgacagaccagtcaattaaacccctattccaaggaaaatgtaaagaactgattctagacaaagaaaaaattagtactattatctcccttcaccttacacatttatactgcctctggtacactcttgctctttaacaatgtatcttcaatttaatatccaaaatctgttacaacgcttttaaattactgcaacaatagaagcatatggttcttaacctttcagggttggattgaatgacctaaaaagggcttctgaagtcttcaacttagcattcgtctttccaggtcaaataatccctcctattttttctcgcagggtgatcagtctttttggaatgatctctctcttagaccatgataattttccagttctttgttcagaatctgggtacctgaaatccctatcccagatgatgtttttatactaaggcatagctgggaggaagcctcaatggaaatactgtcattcttaattttacagtcatctagtgtgcctttcactgctctccagagagaggtcttatcgagtggctaggattccaaattcatggacaattttcagtttttatctcctagggtctctttaatacatacagcatttctttcttcctgcagaagaaagaaacactttcttcctgtgttctcctagatttcttcgtgcatttctggccactctttctcagcttcttttcccctgtctctttcacttctttctctgtattctgttaaataccagatttatttctctagctcagacctattctatgagctgaggtcttatagataaaattgaattattgatgtttttcactttcccaccataatgaatgatatgaccatccattctttcactgttcaaatgagaaatctcacacccgtctgtttcctctctcttctttaatgcccatatttaaattcaatccttcaatgtaccctatcaaatctatttcaaattgtaccccactaaattcatgtctatttccattgtcaaaagttgatccactctaaaattctccatttggaccgttatattagactcctgattgctgtttcgtctttctcttttgccgtctttcaatctattctctggaatctcaaagtaatcttttaaaaatataaatacaactaatgccactcattgtgtaatacctttcaatgacttactgttagatgcagagtacaatcctaactactaaacttgatacagtttggctggtatttttcgctcctcttttcttaagtaactctttcctcttttcattattccatagtcaccaacatttatgcaacttctcagcccatgaatattttcttcctgcattcacacatcttaattttaattagttcttagtttccctggctcttcctcatctttcaagtttcagatttagtaacacctcctcaaaaaggccttcctcactccctatcccattatgatccccaataggcatgattgtgtattttcttcacggtgcttcctaatttgtgaacatttatttgcttgtctatttcccttgttagaatataaattcctttgagggtagacaaacttacttttacctactacattatttaagtcctacagagtaggtgattattaatattcaccaaaagagtaaatgaatatatttttacatcaactcatgttgcagttaaattctgaagaaatcatcacagaaaatggtaagtaaaatcataacattttgttgagaaatatcgggggatagagtgctgatggggaggaccatcacggtagggtgctgctgaaggaaacaccaagtaagaagggtggatagaggggcctagcaggaataacagtagcagtctccatgagcatctacaatctcagattgaaatactgatggaagttattttggaaaataatttttgtttattaaaaccaaaaattgttaatggtaaaaaacaaaaatattaatggtgaaagatcttatttcagatggtctgtccagtaaaaaaaaatgtggaggataatcttttgaaacagataatctaataggcatagatacaaaaaataactgccattatagacatctcaactatctggatgcctgattgactcagcaaaaagcacagcatttaattacacctagaaccttgactcaggattataatacactggaagtggctacagaaaatctaggctgttattgaaattgaatcctctaggtgacttccctagtttttctctgttgtgcatatcaccttctaatatactaggtattttatttatctgactattgactgtcctgccttattgaatgtatgctccaagaaggcagaaacctttgtctattttgttaactttagtatctccttcacctagatagcaggggctcaataaacttttctttaatggacagaaataaaagtgactacaatattgtgctggaaataatgtgaaagtgtgggaaaaatacttccaaaatgcatatattctgagacttagatactacttctgggcattcaccctaggaaaataagtgagcaatacaaatatataaggatattcattgtgacacttctataataatagtgaataagacttaatcctcaataatggcagattcattaaacaaattctggaaattccatggaatgcaaacctaagcaaacaatgaaaatggtacagtggagatgtaaagatatgttacatatattgctcagggtaaattcagctcatatgacagaacagtctgtgtaatatgtataataatatacaatagagcatatatttgtgtgtgtgtatatacacacagtatttcatagactaaagcttgaaaggttatgcactacaatactgaaagtggttttcaagtggaattatgtgtgattattttccccttttgtgtgttttctaattttcctacaatgagtatgcatttttggatgaaaaaccaaaaggatatatggttttctaagagaaactttactccagaaattttataaatgactatgctgacatccaaaaatgttaaatgacatgctaaaggtcatgcagcattttaattttcctttcaaagagcatcaactctgagtaactgagaaaagaaataagggcttgaaactccaagcttaattctgattaccaagagaaaacatcatttaagcaaagggaagtttaggacaatcaggctatatgatttagaattttttccagctaagattagcacaacaaatgacaaaaataatattaaaaacaaagatagactcttaattggaaatggaattcagaatgagtagaaggctctgaaaatggaatatttgacattacaaatgtttcactaattagtaacaggaaagccaccctaaatacagcttggctacctagtgtgctctccaaagaactcttagtgtaactgggacctactagtgtggagggttgagtcataattcaggacaggtacatgaagatagccagggaggccaccaaactttaaaaaacttcaaacaacaacaagaagaaaccctatattcaaccaagaaaaagggaagtatgatgagtcagtttgattgcttagaatatgcatagtttcaaaaggaattttgggtgggtaagtgggaaggatgatgcagtttctccgctgcttccatgtttctcctcaataatgctcatctttaaattaggacgttgaggaaactgaaggcccaaatgttttttggcctcactaaactagaaactgttaaatgaagttgatttgagaaaactaaacaccaaaatatttttgctgacattaccaaactaaaaactgttaaatgacagtggtaatggctgtattccctgtgcccagctcaatggctgttggagagtaggtactccataaacatctgtgaaggagagtagaaatgtgaagattatcagaaaaagcaaaataatttaaccaattcatctgcattttccaaagaatttaaacttggaatgcaagaagaaaaacttgcaaattagattagattttataaaattaaggagatttggagagcatcagaagattgaaacataaacgtttttattatcaggatgcattgcatgaacaacagacaggtgaacctgacactaaaaccaggtaaaaattctagaaggcatatagttattttagaaacatcgtggaagaaaagtgtgatcataaggagattaccaacaagtcccaaaccctatttcatgttttgatagtgtcactaggttgataaattttataaatgcctttataatgtttctgcatttcagcaaggtctttgcctatcttagcaaagtctgtctttcagaaatccctcttattgtccaagaaaagaaatatggactgtatgaaaatggtattagcttagttcatgttgttctcttaaggtgactcccgcccaaaaatcattcagtttattttttgtgggttcatatttgagttctgacttgatcttttaaaagccttttagtgtttggaaattgaagaagtattaatctctgagtgtcactttctcgtttgaaaaacaaaaataccaacaaaactgcttaaggctgtcatgggatgaaagataaattatatgaaaatcttttgaaacctgtgtaacactgctcaaatacatgagtataattatcataattttcaagatagcactgttttcaagatggtagcttcagaaggtaaacagggtcaaaaagacagttttttttttgatatgaagatctgtacataagtgtagactgaggtatagaattcaggatagaggaagactgaaagtactggaaagaaagagggtcaggaacagagtcttgggagaaagtcagtagtagaaactattcattgatttctccaacatccttctttttgatataattgatggcattaggacttacattctgcggattcatatggtcctggaaaaattatacacaaaattatttgtatgatttgaacaactgttacttaaaggtgaagacattttattaatctaaattggcattacttatttatattattaaacaaattccatattattaagcaaattccaaactgctatgttctaaaagcttgtttccaccccacccccctgccaaattcatacgttgaaattgtaactcctaaaatgatattaggaagggcatcctttgggaagtgattaggttatgaggctggaggcctattgaaaggggttagtgtccttataaaatagctcattatcccctcccaccatgcgagaggacagctggaagatgccgtctatgaacaagaaggcaggacctcataagacacagaatctgccagtggcttgacttggacctcccaggctccagaactgtaagaaatagaaataaaataaaatgtttattgtttataagctacccagttgagagtattttgctgtagcagcccaaatgaactaagacacatatcttagacttccatttccatctttaaaatgggaagaaatttttttccaactaaatatttgctatgtttaaagcagatgataatattagaagtccattctagaaactctgagtatttggatataaaagcagtgttgcaccatgtcccattttatttgtatctttgattgtggcaattaacaacctgctttgtcatatcctacaaaaaaataacagttgtcaattgagatatttggttgtgactttatatagacctgtgtgtgtgtgtgtgtgtgtgtgtgtgtgtagttttctttatttttctgtctgaactttacatttagtatattccagtacagtggtgaccttgacttattccggatgagatcagggctaaattctactattttgtaaagtaccccaccaagttttgtagaaagccttataaatatctccaaacaacattattttgaataggaaatgaaggagagcttttcccagaggaatatacagtgttttcatttcagcaacattgaattgccactgcacatagccccatggccttgagtaagtaactgactcaatatgatgctattttgagaacatgactttataatgacttcatgctatgtgtatcatgtttccattcagaatggaatagattcagtttaaatatctatcccacaaatgtttatgatagcaactaactgcaattggctgcatttttttctggccataaaatttgagggtttagccatagatacagatttaccataaactaatttctttactacaattgatagaattgaggttttttttttaatattgcatgcagtttattaaaatgttaagaggctgagtctttagtaaatctccatttaatgtacttttccagtggtatactatgtttgtattattcagaatgtcctggttcagcaatagagtttatagctagatgagattacaggctgataacacccagatagagtttggacagtaggagataactatttatcacatcaggcaaataaaatggaaactggctctccgctacttcctttcccccctgactttaaaaaaaaatttttagctgcacaatttaaaatagaaaaaggctgtcccaataaaaacacatttttgtatttatttgatagtgaattgaaatacagcaacttttaagaaaaaagaagtcctgagtagtttcacgcataaacattccttttggtaaaatgttatttatttttaatttgagagataatagtaacaaatcagacgtgtttaaagcaacaaaatagtaacagtaacaacaaaacattgtaaaagaggctatgagtcaatactaactaaagattaaattacatatgacatttgggaaatgaggaccaaacagcttactttttgtatatatgcaaactgtatgggtcatatcacttctaaattaggaaaaatgtgtatgcctatctctcatgtgtttttactattaagacagaggtattctgccaccatagaaagatccatcaaagtctatgcaatcaaccaaacttagacttgaatccagtcctacttataattgtttggcttgggaaaagatacttaatttttctcaagtcttgacttcacgaaattacaggtttgtaccttaggaaatgttgactgatgttaaaatgatataatgaatataaataacttagtacagttcctgtcaaacaaaatacctcattacttagtaaatgtcataactgtacttataaagatcacagattaaactaagcatcaacctgacagtgttaacttttatattgttagattagattagaatttgtattattaaatttcgtattcatgatctccacatctaaataagagtacacattataacatgctctagtcacacggatttatgtgttgaccctaaacatatctcttcacttatgcttttctttctttcctccctacttttgaccaatatcttttgtctgccaataatactcttcccctgtctttgtgtctgcctttcaaaggcctgtgctctgcatttatgaaaaccccgatgaaccactatattttccatgaagctttttagaaaacacttctaaaataaacctgtccctctctgccattcctacagtatttgtcattttatttaacttctgaagctatttatgaaatattcgtcctattggactgtgagttgctggcatcaaaatacatttactgtactctattttgcattatccatagcttataacacagtctcatgtattcagtacatttattaataagggcttagcagcccttattatatttatatattcaatacatttattaataagggctaagaagtcaggaaatattctaggattaaagtttaaacaatgggaaaaattgataaaagactgaggaagggctggtcagaaagatagaagagaagccatagtatagtgtgtcccagagagaaagagaacttcaaggagttggaggaggtcaacacgctaaattgacaaccactccgatttttcttgaactcattctattgatatccaaatggtggaaaaatgataaactgctatgttcctttaggttgattccacggcatttattgagttgaagcctttaatcctgtaaactacactcaggattctagttctgaccttgaaaagcccacacctagtcacgtagttagggagaacctgctgtttgccagataatggtggtaaaaaaaggtattcaagatagtaatcattctttattcctgccattataaagtgaacgtcctgattgctgagggtgatgaggataactgattgaacatttacagtgcgttaagtagcaggctaagtactttacatattttttttattttattctcacatttctatgagaaggtgttctacaaaaacaaaatggaggcatgaaaaagcgaaacaatattgaattgctacaatatgctggaaaaaggtaaaataagtccaattatcttctgctttacatcccttccaattgtttagaacacctgccatatcttttaagtactgtcttctatagaagaactatttccaggttcatcagccattttttttaatgaaaaagtttccaggctttttgctttctggataaatttatcggaatatggtaatgtggacaaaaacctcttttaaaacatttttggaggtagttttccaagcacaatagaataatcagctttcttactgtagcaacttcagttctactgacattacattcagctttttgataggtacagatactattgagagatttacaaaaaaaaatcataaaaacctctagatattttcatatgaagtgaaattatgtcatcttgcccttggatataaagtattttgaggtaattctttctttagatccaggagatataataaaatgatactgaaagtatagatttagaagggaacttatgtaacatacggctcttagcatggtgcgcagaatggaaatattcaatcaatgtcagcttctcttcctattagctttgtgctctagagatgaggaaactgagctcagctttctcattttcaaccattaacttcatgctttataacacaatatgtgaacttacagtatctttggttttcttaatctgaacataattaaaaccccttggctttttgaacttctggttaatcctaatgtgagactgtcagacaccagtattttggttcttccattctgtcccaatcttgtttatttgacctctttctataatgtaaagtgtcattttccaacaagatttcatatgaaaatcctctattaccacacactttctttagaggctctgctcctttcttacttatcagaattttctaattaccaggatttaattttgtgcatatctacaaaaagccaccttcctttttaacagcactgtctagagccattattcttatatttgctctgaaatgtcttatatctactctcctaaaatgtggaatttatcacccttatcagtgattcctttctggatgatataaattcagaaaagaaacatacttttcccctgttgtttggtaaatacaagcaagttgctttagtatcatagaatagagtaattcttcctgtgagagatggaatgtacgcaggacaagtcaggaaatgaacacattttttataacaataaaagtatccaaaagcaacccgaatagtagctctccccttattacatcttgatactgtcagctgagtgatctgtattaggacaatatcactgtgtcctccatctagctggacagcctataatatactaccacaagaataacaccacactttctcctttcatcatcatccaaatgttactctgcttttttccacctacagattcttggatattttacaagcatttatcttattgacaaacagggctattccacacttacttttagactggtttctttttgatgaagaaaatccttctattgtcataaaaatttattactgggactgatacatatttttcaaatgtgaggagggaaaccatataccagcattaaagcacatctttaaatctgtttatgggtaaaataacagtatcatgtttcttgcagaaaaactccctcatggcttatttctcaccccttcacctaaatggaatagctgtttatgttgatgttctaactattctgctgtggctggtcttcacctatggaagcttagactcagtgtcatatctgaaaactaataacagaaaattagtcaaactaccttcctatcagaaaatatacatacagttatgtagatgcttggtaaaatgttattatactatttaggttcttatccttaatgttccaaaattctgtgagtccgtgattctagcatgtgagagagacaacatatgtttcatttgatgttgcagacattttatctaaacaaaaactattgacttcatcaattcaagttttgtttattctaggacagttttgccctttcaaacctgtgttttcaggtatttaaggaaatgaggagttagatttgaaactattgcagttgttcatagtagaggaagtagtagtagtagtagtaatagtagtgaatgcatccaaggtcaggtgacgtttcctagaagatttttatgcattttctcctgtgctcccatcaggcctgcaagaataaccaaacacaagtccaaccactggctgcttgcagaatccaattaacaagagtgagttatggtagaaagaaagtgactttatttaccaaaactagtaatggggaagtggccagatttacatctaaagtaatcacttcaaagtttaggctggagagaggggctttaaagggggaatttggagtggaaggcatgagggaaaggtactcagtacaaggtctgcatatcttgttctggtggctatttctagctgtggtcctccgggagtgtggactgggattatctcaacaatagctgggttgctgactaactgccttgaggtaatctctggaattttgcagctgggtctccatgcatggtctgtttcaaggttatcccctggaacttctaagtaagctcataattagtacaggcatacggttaaataaatgtgcatggtttaagggagtgtatggtaagaaagagagggatgtggtgcttcaaagaaagtacatttaaaagctagaacaaatagacttaacagatatttacagaacattctacccaaaaactgcagaatatacattctatttatcagcacatgaaactttctccaagatagaccatatgacaggccacaaaacaattctcaataaatttaggaaaattgaaatcatatcaagtactctttcagaccacagtggaattaatttggaaatgaactaccaaaagaaccttcaaaactatgcaaatacatggaaattaaataacctgctcctgaatgttaattgggtcaacaatgaaatctagatggaaattaaaaaattctttgaactgaatgataatagtgacacaacctatcaaaacttctgggacacagcaagtgtggtgctaagagcaaatttcatagccttaaatacctgcatcaaagtctgaaagagcacaaatggacaatctaagctcacacctgaaagaactagagaaagaagaataaaccaaacccaaacccagtggaagaaaagaaataaccaagatcagagaagaaccaaatgaaattgaaacaataaaaaatgcaaaagataaatgaaacaaaaagcttgttctttgaaataaataaataaaattgatagaccattaacaagattaaccaagaaaaaagagaaagccaaataaactcaattagaaacaaagtaggagattaatagcagaaatttgctggagcattatggtgtagggaactaaaaggttctgagaaagtctgtcctcaaccctatgcagtgtacagtggcaataaaatccttagcaaccaagttaaacaatgagcagaataccagttatattgtatatgagagtcttatctgtattaagaagttaactaaactatgttgttatggagtcctgagaaaagacatctataacagaaatacgagtatctaatgcacgcataaatatatatatatatatatatatatatatatatatatatatatatatatattctctcacaatataacccatatatatgtacacacacacacacagacacacacacacacacacacacacacacacacacacagatgggatggagactcaatatttaatgtattatattaggcctcatgagtcaaaaggtctttttaggatataaaggcatgcaaatgtgcactttctgtaaactgggcagaactagtccatggttggtggtcttttctcgggagaaacttactggaattaatattttatttaattaaagctacagttgcttgtgcaataaggggctgtggggcagttaacttattgactgctagagaaaaagaaaaaacatatggcagttagaacatagagaaaaagaaaaaccatatggcagttagaacatagtttattctttaagtgtaggagcctgtgacttacccctgcctggcatggtcttaggtcctgtttataattttgtgttttgttacaacaagccttttctgtcaaccttatgatctccattttaatgttaatgctgatcagttgtgtctaaatcaaaaaaagtgaggaaaggtatagtgaaacttgtctgactcttttcttgctgtcatggcctgaactggttttttaggtttctttgggatttcctttagccaagataaggggtccattcagtctgctgggggacttagaattaatttattttttgtttatattctcccttttttgtcaaagtataccagaggcagtgctgatggccaaccttctattttgtcccatatcaatgctgaggtggtgtgatacctgcccctggtccatcatacaccttggtggaatccttatggccaaggaccttagagtcaaaagaattaaagccaattaaatgctctaagcaagacaggcatgaaggtgggaaggcactcattaatccttaaaacccttttaatcaatataataggcaaaatccagaagccaaaaaataaggtcataaagtggacttatctataaattctgtgcatttagctactgtgatgtgatcttggcttgtagaaattagctgtccaaaacacaaatagtttgttcagctgtttaggcatctgtgtgcccatccctgacttggagggtctgaataaatttgtatagctttgataagccccagctataaatgagagacttaatttaggatttgatcttcaagatgtttgtcaaagatgttaaaaggctcaaaatatattattgcaacagaaacataggtcattgtaaaacaatagttactcatttaacccaagtaataatcaaaagactttaaaggcaatacaggaggttacatagatgtaaaacattaattcttttaaatatcagttttttaaggaattaaaaacctaataaagagtataggaattattttgataaaacctaaaatgttgtctcttaagcgagttatcagaaaggcaaagaaaaacctgcaatgtgactgcttcttatgggaagcccatttacataacctgaaaattaaatctgatgaaaaagtacttgaatttaatcagacatcagaagattgtgttaagattatgagtatagcaggggaatatataattcttagtaactgcataagaagttttctgattacattcaaaaatttagacatatcaagaaaagccaagatgacaaaatcaggttatactggaggaaaacattgcttttctagaccctcgagataaaatgttttcacatcaggccacaacaatagttacaactggaggaaaaaacttacagaagctgatgaaaaagctgaaggaaagagtcacctcaagctttctcaaggagagaaaaagctaaaaacagtgtgacaccacagaagctgaacttctgaggtatgattctgagaagttttcaaaacaggatataaaattaaaaatcaaaatctgaattttattaagagccaattaatatcttaagaaaatctcattataacacaggggaccaatcttataaagaccattataactagttcccttctaattatagtcaactgaattatatacaaaacttcttttataatttttctttcatgaaccttgtcacagcttacatagaccatttatgacatgcttggactttctgacttgtattacattttcctcttttctacataaccagtaattttattttaagacaagaatttatcattcatataaactcttttttcatataaaattattatcttttctttataacctttttatttaaaatatattttatattgataactttctttatatctctctcccctgcttactggtttatttttaccttttttaaataagtaactttaaaataacctccaaattatataaaagtattcttttttaacataagaatacaacttacagaattatatattaactagaattattaattttagtaaccttcaattttagtaaaaatttagggggtaagaaatcctgaactatttgtcagatgttagcattttatagattaagccattccactattttagaaacaattttcctacatcataatattttcttaattgggaatgactgagacatccaaggagcacttattatttaattcaaaataattttaagatttaaaattatacaaaaagtacacttacaagtatttatgtcattaacatgtactcaatttttccatttttaccagttgatctagattacttttgaaaactgtcatattacacaaagctagtcattatttaaagttatttccctgttaaccatttttaaaatctgaacattaggtgaacacctaagtaagaaacttaagcacgtgtgtattttgctgataactcagaagattcagctgtttttattgaaccaacaatcataaattagtcttatttgtaaaaaaaaaaaaaaaaaaaactcatatacacaaagattactctgtttttggctgggtctcacaacctttatgccaaaacattgataccttaaacatttagcaaaggcaaatataaaacttatttatccagacacaaatgtatgcccatgcttccaaaggcattttttaaaattttattaataattatagttagaaactagttttatttatcaaagattcatgtgaatgaaaagcatttggacttaatttatgagtactcatttacttataagccaatttggtagcatactaaatatgaaacagaacataatacatgtatattacataaatacatctaatcgcatgtatacatgtgtgcacaaagatccaatagcttttaccttggaactctagccatgagatagcatcacaaactcattgacttataaaagatagctggctccaagttatttttctgacaaaattggaacctcttcacatagctaaactttgtttgccctgataggtaatccaaggaaagttttgaaccaaaattttaagtaaagcagcctctatggcaatttgtggggtttttttaaacttgagaaaaaaaactcttttaccttttttttccttttcagtttcaaacaagtttccaatgtttacattctagatagaccataagtaatgagtcttagcaccagcagcttagtaacagcagatttaaagcaggtagaaagaaaacaagatagagagctttagaagattccacttaactctctagttacagattcaccatttgagctctgaatttttcttgctttaatttgtctgtcagttcaaaatgggcataaaataggccatactatgtaaccagctggagtcttaaagaggatgacaaactcgggctaagatgttggaagctgtttttccccttcagggctggtgtccctggattgaataagaaaagcgaaaaagaaaggaatggagagaagaaaggaggtcaggttttacagaagagaggatgaaagagaaaggtaggagaagaagcttttgagccacctcaaggttcagggtcagtaccccccaccatcctactttatctcctgtcagagagagcctcagcaccccacacctacatggtatggggtgaatccctctcatctctgcaagtcaccagttaaggtgaactatttccaggtggagggagctaaggatgcttttggcccaaaggagtaaggctgtaggtggctcctgagataatctggagaatgaagttggaagaaggggaaagagagagagtagggcccacacacaaaggtcacacactcacacatacaaacaagtggcatacctccaaaaaatccccaggtaaagggctgggtagattcccaaatgtatcacctcagtttcaaacagtccccccacccccaaaagtcagctgagtctgaaccaaccaaaaccccaagggtaccacaaatacaaacaaatacaaatgcataaaacactcaaatggtatccctagcagccgagtctaaatagagaagagccccagtgacaacctaaaagaggcagaggatagttgagtgcattccaactaactcacttagttccaaagtttgttgacttctccagtggtcactttctttgcaccagagaagcattgaaggcagcaggcactgcagcaggaagagaaagaggatccacaagacaaaagcatcttggcagctgcagagaaattccctaacgttccagccatggggtcagccatgagcagccagcattcacaggcatccctatgccccatcatacagaaattagactggcaggctggagactccggagcacacagcaatccccatatgggccaccaaaattgtaactaaatgcagatctggccacttgctgcttgcagagcccagtaacaagagtgaggtataataaaaactaagtgaatttatttactaaaactaataatggagaagtagccacattcacatccaaagtaaccacttcatacgttagggataggggtttaaaaagaggaacttggaatgggaggcatgtgggaagggtactgagtacgaggtctgtatatcttgtcccagtggctgtttctagccatgatcctcctgaaatgcaggctggcatcatctcagcaatagccagattgatgataacagccttcatgtaatctctggaaacttgcagatgggtctctaggcatggtctgttttaaggctagcacctgggacttctaaataagctgataatgagtaaaagtatacagttagataaatgtgcatggtgtaagggagtgtatggtgagagaggcatgtggtgtttcaaagaaagtatatttcaaggctatagcttaagactaaagaggagaagaaaaggtttccacaatatgcttaagggttacattttgagactagggaaaaaagggaaaagggggaaaagttttaaaatgcacttttaggctagactctttagcctaaaacaatgacattattattcccatttcacaggtaacaaaacaggttaaatttattattcatacacttaacaaatattgaacatcttgtatgagctaggctttattctagaaatttggtattactaattttaaaatggataaaattcctatcctcgtggactgacattctaataagaaacttctcatttattacaagacataagaaattagtaattaaaattatatgttagaacttgatacattctttagaaaaaagaaaaggtagaacagtgtaaggaagatctgactgctggagtgacagcagggaaagtgtagcaatattactcatgtcatgtttctggcttaaattctactttatctgcaacaggattccatccctgccttcctgtgtattatcttgtctgttaaacctttgctcattcctttatgtttagctttttgaatcattgtgttccaagtttgtcttttttttttctttttttcttcttcttattatttttttgagacagagtcttgctctcttgcccgggctggagtgcagtggttcaattttggctcactgcaacctccacctcacaggttcaagcgattcttgtgccccagtctcctgagtagctgggattacgggtatgcaccaccacacccagctaatttttgtatttttaatagagacagtttccccatgatggccagactggtcttgagctcctggcctcaagtgatccacatccctcagcctcccaaaatgctaggattacaggcataagccactgcacctggccaagtttttcctttgtgtatagcatagaattcagttttgctttataagccaaattgaaattttattattattattaaatgaatacatcctaatcacatttaggatgtgactaatatgttgggtctcaattgtcatggtatcttatgttgtaattactgaatatattatttttactgtgttttccccccactatgttgtgtttttgttgttgtttacatcatttaacttgtttatactacattttaacttgtttatactatatatttatactatatttatgaagatttctattccagctctagtggttatttttggtttaatattttatatagtaatcttaatttttctgtttctgttttctccattttaaaatttttacaatctcttctgtcaattttaattggtatctttcaaatcctatctaagacatggacaatagttaatgaaatgattctactttcctttctccttttccatgttttcttttttaagttttatttttgtgagaatatattatgtttacatattattcttttacccaagattaagactttgtagtctcagttctttgtcttaggtctgctagtaaaaatatgaaatacccccagtcctttggtcagacttggttggatgaagctcatcctctagcagattcctttgaaaggacacataagtgtgtgttttgcacattcaaaacttttttctattcctttcacacttcaaggacttagctgatgtcagaatttctaaatttcttgaaacttctgcttcatgttggttttatttttgagaggtctgattgcctgtctattctcatgcttttgtaccttgtcatttcatttcctggagaccctgaggatactttatgtttttttaagtctaatagttttacttgagtatggtttggaattgctcacaccagttcaattttccttaatacatcctttcaagatgcagattcaggtcttcttttgttttctggaaagtttccttgacctatagttttaaatattagttctctttcatggttttggttttcttagtgaaaggctccagatatgcaaatctcggacatcctttacttagcttccatttcaagcatcttctctctgaccctttttcttttatttttttttaaataaaaatgtcatttacattaccctggttgtttttctctttattcaataccctttataaaattgtcatttgaattcatatttttggtcattttgtaacttacttttcaattctgatatttaatttttttatttctttcttgggttcaattgattctcattttatttcttcctgtttttgtcctttgctgctttcagtgtttatctttctaattcagcatactttgaaaaaatttccaaatgctcatttgaggatatttaatttagtttgggggattgtattataggtctcttaagttctttggttggttttatgggaaaaattttcatcagctgaaatgcgtcaattcaatttaagtgatttttcaaaatagttgtgtgtggatgtggtctgattttttttctatggctatactcttcataaattgagagtgcccacttctttcagttcagcccaaatctgtgtaatttcttttatgaatggtgttttgattgcagtgttgtgggcggagggattggagtgttttattcctttttgttttctttgtttctttcctttccaacttcatacatctgacttcccccttccatctactgtcaataactccctgctgttgccacttctggcaccacttactttcgctaaacccagtgttaggaaccaccaagttctgacctgtgttcagcattttggtatttgtattgaactttctcactttgatgatgattttgtttgtgttttatctaattcatctagaatcctactcttttttagttcttaagtttcctctccttctttctccacacccacaggcaatggaaatacttcctagtgctcctggatgtgtgaatcatctgtggttttgtttgttccccttgttggttttatagttttttgggagaaggatcaatggggagattcaagctcaggacgccaaccttgttctccaagcctataggtctttaagatctggaggtgaacagagaagatgttaatgagaaagttatattaaacaaagccttgaaaaggattagaaagttgtgcagtgggatattggatggggatgcatttcaggcagaggaaacagcatgatggtcttgaggtgtaagcatctctggcatgtttgcggaacagaaatgaggggagctggactatggatgtgcaggtgaatatggaaaagaagagtaagatgaaaggtcagagaagtaagagggtgatgtgtatttgtaaggactgaataaacatgcctgaagatagaaattggagaaggtggtattcaaatctatctacatgatttcacaccttgtgttcttttcacaacataatgttgcaattcataaagagattttattaagttaacctataatgaaatataacccagaatatgcagttttggagctcacaaaagaatcttctagtgtgagagaatgataggtctttgtggactcaatttattatctctagtatttacctttcccttgaagagaactgataaaactcctggtgtcatgaagcttacattccatggagggagatacacaagaaacaatatgtaagtaaaagacacagtatgttatggtgatcattattaaacaggaaagaaggataacgagtgctggagagatgttcagaattttaggcaagacagctatgaaagagcttactgaaaaagtgacatttgaatgaaaatcctggaagatgtgagttagtgcaaggtgcttaatcattttgtacctaattttctcatctgtaatttggggaaggattacattaaatggtccatgtcaaagtatttccctatacagtagtaggtaatgggtgctctttgcatagctgtcttttcaatgtccaggtttaaagttagtaccacagaatattgtgttagggactctccagcagagtgtaaatgcttgagcatgtgcgcacatgcgtgcacacacacacacacacgacattgccgcttcattctggcaaagatcattttggtctctgattaaacattccagtatatcacctgtggaggtagactcctgcagacacattaaagcaagttttcattagcaattagaaaacatcagattccacaggtgccacataaatttgccagtttatcttaattcatcaactgctgtcagcatccatggctcaagctccccatcataaacaaaaaatgaggaagaaaagtttatgttttattcattcagtactaatttgcatgtggtttgattagaaagtaaagcaatgcagtcagtagatggtgccagagggttgcttttcactgcaaggctagaattagtttgctgaagataatcttttgtccaatgattctgattccttttccctggccatgctaaacatttttcacacgggtgaactattaacataagaaaaatctaaaactttagagtatatccacattactatgcatggaataaatcattatacatcttattaaaatatttaaatgtataaatttcaaaagaggaaaatatttaattctcatgttttctaatcataaaaaggatgtcttaagcattttgatgaaattattaatatattatttgaatttatattcaatgcattaagttgaattatgaatatgtatgtgtattatttatatatgtatatataaaatttaaataatactataatatcttaacaaaagtgatacagggaacacatggtggttccatctacctatctgagaagattttctcaccaaatcttttggagttgtttcttctggagggaaaatgatagtcttatttatctatcatccctttaagcataacaccacatggtgctcattcatagagtaaatatttgttaaatgaatttctcacagtgatatcttattctcaagacctccctccctttgtgttatttttataaaaagcttattaatcatattcactcatttattaggttcacataaggattgcatatgttgtcaccaaaactcttctataaatcccttcaggttatagaccatgttaatctttaactttctaaaatttatttaaatcttctcccattttttaggttgcctgttcactctgatggtagtttcttttgctgtgcagaagctcttcagtttaattagatcccatttgtcaactttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcgggtttgtcaaggatcagatagttgtagatatgcggcgttatttctgagggctctgttctgttccattgatctatatctctgttttggtaccagtaccatgctgttttggttcctgtagccttgtagtatagtttgaagtcaggtagtgtgatgcctccagctttgttcttttggcttaggattgacttggtgatgtgggctcttttttggttgcatatgaactttaaagtagttttttccaattctgtgacgaaagtcattggtagcttgatggggatggcattgaatctataaattaccttgggcagtatggccattttcatgatattgattcttcctacccatgagcatggaatgttcttccatttctttgtatcctcttttatttcattgagcagtgctttgtagttctccttgaagaggtccttcacatcccttgtaagttggattcctaggtattttattctctttgaagcaattgtgaatgggagttcactcatgatttggctctctgtttttctgttattggtgtataagagtgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgagtaccctttatttccttctcctgcctaattgccctggagaaaatttttgcaacctactcatctgacaaagggctaatatccagaatctacaatgaactcaaacaaatttacaagaaaaaaacaaacaaccccatcaaaaagtaggcgaaagacgtgaaaagacacttctcaaaagaagacatttatgcagccaaaaaacacatgaaaaaatgctcaccatcactggccatcagagaaatgcaaataaaaaccacaatgagataccatctcacaccagttagaatggcaaacattaaaaagtcaggaaacaacaggtgctggagaggatgtggagaaataggagcacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaatgatgagttcgtgtcctttgtagggacgtggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtgggggtagcggggaaggatagctttaggagatatacctaatgctaaatgatgagttaatgggtgcagcacaccagcatggcacatgtatgcatatgtaactaacctgcacattgtgcacatgtaccctaaaacttaaagtataataataataaaattaaaaaaattaaaataaaataaaatttatttagaccaatgcctggcaataaggatagcatgatatgaatgccataactatgaataatacagttaatatagttaataattatactataattaataacttgtatggaaccacaatattaaatttcttatttctaggcacaagcagtgaagataaaatacttatgactaaattcaatcctaattatgagacaaatagggaaatttgctgaaacacagaaatttacttcaacctccaggttttggcagcaattaaatttagagatagaggcaaatgttttccatagaataaacacagcatttgaatttatttgatcttgaaaagtttaaagtgtcaaaaataagtaacagaatacataaatatgtcatttgatatactttacagactttggaattgacaaaagttaaggtgctgatcaaaaattatgacaatttcataaaacgtgttatatgaaaaaaacttaagagaaatagacttttgagagaaagttgaggaaataaagataattattgaattagatttggagcaaagtaggtaatgtattgagccaattgttggaaaggaacaggatgtcagattctgtagataaagcctgtgaaagaaaagagcagatcaattggattaggataatttaaaagagtagaaaaaacgtccaaatatcttgaatctgagaaaatgagaatatttctacaagtctttgcatagtaaagatcttagaatcttttgccagaatcctcacatttttatttgacatgaaaattgaacatattattaaatccaaaggcctaaaatgtctcataaggattccagtcccctgtgattgcacataggaatctcaagtgtaagacactttgctgtcaaatgtgtttctacaagtaggcacagcactggactataattgtaagaggagggtaaaaatataaatctcttcttccaaagaaacttttgttatcaaacttagcattttaaatcaatcagtctgatacctaaaaacttagaaattatctctctattataaggtttgctgttctaatagtaagcgtaatagatactatatttgatgattccatcacttcgattggtatgattttagttaaatgattgcactattatttatgccacaggatgttcagaacccctgatagtctctttgatactcactgagtaatgatagttttatgctgctatggccttagagtaacttcacccaggaaagtattatagcaatcccctttcaataacttttacaacaagtgaacatatttattcctatgtccctatctgtgcttagatcccatttttaaaatggctctttattagacatgtgtgttttttcatctgaataaatccttgtaaacaacagtgagttaggttttataaccccacattatgaatctaaaacaggctgtataatatgtttaagtccataaagggagtaagaggtaaggctatgattcaattcttggtctgcttaccaccaaaacttttgtccaatctgtctctggggcccatgtattctggttgtctgggacagttctgattgttgcctatccggcttagcatttgtcctcttctgaaatgtctcatttggatgataaattttatggtcactctagaccacactaagaaaccaggattatttaatcaagattcagacattgcatcaatgtactggaaaactagaaatatggtttctactttaaatgcttaaagaaaaatagagaacttggacatctattcaagttaatgtctccaggatacttgcataaatctcactgtgtataccagttagtccaatgctaaaaacaacaaacaaacgaatgggttatgaaacttgagagtgcgtaccagagtataatattagaaatttatgcatgctgtacacatgctttctttagaaagaatttgtccctgggtaagattgattaataaaactactcttcttcagctgctttaaattatatgccactttttaaaaaaccaatattcaacaaaataggttatttctagtcaaaagagttctaagaaaatatcaacatatttatctctacataaatatagacaagctgaggatgagggcaaaaagcacctacatggcccatagagctacacatgcaatgcacgtacacacacacacattctggacctcacctcctacctttcttttgctcattctgtttcagccacagtcagtagcttccttgctttcctgaagcatattaagctcccttctctcatagggcctttgcaatttccagtccctctatttggtatacttttccctctcatttcccaatggcttccttccttccttcaggtctttgccaaaatgtcatcttctagtagagatctctgattaattaaatttaaacagcaaaagccccattaccacacatcttacttttccccattcctccataaaacatacctcctgacatacctccataaaacagaccttctaacatacctccataaaacagaccttctaacatacctccataaaacagaccttctaacatacctccataaaataaggtgtgttagaatgtgtaagttctatggagaatattaaagtaaaaatattttaacttttttatcttaatattctctaatataaagtatttttactttaatattctccatagaacttacaccttctaacataccttattttatacttatttatttcacttattctctgtctgccgctctgaaaggtaagcccattgagaacaaggtttgtattttgttttttggtggtggtggtggtttgttttgttttaatttttgtggatacgtagtatatgtatatataaacacacacacacaaatatatatatacacacatagtagatatccacaaaaatatatacatatatgttacatatatatagtgtatatatgtatccacaaaaattaacacaaaagaagccaccatcaccaacatgtacatgtataaaattaaaacaaaacaaaccaccaccaccaacgtatatgtatatctcatgttccatatatatatatatatatatatatatatatatatatatatatatcatgtaccacatataggtatgctacatgagatattttgatacagacatatgatgtgtaataatcacatcagggtaaatgggatatccgtccactcaagcatttatcattttattgtattacaaacaatccaattattctgttacttatttttaaatgtgcaattaattaatgttgactgtagtcatcctgttgtgttaccaaatactagctcttattcattctaactattttctgtacccattaatcatccccacttcctaccaccactgctctttccctgcctctggtaactatccttctactttacatctccaggagttcaattgttttaatatttagctccacaaataagtgaggacatacaacatttatctttctgtgcctggcttatgtcacttaatgtaatgacctcaagttccatctatgttgttgcaaaaacaggatctcatttttatttgtgactaaattgtacttcattgtgtgtatgtaccacattttctttattcattcatctgtttatgggctcttcagctgcttccaaatcttggctattgtgaatagtgctgcagtaaacaagagaatacagctatctcttcgatataccaatttcctttctttttgggtatatatacctagcggtgggattgctggatcatatggtgggggtgggtctattttcagttttttggggaacctccaaactgttcttcatagtggattgttctaatttatattctcaccaacagtgcacgaagttttcctttctgctacatgctcaccaggattcattattgcctagcttttgggtaaaagtcattttgactggagtgagacaatatctcattgtagttttgatttgcatttctctgaagatcagtgatgtggagcacattttcatatgctgtttcccatttgtatgtcttcttttgagaaatgtctattcagatcttttgcccctttttaaatcagattattagggttttttttttgtttttgtcttgttttgttttgttttttgttgttgtttttttgagtcagagtctccctctgttgcccaagctggagtgcagtggtgcaatctcggctcactgtaactgctgccttccaggttcaagtgattctcctgcctcagcctcccaagtaattgagactacaggtgcacatcaccatgcgcagctaattgttgtatttttagtagagacggggttttgccatgttggccaggctggtctcaaactcctgacctcaagtgatccaccagccttggcctcccaatgtgccagaattacagacatgcaccacggccaaggattattagatttttttttcctatggagtcgtttgagctccttatattctgatgataatcccttgtcaaatggattttttgtttcaatttagtggggaagtgtttggggtctttttactgaaatatataccacagtgtctgccatactgtatatcctcaatgaatataacttgacaaatagaatgaaaaaatagattgtgaataagctgaatttcagcttagagatgacaatttgtctcaatcgctggaagtatgtttcagaaattaagagtaggatcccctgaatcagcaaccttgtttagttacttttaagatcttatgcattacggagaaccagcgatggttaataccttatggcatatatctcaccacagctgaaaatgatgctacctactcgaaatgaatttcataatttgcatctttctcacagttacagaaggatatagaaggtaagttcataatcaaagtcagttattttttgtttgttttgttttgtttttatatgcaagaggacatatttgcagtataactgattataaaagtacaagactggtttttaccctgattgagggcacagctcaatttccttttagttataccatgtgtctttgtagagctgattctgcaggccccaagacaagtccctttctcatattattgaggttctcctttgattgacaagtattgatcagcaactcttttggcaaccttgaaaaatagttgtcttcttgaaatagggttttctacttataggaatatgaccagactcacttaaattaatccataaagatggaaatatagagagaaataatatacctgactgattactgactatgagttaggcatactcagtcctcattcacaccttatgagatgagatatttgtattctgattttataacaagaaaaccagagtttcagaatccaggttcatgatgtttggtaaatagtgagcattcacaaagtgttaagtgcctttatttgtttcaccacctcttccaggtccaacattttattatcatacttgaaaagttaatacaaacataccaagttacccaaaattgagtgtagatttcttgataattagagtaattgttaaagttaaagcattatctacctgagataaatatacttgaaatatatataaaatgagaaaaaatatattttaaaatgcattgggtttaagaagccatatgagataaaacaattggctattttcccattaaatatccaaagtagcctggaaattttctattttgtgagattatgattattataattttatagctggaatcatgctaaaacacatgggacaatggaaaaaatgttttatgaggcaaaatgagctcactttaagcagatgattcagattttatataatgataaaaatttatttcaaagcccacattacatgagtataagaaatttcagctgctgacactgtaaagattgttttcattttacttttaaaacagaccaaaattctgtaggcttccacagatctagtgaatagtaacaaatccagaaattgctgttctgttgcagtggcaatttccttttcaaattgcctaataataggtgttggatttttctccatctcctgtaccgtttaaaaaccatccggaactgtgtctggtatgtagtagttgcttgtttagtatttgtccatttatcaaattagttttcttttactaaaaaacaaaggaatgtgctttcaaggtaaaaatttccacaactcaatagaattgcagttaaaagaaagcttctcttccttcccagaatccaagtcttactctcaaccgaaactggttatggttttttagaatatttcttgttggggctgacagaaagcactcatgtgcatacctttctcctcaaacagtgcattagtaaaggggctttctagatatacgttaccaagttcaaagagaataggaaagcatccatctgcagatgaataccttcagtagatttctacaagataaaactttggtggaagaaagtcgagtgaaaaaacaaatcagagaaagaacactctaatagaagtgcaaagaggccacttgaggaagtcttctctaaaactggggggataaatcaagaaagaagatgggagatccaggaaactgtggacctagctctagatgagatgttgcaacagggctacagagctgtcagtcctgattggagtagattccaccaagtcaatcagtgggctggaggagggaggatttcaggagatagttcaccgtttgatatagattgctgtccttttactttgttaagtacacctatgagaaacaaaaatgaaatcctaagcctgccaactgactgaatggattctgtcttggtcaaggggatctcagggaaagcttggaagttgagttcccagcaataacaggatgggaggttggacaccatctcccatgtgcaatgaaagttttcatgtcccttgcttcaccttttgacaccacagggctgaaaactgtatcctcgaattatgctaacccatttttggaacatgggtcccatagagagacatgaaactcaactgcacatgcccacatttctctacttataaatattcatgactcttcctatagtttattgaatatgtgtatttggccagtctattcaacataaatccctgtcatattcttctgaccctcaaaaagtgtgtttctggcttctggatggaggttacacttcctggcctctcagaatggctacgctgcaggctgcaacctttatgaaaagtaaagctctcctttccaaatttatgaaatttatcattcttcagttgatacatctttttaaatttatgaattgtatctccctcttaaaattagaaaggtgtatgcataggaaattgtggataaactctgtagttttagaaacagcagtaagtgtgctgaggaacaactgagtcatcagtactagtgatcccatagaacacggttccaacagtttgtgtaagatgatggatagacagatagcctgagtggaaaactgacaatccagagctgatggtctctctgcttggagatgaagcctcttcgtatatgagcttacacttataaaaagatataaataaggaaaagtgaagtaaaagaaaaacccatgttgatactctgtggctagaatttgtcatatatggtgttgagagaagaggggacgtattgaaagaggaattggggtagggaaaaaggagggaactacatctcagtctcatattaagccaaattctccttttgccttttgtctcagtttgcggctggatatggctgccgtgaaaacacaagggctctctaatagaaaacaaaacaaaacaaaacaaaaaactgaaaggagcattgctaagttgactctgacttgtttccagggaagacagcttactacaagtgggatagatttttcttcagtgctagtggtttcaggctgtataggcataatgtttaatggcatatttccaggttactgaccaaggagctagttagactaaaacagcattgttgcagagtggattctccaggaaacagacactgagatggaaataagattgtagaatgtttattagaaactgtgtagagatcaacaccttttaaaaaggggtgtggggaagcagcatcaggcagagagagaagtggaactgtgatgtggcatcaacaccttaagctgttgatcaacagcttaagctgacccagaggaagttctggagttgatagggtctggctgcggtgttccccattaggccaaatgtgagagagccattgtacccctccctggatcagacatcagatgagggccacccctgaagagtgagcctttggtcaatggaaggcaatcagaaaaggctgtttgataaagaaaggtagcttgttgcagcactaaaagctgctgaggcccgctcttccttaaaggggacctaagcagtttaataataagcttaagatatcagaagaacttgacaaagatgcagcaaatacaagaaaataaaagaaaggctataaaatatgtgatagtggactaggagtaggtggaggctcagggcaaactgctagaaaggaaatatgatcatgtggctttacctagtcacaataatataaatatcatgtattgcttttgccatttatattcaacctgttgaaatttggaagatttgtgactacaaggctataaatgaatgcatatgatccccatattaatcaaaatttaaaattatagataaccgatattttgaagttgaagatgaaaaggagtgaaaaagagtaggattactaatatcattaaaagataaagttagaaatcagtaaatactgtctatatgaataggacaagaaatagaggtttaagtatattattctgatttacaatgattaccaatagggagagaataatagaataacactttgaagaatagtagaagtatctattccacgaatatttggtaggtggttacatttgaagtgatataggcatggcactttacaattttctcaatttattctactacagttggcctgtttggatataataaccctattgaagaaaagatatttgttctaaattttcaaatttatgtacataaagttgagaattgagagttatttgaattttctcaataatgatatatctcatttatattacttttttatttctctttttgtgtcctaattagtttattaagtagtttatgttatcagttctttcacataaccatatgcttgaattgtattagctttactctatttgtaccttctaaatgttgttaatttctgctttaatcttggttaacttttccccctctgtctcattagaggtatttattttgctttttaaatttaataattcatttaatttatattttcctatttcagtgtgtagcatttaagacaataaactttcttacagtgaatcatttcatagagtttatattttatttccatatttcatagattgtggtttttcatgttttttaactattatatttagatattcttcaattttttttgcttttccccagttttaaggttttcaacttaaagataccttttgaggaggattctatttttaaaatttaacttccactttgatattgttatcaaaaagcaagttatatattatgtgtaaatgtagaattcactgaagttatattgagactattgagacttcatatagaacaaattttgaatatattcccaagagaatttgaaaagaaagtttggattctattttcaggatgtagaatttagtatcttaatatacatataaaatgtcttacattattatttttatttgtttattttatttatttatttattttttgagacagagtcttcctctgtcacccaggttgaagtgcagtagtgcaatctcggctcactgcaagctctgcctcccgggttcacgccattctcctgcctcagtctcccgactagctgggactacaggcgccccccaccatgcccggctaattttttgtatttttagtagagacggggtttcaccgtgttagccaggatggtctcgatctcctgacctcatgatcctcccacctcggcctcccaaagtgctgggattacagacaagagccaccgtgcccagcccacattattattaatatatagagggaccataaattattattatttttgccctgtgatataccatagaatacagtaagatatatgagtcaaagtcacccactcctctgataaatcaatttcattctgctatttcattctcttccaattttgctgtataaattttcaataacaaatctttattgttgattatacagtatgtatactactatcttaatgactaggctttcaaatcaaatgtgctttttattattgtaacaatatctccattctttttgattgaatttaatcaatgtttactttctagattctctgaattattttgatataggcatggctttaatttatggcaatagttttttgacatagtttttttttttcgtgctacattttattttatttattttatttattttttttattatactttaagttttagggtacatgtgcacattgtgcaggttagttacatgtgtatacatgtgccatgctggtgcgctgcacctactaactcgtcatctagcagttttctttcattacatatattttttgataaggaagctccacctaagtgtatggttatttatttcttcttcttgcctcttttcttcccagataaagtggcctggcagtgtagaaggaattatgcaaaaccccttttcacatttctttgagctggagccagctctgcttagtcatagtcacatttttgttactgtttttttttttttccttgtggtcccatacttcttatagttgtccagatttaaggtagcttttctcataatctttaaagacctccaaatttagttctcacagaaaaataaagtcaatacataaaaaagtttgaaagctattcaacgtgtgacctcttttctagctcccttaatattcattcaatttctttgcctcttaaatatgctcatgtctcaatctttaaagtatttcagtggactcttacggctctcaggataatgctgaaactctttcacctggcttatcatgggcttcatggaaggaatgtgctttcatttcctaccttgcttctgaaaacttcccttcttgcactctaccacacattcacactaatatatgctttaggtccttgatcagtttatagatcttatttggatctgtatttgaacaacatataaagaaaaatattttgagaataatcaaggtaatttaataatgattttatgaaattaagacatcattttaatgtttttagatgtgatataatattttgattttgtttaaacaaagaaatcttattctttacatacacatgatgagaggcttatgataatgtctgagatttggttcaaaataatccgaggttggaaagtaggtgaaacaaggctgtctgagcttataattgtttaaactggatgttgaacacgtggtaatcattataccaatctcttgacttttgtatatatttgaaacttttcaaaattaaaaaataacctttttggatcaaattatggaaatgtattttaatatagttttagatcatatataggcatccacaattaatctattactacatatttatataaaatagtataaaaatgcatatataatttttatttatttactttttggattttgaacttttaagttcagggatacatgtgcaggatatgcaggtttgttacatagttaaacgtgtgccatggtgattagctgcacagatcatcccatcacctacagattaagcacagcatccactagctattcttattaatgctctccctcctcccacccctcaacaggctcaagtgtgggttactctcctccctgagtccatgtgttttcattgtacagctcccactaataagtgagaatatgtggtgtttggttttctgttcctgtgttagtttgccaaggataatggattccagctccatccatgtccctgcaaaggacatgagcttgttcttttttatggctgcatactattccatggtatatatgtactatattttctttatccagtctataatcggtgggcattttggttgattccatgactttactattgtgaaaagtgctgcagtgaacatacgtgtgcatgtatctttataatagaatgatgtatattcctttatgtatatacccagtaatgagattgctggagggaatgctgcctctaggtctttgaggaattgccacactgtcttccacaatggttgaactaatttacactcccaccaacaaaagtgttcctttttctccacaacctcaccagcatctgttgctttttggctttttaataatagccattctgactggtgtgtgatggtatttcactgtggctttatttgcatttctgtaatcatcagtgacattgagctttttttcatgtttgttggctgcatgcatgtcttcttttgagaagtgtctgttcatgtcctttgcccactttttaatggggttgtttttttaattgtaaaattgtttatgttccttgtagacactggatattagacctttgtctgatgggtagattgcaaaaatggtctcccattctctaggctgtccattcactctgatgatagtttcctttgctgtgcagagctctttagtttaattagctcccatttttcaatttttgcttttgttgcaattgcttttggcatcttcatcatgaaatctttgctgtgcctatgtcctgaatgctactgcataggttttcttctggggattttatagtttggggttttacatttaggtctttcatccatcctgaattgattttcgtgtatggtgtaaggaaggggtccagtttcaatcttctgcatatgcctagtcagttatcttagcaccatttattaaatagagaatcctttccccattgcttgttttggtcaggtttgtcaaagatcagatggttgtaggtgtgtggacttatttctgggttctctattatgttccattggtctttgtgtctttgtaccagcaccatgctgctttggttactctagccccatagcatagtttgaagtcaggtagcgtgagtgtgatgcctctagattttttttttttttttttttttttcgctttggattgccttgactattcaggttcttttttggttccgtatgaattttaaaataggttttttctagttctgtgaagaatatcagtggtagtttagtgagaatagcattgaatttataaattcccttggacagtatgactattttcatgatattgattcttcctatccatgagcatggaatgtgtttccatttgtttgtgtgatctctgatgtcttttaggtttgtggttctccttgtagagatatttcacttccctgcttagctgtattcctaggtattttattatttttgtggcaattgtgaatgtgagtttattcctgattaggctcttggcttgacagttgttggtgtatctggatgctagtgatttttgaatattgattttgtatatgagactttgctgaagttgcttatcagcttaagaagcttttagggtgagatgatggggttttctagatataggatcgtgtcatctacaaacagggatggtttgacttcctctctttctacttgaatgcctttatttctttctctcgcctgattcccctggccagaacttccaatactatgttgaataaaagtggtgaaagaagacatccttgtcttttgccagttttcaaggggaatgcttccagcttttgcctgttgagcatgatattggttgtgggtttgtcatatatgactcttattattttgaggtatgttccttcaatacctagtttactaagagtttttaacatgaagggatgttgaattttattgaaggctttttctgcatctattgagataatcatgttgtttttgtctttagtcctgtttatgtgatgagtcacttttatttatttgtgtatgttgaaccaaccttgcatgaagtctctttgattgcggtggttaagctttttgatgtgtggctggatttggtttgccagtattttgttgaggatttttgcattgatcttcatcaacaatattggcctgaagttttctttttttgttgtatctctaccaggctttttttaatcaggatgattctggcctcatagaatgagttagggaagagtccctccttttcaattttttggaataatttcagtaggaattgtaccagctcttctttgtaactctagtagtatttgtctggtcctgtgctgtttttttatttatagctgcttattactgcacaatttcagaactcattattggtctagtcagggattcaatttcttcctgcttcagtcttgggagggtgtatgtgtccaggaatttatccatttcttctagattttctagtttatgtgcatagaggtgtttatagtattctctaatggttgtttgtatttctgtggcattagtcgtgatatccccttatcatttctgattgtgtttatttgaatcttctcttttttcttctttattagctagctagaagtctattttattaatttttttcaaaatccaactcctggagaaatacggaacacttcacaaatttgcatgtaatccttgtgcaggggccatgctactcttctctgtatcacttcagttttagtatatgtgctgctaaagcaagcacaaacacaagtcttgactaagccatctaaactatttttcatctctcttatatcataatataaaagatcatagtaaaaaaaatctgtcaacaaagaataaaagacaatactagaccacgtgtttattttatcttgtattttctggatatagattggtcttatcacatagagaactaacagttcccctaatggttcgggtattgatatgcttttagatctgtatatgttttgtcagtaaaacaaagataacagctctttgattctgccaaccaaggttggctctattcttgcatgaagagtcagctttaagtatatttctaaccaccataacatatttttcattgctctgaaatactagcctattttgctcgttattggcttcatgacctgagtcttttacttctgagaccatagtgaagatgctctattgaaaaagggccttcatatttattcatgtgaacaaaatatacatacgaaaatgagtacgcatgtgcacacacatgtatacaggcacacacacaaagataaatatttaacagtgaaccaggctctgcactagaatctgcaggtataacaaagaactctgtacttatgggaggttaaagtttgagagacatgtggaatggaaaggcattgaaaatgatacagagcaatttatcctggccccgcatttgtgccaactgaggagttacaaaaaatactgtttctgggttccactcaaaatcaaataaatcaaaatgtctggttatgggaccaaccgtatgtattttaaaaattttcccaggaggcactaatgtgtaacaaatactgaaaatactcataaagagcacctttatctgagatcaaatgaaatcgtttctgtgccacctttcttccactgcagtcctcttgcttcatactcccagatttagcaagaagaaaatgaattataacattgggataaagggccagttgatggtgcttggagtttattcatgtatttattctgcaaacattcagtgagcacctattatgagctgtgtgctgggcactctggtggtagttgctaatacaaaattaacaagacattgtttctgctatatcaattaggaaagacaagtaagtaatctgtgattacattcctgaatgagaagtgcaacattgtgagggtaaatttaagttaagtaaaagtgtgaaacctggacatgggtttttaaaacaaaaggaagaagttcctttttctcttttctgttttgccatttaattcatttgcagaagaaaacaggtaatttgaccatggattttttgcttattttgaccttctgtttatttttactttttttttctccttgcctcttgtatttcctgtaaactgttagctaaatctagagacttgttcatattcaggttcgagtatgggctggaatacttcatcagtaatgttgagtacttccatcaagagacccatgctacctgttttaagtgtctttttggattttatggaccattattttcattccctaaatccagtattttgtcaagaactttaagtggttattttcttttactccttcttagtatatttgccataattttctatgaagagaaactttctctgattgactagttatgctgcagtacagtgggtataggaaaatcaagataaaggcttgcttctttatcagttttcaaaatgatgagttggtacttgaatatcagttaaagtagactgctgaaggatttttcctgttatcattatgaactaatgtttttaaaaattaatctcctcagtccattacattttttttccctgaataatcccaactttggtcaatgacagccacttcagattggctccagagaactttagacttgaccccggtcatcattgataacttccttgtttctggtatgataaaatgtaaccaacatatcttataccattcctgatctacactgagaaccagtcagcccaacaagtaacttagtgggtgttggtgtttagggactcaatctgaaaacttacctggagttatataacctagggaggatggcagtgcttttctgagaatgagcaagaaaatgggcattccacataggctgaggagtgcatggtggtgtgcaggaaaatcatgccatagagacaacagccttttaaaattctttttccttactatttttaatcctctaaggcatatgtttgcaggctctttctccatggcttacctcctttgatgatgaaaaggtgtgtgataatagcaggcaatcgttttataaattaccacttcatttcatggggttctgtgtctgtcaaggtatatgacaatcaggaaatgcttactgaatagtcactatgctagctttaagggattcaaacaggattaaaaccttatttcacgttgtccttcaggttatttcaatagagtgatgaatgctattgttggagcccagaacaagaaagtaataaattctgcctgagtgaaaaagagaagcagtcatgcagtgagttttcataaaggtcttaaaggaataaaactttggtgtgtgtgtacgtatgtaacaggggatagggagttggggcattatttaaaacagaacagctgtaataaagacaaagacacagtgatttaaaagtggaaaggtagtagatccaggtggttagagtatagagtgcctgggtggaagttccaacattatgctgagaagacactttcagtcagtttgttggtgtagcaaggtcacttataaagttattatctaaacttgaataatcacagttggcattaaatagagaggcatatattatgagacactgtacaaatagaacagtcattctggtgagtggatgtgaggaaagatttaaatatgacaacataattttgttatgatgactgttattagagcttggatgataatggagtgagaccaaagtagggtagttagagctcagaaatagccagacaagacagagaaggatattaaaggatttttttaaaaatcacaaaacataaagaaatcaaaaagtagacaatcaagtatccaagaaatttactggtaaatgtcagataattggcaggaaagctattgaggttaaatgttcaacaacacatccatccatccatccatccatccatccatccatccatccatccatttattcattcattcgtaatcatttactcaatgattatcaaggcctattatgttcatgtgtcttgcaagaaacacatagaaaaataaaacttggtcccaccctttgaaatggtgtaatacagtaatagataactgagattcacagccacaactttcagtctagtgttggttttgtcagatcacccctggacagtccatctcactgggtacactttgactctgtatgttaaaccaaagtaattcggcagtcatcccttttcactaaatgttgacactaggtgatcatgaatagtctctgggcttgggcagggccatttgggaattaccattttggaacacccatgtgcttctgagcatttttttttaatttcaacttttattttagatagagggggtacccgtgcaggtttgttacatgggtatattgcatccaggtagtgagcatagtccccagtagttagttattcagcccacatcttctccctcccccctccccccccccccactctattagttcacagtgtctgttgttcccatctttatgtccatgtgtgctcagtgtttaattcccacttataagtgagagcatgtgatatttggtattctgttcctgcattaatttgcttaagattctggagctgagcatgctgttgatcaagtctgtccacatcaaatgtcaaggattcaaaacaccctatcatataagatggccattcactttttacagtccagacctcaagtcagtggtgtacttccattactaatggagaaggtgtgtcccaactcctgccctagattcataccatagctaagtaaatgaaaaattctcaaaaaattatctacttattaaaataagcataacttattttctgtcaaacaccaagtattttgcatctgtttgtaaatagagcagtttgcaaactacaagtgcgcatttcaaccgattcctagtcttttcactctctctttatgttcatctttcttaatatagtctcaaaacacccccaaggggattggtgctgattcttgcttattttatatcaaaattcttgagagcttgttcctctgaaacagggctctttttttccttcattttaaggcatcttctctgactatttcctgctgaaaaaaaaaaactaataataacctcccacctcttgcactaatttcccactgataatgggatcctggtcatggactttctgcctaagatcacttttaatattttttccctaaaaatacagatgaaggacttcaaagctcttttgttgttttttatacttttcccacttgaggagttacacaactcttgctgctggacattcaactcatattgaacacaatacttgtacacaaattagcaatttctgttgactatcccttgagaaagagaaatgtcagacatctgatctcccccaaacaaagtgatgattataaaaattatgtaaaaaatttcacaatgccttacaccaatgtattatgtacttcttcacatggctatgaagaaatacccaaggctgtgtaatttataaagaaaaagaggtttaatggactcatatttccacatagctgggaaggcctcacaatcatggtggaaggtgaaggaggagcaaagctatgttttacatggcagcaggcaagagtgtgtgtgcaggggaactgccctttataaaaccaccagatcttgtgagcgttaatcactatcatgagaacagcatgggaaagcccacccccatgattcaattgcctcccaccaggtccttctgaagacacattagggattatgggagctataattcaagatgagatttgggtgaggacagagccaaatcatatcattctgcctctggcccctatcaaatgtcatatcctcacatttcaaaacgaatcatgccttcccaacagtcacccgaagtcttaactcatttcatcattaactcaaagtcccacagttcaaagtctcatctgagacaaggccagtcccttctgtttagagcctgtaaaatcaaaagcaagttagttacttcctatatacaatgggggtacaggcattgggtaaatacacctgttccaaatgggagaaactggccaaaacgaagggtctataggccctatgcaagtccaaaatccagcagggcagtcaaatcttaaagctccaaaatgatatcctttgacaccatgtctcacatccaggtcatgctgatgcaagaggtgggctcccacagtcttggccagctctgtctctgtggctttgcgggatacagccctccctgctggctgctgtaataggctggcattgagtgtctgtgtcttttccaggtacacagtgtaaactgttggtggatctaccattctggggtctggaggatgggggccctcttcttgcagctccactaggcagtgccccagtggggactgtgggcgtagggagctctaaccccacatttgccttccacactgccctgtcagaggttctcaatgagggccccatccctgcagcaaacttctgcctgaacatccacgtgtttccatacatcctctgaaatctaggcagaggctcccaaacttcaattcctgacttctgtgcactcacagactcaacaccacatggaagctgccacagcttggggcttccaccctctgaagccctgacctgagctgtaccttggcacagtttagtcaaggctggagcagctgggacacagggcaccaagtaccaaggctacacacagcagtgggggcctgggcccagcccacgaaaccattttttccttctaggcctctgggcctgtgatgggaggggctgctggaaggtctttgacatgccctggaaacattttccccattgtcttggcagttaacatttactcctcattactatgcaaatttatgcagccagcttgattttctcctcagaaaatcagaagatgggtttttcttttctattgcattgtcaggctgcaaattttccaaactgttatgctctgcttcccttttaaacattccaaacattttaaatgttccaaaccatatctttgtgaatgaataaaactaaatgctttaaagagcacccaagtcacatctctaatacttttctgcgtagaaatttcttccaccaaataccctaaatcatctctctcaagttcaaagtttcacagatctctagggcagggtcaaatgctgccagtctcattgctaaagcataacaggagtcacttttactccatttcccaacaagttcctcatctccatcagagaccacctcagcctggactttattgtccatatcattatcagcattttggtcaaagccattcaacaattctctaggaagttccaaactttcccacatcttgtcttatgagccttccaagtttttaggaagttccaaactttcccacattttcctgtcttcttctgagtcctccaactgttccaacctctgcctgttacccagttccaaagtaacttcaacatttttgggtatctttacagcagcaccccattacttcgtactaatttactgtattagtccattttcatattgctatgaagaactacccaagactgggtaatttataaagaaaaagagatttaatggactcacagttccacatgactggggaggtcttataatcatggcagaaggcaaaggaggagcaagggcacatcttacatggtggcaggcaagagaacatgtacaggggaagtgccctttataaaaccttcagatctcatgagacttattcactatcatgagaacagcacaggaaaacctgcccccatgatgcagttacctcccaccaggtccctcccatgacatgtggggattgtgggagctacagttcaagaggagatttgggtgagggcacaaccaaaccatatcaaccaaaaagctccagtttctgtaaatgtgttcatgttattgcactagtcaaatctgcagagaatctacactgtcttccacaaaggctgaactaatttaccctcttaccaacagtgtataagtgttcctttttctccacaaccttgccagcatttgttattttttgactttttaatagtagttattctgactggtgttagatggtatctcattgtgattttgatttgcatttaatgatcagtgatgttaagctttttttcatatgcttggtggccacatgtatgtcttcttttgaaaaatgtctgttcatgttatttgcctactttttaatggggttgtttgttttattgtaaatgtgtttaagttacttgtagatgctgaatattagacctttgtcagatgggtaaactgcaaaaattttctcccattctttaggttgtctgtttactctgttggtagtttcttttgctgtgctgaagctcttcagtttaattaaatctcattttttcaatttttgcttttgttgcaattgctttgggtgtctttgtcatgcaatttttgctcgtacctatatcttgaatgctattgcctaggttgtcttccaggatttttataggtttgggttttacatttacattttacatttaaaatccatcttgagttgatttttgtatatgatgtaaggaaggggtccagttttaatcttctgcatatggctagcctgttatcccagaacaatttattgaatagggaatcctctccccattgctggcttttgtcaggtttgtcaaagatcagataattgtaggtgcacagtcttatttctgggttctctattctgttccattggccctctatgtgtctgttcttccagtaccatgctgctttggttagtctagccctgtagtatactttgaagttgggtagtgcaacgcctccagttttgtttcttttgtttaggattgacttgacaatttaggttcccttttagtttcatatggattttaaaatagttttttctaattctgtgaagaatggcaatggtagtttaatgtgaacagcattgaatctacaaattgctttgggcagtatggctattttcatgatattgatacttcctgtccatgaatatgggattttttttaatttgtgtgatctctgatttctttgagcagtggtttgtagttcactttgtagagatctttcactttcctaattagctgtattcctaagtattttatcctttttgtgacaattgtgaatgggagttcattccttatttggctcttggcttgactgttgttggtgtataagaatgctagtaattttttcacattgattttgtatcctgagactttgctgaagttgcttattagcttaagaagcttttgagctgagatggtggggttttctagatataggaccatgtcttctgcaaacagggatagtttaacttcctctctttgtatttgaatgcctttatttctttctcttgcctgattgccctggccagaacttccaatattatattgaatagaaatggtgagagagggcatccttgtctggtgctagttttcaaggggaatgcttccagcttttgcccatttagtatgatattggctgtgactgccctatctttcaacattactctaaacacagcattcttttgtagttatctctggctcttcctactccttccaaaggccaagatgtacactctggatgattacacagtactttaaaagtacttcaaaggtaattctttttatcattatctcatcaaggctgtataatccaggtggacaggaccatttgtcttttattcttagcatatttttagcatatggagaatactcaataaaatttgataaaatttcctttttagctcttagtgcagtcattacttgcttactaggttattacgcatgaaatccaagattacagaacacttagaagaaggtacatttcttatatttttgaaaccaaattgtatacaaagtaagcacagtttgagttaaagttgtttcttggatttattcttacttatgtttatttaaaatttgattataagaagatatatgccaatagtgcagatgtaaaaaaaaaaaaggaagacttaaaatttactgctatctactgttaagtagctctgagttcttaaaaatgtaattatgtttgtaacttgttaaattgaaggtttttaaaccataaaacccataacaaataagatttatcgtatttccaattccatgctgtttgagaaatacatttttttctgaaggcttagcaaataaatatttaagttgaatataaacttgaatttttcactaaacttttaaaatatgcttattaaatgttcttattccttaaattacaatgtaactttggatgacttgggtggttttgagattatttgaagaatctcttttttcaaaagtatgtattaaggtataaccagtccaccaattctgttacttttctactgatgtttttaagaaatttgacttaatagaggcttacaaatggctccttaaataggagataggcgaactgaatggaatagacctaattccccaaatattagtttaaaatttacttcaaaaagataaaaattagtttatacttgaggaatattttcaaaactgaattataaaatgaaattttaggagttgatttttgacttaggtaaccagtatttgatgattttcatgctcatacaaatattatcaaattgaaacatctctttttctctgaaaggccaactttgtttctctgtggaattcctcactgttttatgtgtttggtcacatccaaaaagtttgtctttttgagttcccccttttctgtagatattctccttggcgtttcaccatagtccatagacgttagatcgtcttctccaccatgtatattattcaggtgatgggtgctctaaaagccctgactttacccctatacaatatatgcatgtaacaaaattgcacgtgtactgcgtagatttgtacaaataaaaagggggaaatatattattggtcaccaacaaaaagagcacatgaattggtgaatcttaactaaaaagagaactgcaaggcaattgatgtgttaattagtgtaatgtggcaatcatttcacaattcatgtgtatgtcaaatcattacactgtatatctcgaatatatccaactgttatttgtcaagtatacctcaacaaggctggaaaaaatgggaaaataaataaataaatgaaatgatgagcaataatattttataaatgtccttacatgaaagaatattttctctttggattttttctgatccaagtaattgcaattgcaaaaaccaggaatcactaatgtagagatatggatggccaatttgggttgcttatactatgactatatcagaaatgcagcttattcctttctccaaatagtccctgagattttgcagatgtccatacagcagaaataggtcttagtttgtggcttgcatgcaaatatacaaagcttgattgtaggcataaccccttttttcctatagatagtttatgagaatgttgcaatcaaaaccatgtcctaacattcccagtgtgctcccaaatcccttgtcccagttagcatttagttatgtgagcaaactgatttcacaatgagtccatgagataactgaatctgtctccagaattttagtgtgatcgtgcttaatagcaaatgaccatttaaggtccccacccaatcctaaaacagccttctggatttcaagaagctatataatagctggttatgccatcattaagcctcaattaaatgattattaaggcctttctgtgcttggagttatggggaaacatagaaatgaatgcaaaagttataatcctttcaaaatattttttattgcttgcgcttgattacatattaaaagattttttttttctttttttgagacagagtctcgctttgtcacccaggctggaatgcagtggcctgatctcagctcactgcaacctctgcctcccgggttcaagcaattcttctgctcagcctcccaagtagctaggactacaggcacatgccaccacacctggctaatttttgtatttttagtatggacggggtttcaccatattggccaggctggtctcgaactcccaacctcatgatccactctcttgggcctcccaaagtgctgggattacaggcatgagccaccctgcccgtaatgcactcttgtactttaaaggaagaaatgaagaattaaaggaatgaagaagccaaaagattttatcaaggcagagctatatctattaagccttcaaagctaaacttgtttttcccgagttgtcaatgtcccagataaaataaaatttgatcttgattagccttttattaaatagaccaataaaaagttaaaattattatgtttgtaaaatgtattttgaataacatggttcagatattttcatatagcagtaagtatagattggaaataatataaacagttaaacctggtcattgtactacttataaccttaaaaggaaataaaagtataaatgggaataggaatagattacctactaagaaatgatatgttataatagcaagaataaataatttgcctatttcttaatgatctgaacaaaatgtgtttttcagagattttttgaatcagaaaagtgtacctataacatattctatctaagaatttaaactggtgataaaactggaaatagaaaagaataaagattgcttctaaatagaaaatgcttaaaaccagcagtatttattgatattttgtgcaataaaagaaaatgaaagatgcagttatttcagctgctttctcaggtaaagctgtttttaaagaaaacttcttaaagctatggctaacccagctcccacgtgaaatgactttttttatgacattttcaatgtaccttcaatgcatgtacttctagtctaaattattagcctaggctactttccctttactcacctcagatagcatttttcaagaaataaacttatgtacatcacaagtggaaaataaaaccacgttctatttcttcatttataggaggttgaacttctctggagtgctagagctatagatttttctggatgtgtgcttcagagtgaagtcaagtgatattacttttctcttaaattaccaaccaattgaaaaaaaatccttagttctaaatttcaaattccaccgatatcataagtcatacaaaagcactttgcttttcaccctttattttttaacattgtctatatgggaatggacaactcttgattactacagctaaattgtcagttttatgaattacttcctataaaaatgacctcctttgccctgcaagtatagtttttttgttgtttttttgtttttgtttttgtttttgagatggagtctcactttgtcacccaagctggagtgcagtggcgatatctcagctcactgcaacctccacaccccaggttcaagcgattctcctgcctcagcctcccaggtagctgagattttaggtatgcaccaccacacccggataatttttttcacatttttagtagacacagggtttcaccatgttggccaggctggtttcaaactcctgatctaaaatgatccacccacctcggcctcccaaagtgctaggattacaggcgtgagccactgtgcccagccaagtgtagcgttttttaatgcaaacaagcatatgataaggaatttaaaaggaggctgcaaaaggtcagaaaaattgtacaaacctatttcaacatggagttctttcttgagtctctttattactttcacatttcctgcagaaagctaaaagttcactagcaacagtgcataaaagaaataatagtaaggcggtgtaatcactaaggagctgaagcactggcatctcttaaaatgctggattacctcagtgctgatcagtggaaaatcaaaaaggatgagaaggatgacaaacacttttgagctctgaatgaagaggatactgccttgctgaaaaatcgtggtcagagcacttattctaggcagattaagcaggttgagaatgacattcaacaacttcttaagaaaattaattatctcagtagtgttaaagagtctgacactagcctggccaccaccagcactctgggatttggctgcaaataagcaaatgctccagggtgaacaatgtttacaggttgcaaggtgtagaaagatagtaaatgctgattctgagaactcaaaatacattgtcaatgtggagcagattgctaagtttatggcagacctcagtgatctactgacattgaggcagggatgaaatttgatgtggaagaatgtaagtattaaattcatattcccatactttctaagattgatccaacaattaccatgatgccagtggagtaaaaacctgatgtcatatacagtgatgttgttggctgtagggaacagattgagacattgtaagtagttgaaaccccactacttcatccagagagatttgttaaccttggcatggagcctcccaagagtgtgctctttggtccactaggtgcaagacactctgtgcttaggtggttgctaaataggactgatgcttgcttcattgagttattggatattaacttttacagaaatatatctgcaaaggggctggaatgattcatgagctcttcccaatggccagaacaagaaacgcctgccttatcttctttgatgaaactgatgctattggaagagctcagtttgatgatggtgctggaggtgacaatgaagtacagagaaaaatgtgagaactaattcatcagttggatggctttgaccctcaaggcaatattaagtgctgatggccactaacagacctgatactttggattcagcactgatgaagccagggaaattggatagaaagattgaatttagtttacctgatctagagggtcagactcacatctttattttttttcttttttttaaaattatactttaagttttagggtacatgtgcacaacgtgcaggtttgttacatgtatatacatgtgccatgttggtgtgctgcacccattaactcgtcatttaatattaggtatatctcctaatgctatccctccccactccccccaccccacgacaggccccggtgtgtgatgttcccttcctgtgtccatgtgttctcattgttcaattcccacctatgagtgagaacatgcggtgtttggttttttgtccttgcgatagtttgctgagaatgatggttttcagcttcatccatgtccctacaaaggtcatgaactcatcttttttatggctgcatagtattccatggtatatatgtgccacattttcttaacccagtctatcattgttggacatttggcttggttccaagtctttgctattgtgaatagtgccccaataaacatacgtgtgcatgtgtctttatagcagcatgatttataatcctttgggtatatacccagtaatgggatggctgggtcaaatggtatttctagtactagatccctgaggaatcgccacactgacttccacaatgattgaactagtttacagtcccacaacagtttaaaagtgttcctatttctccacatcctctccagcacctgttgtttcctgactttttaatgactgccattctaactggtgtgagatggtatctcattgtggttttgatttgcatttctctgatggccagtgatgatgggcattttttcatgtgtcttttggctgcataaatgtcttcttttgagaagtgtctgttcatatccttcgcccacttgttgatggggttgtttgttttttttcttgtaaatttgttggagttcattgtagattctggatattagcccttcgtcagatgagtaggttgcaaaaattttctcccattctgtaggttgcttgttcactctgttggtagtttcttttgctgtgcagaagctctttagtttcattagatcccatttgtcaattttggcttttgttgccattgcttttggtgttttagacatgaagtccttgcccattcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccaggaccatttattaaatagggaatcctttccccatttcttgattttgtcaggtttgtcaaagatcagatagttgtagatatgtggcattatttctatgggctctgttctgttccattggtctatatctctgttttggtaccagtaccatggtgttttggttcccgtagccttgtagtatagtttgaagtcaggtagcatgatgtctccagctttgctctttttgcttaggattatcttggcaatgtgggctcattttgcttccatatgaacattaaagtagttttttccaattctgtgaagaaagttattggtagcttgatggggatggcattgaatctataaattaccttgggcagtacagccattttcactgtattcctatccatgagcatggaatgcccttccatttgcttgtgtcctcttttattttgttgagcagtggtttgtagttctcctcgaagaggtccttcacatcccttgtaaattggattcctaggtattttattctctttgaagcaattgtgaatgggagttcactcatgatttgactctctgtctgttattggtgtataggaatgcttgtgatttttgcacattgattttgtatcctaactgtttgccgcagttgcttatcagcttaaggagagtttgggctgagacaatggggttttctaaatgtacaatcatgtcatctgcaaacagggacaatttgacttcctcttttcctaattgaataccctttatttcctttttccgcctgattgccctggccagaacttccaacactatgttgaatcggagtggtgagagagggcatccctgtcttgtgccagttttcaaagggaatgcttacagtttttgcccattcagtatgatattggctgtgggtttgtcatagatagctcttatcattttgagatacgtcccatcaatacctaatttattgagagtttttagcatgaagggctgttggattttgtcaaaggccttttctgcatctattgagatgatcatgtggcttttgtctttggttctgtttatatgctggattacgtttattgatttgtgtgtgttgaaccagccttgcatcccagggatgaagcccacttgatcatggtggataagctttttgatgtgctgctggatttggtttgccattattgtattgaggatttttgcatcaatgttcatcagggttattggtctaaaattctctttttttgttgtgtctctgccaggctttggtatcaggatgatgctggcctcataaaatgagttagggaggattccttctttttctattgattggaatagtttcagaaggaatggtactagcttttccttttacctctggtagaattcggctgcgaatccatctggtcctggacgttttttggttggtaggctattaattattgcctcaatttcagagcctgttattggtctattcagagattcaacttcttcctggtttagtgttgggagagtgtatgtgtcgaggaatttatccatttcttctagattttctagtctatttgtgtagaggtgtttatagtattctctgatggtattttgtatttctgtgggatcagtggtgatatcccctttatcagtttttattgcgtctttttgattcgtctctcttttcttctttattagtcttgctagcggtctatcaattttgttgatcttttcaaaaaaccagctcctggattcattgattttttgatgggtttttttttgtctctatttccttcagttctgctctgaccttagttatttcttgccttctgctagcttttgaatgtgtttgctcttgcttctctagttcttttaattgtgatgttagggtgtcaattttagatctttcctgctttctcctgtgggcatttagtgctataaatttccctctacacactgctttgaatgttttccagagattctggtatgttgtgtctctgttctcattgatttcaaacaccatctttatctctgccttcattttgttatgtacccagtagtcattcaggagcaggtttttcagtttccatgtagttgagtggttttgagtgagtttcttaatcctgagttctagtttgattgcactgtggtctgagagacagtttcttataatttctgttcttttgcatttgctgaggagagctttacttccaagtatgtggtcaattttggaataggtgtggtgtggtgctgaaaagaatgtatattctgttgatttggggtggagagttctgtagatgtctattaggtctgcttggtgcagagctgagttcaattcctggataaccttgttaactttctgtctcgttgatctttctaatgttgacagtggggtgttaaagtctcccattattatagtgtagcagtctaagtctatttgtaggtctctaaggatttgctttatgaatctgggtgctcctgtattgggtgcatataagattcatacttgttcaatggatgttgaaagataccagatttgcatggttagcacaactacatctatacagcactggggctgagattagacgcttttgtgtagaagctaggtttttttgttttgttgttttgtttttggttttggttttggttttggttttgaaactgagtctcacactgtcacccaggctggagtgcagtggcacaatcccggttcactgcaacctccgcctcctgatttcaagcgattctcctgccacatcctcctgagttgctgggattataggcatgtgccaccatgcccagcttattctgtatattaagtagagaccaagtttcactatattagccagactgatctcgaactcccgatcaggaactctcgatccctcaggtgatccacccacctcagcctcccaaagtggtgggattacaggcgttgagccatgcctggctgtagctggtatgtttttgatcagagcatggtaaaaaaatgctactgaggattgcttggaagacgtaaataagatcattaactattatgccaaattcagcactactcactgctaacatgacatgactgagccctgaaggctttcaaatgaaaacacatcttttcattggaatcctaactttgtatggagttgttaataaccacttcacaaaaaagacttcaacattataaaataataatagtaattgtcatttactgaatacgtgatacttgtgccaagttactgtgctgaccatttatgtttatttgataaatatttattgagtacccactatgaattaggatgaggaagatgatcactgccttcaaggagcatataatcaaatataaacagatatgcccaaggcaatgataaggagactcagtgggaattatgaaagcaccgactagcctgaggtaaagctttctggaaaagtttttgattgagctccatattaaagaaattagaagattgcatttgaagatgaagagaaatgacatcctaagcaatgaatttgtgtggacaaaagcattgatgagaaaacactatctgtgttcaaagaactacaaagaagttagtatttgaaaggtcagaactgagaagacctgaggctggaaaggtatgcagaattaaaatcgtgtaagaattggcatgacattttaagatacccaaacttttttctgtaggtgagagaaatcaatcaagactttgaaaggccatacatggcatatatgcataccttacatacatgtcagggtacagtttgtatttatgaagatgtattagttcaggctgccctgtcaaattgtcatagatagggaagtttaagcaacagcaatttattttttgcacagtttaggaggtagagaaatcaatcatccaggggctggcaaagcaagttttacctgaggcctcctctcagctggtaggcagtcgccattttgctgtgtgctcacgtgacttctttgtgggagcaaagagagagcaagctctctggtgtctttccttatgaaggcactaatcctattatgaggattctaccctcatgacctcgtctaactcattacctcccaaaggccccatttccaaatacaatcacattggaggctggggttttgacatgggaatgtattgagacacaaacattgagtccataacaggggagaaggaaagaaacagaagagcagccgtgaggtgaaatcagtgggtttgaatggtcatttgattgattgattgattgattgtagctcagagagaagatacagtctacttttttctctacccattgtaacccatcaactctatgccaccaggtgaggctactgcactagtcttcatcctagttcccttcctgctctttacccaacccccaccatcgtctccactaccagccctcattccaccaccctcctcagcactattcagctcctttctagtacctgattctctcccaatttaggacatttgcacattctagtggagaaaataggtaagtatacaaataaatgcaactcagtatgctaagtactactgaatcacagaagttactaatggtagtatagtcagttctgttataaatatgacatacatgttcctgaaaaattatcacaccatgtagaattacacaatttaaaaaacacagggctaatgatcaaatgggcttggagttcagcattcaaaaattttgtcactgccatatttttaaaaataagaatctaatgaaaatgacaatgtttgtgtgtgtgtgaatagttaagaaacacatacatgatacaataatgtgggtatttttaccataaaatctggtttgcttttggaagtgagtattaaaagggttgcagcttgtgaattattaggaagtaggaggacagtgagctgaaatcagaggaaaggttgtattaggtgcagataggtgtggcttataaaacacccagtgaatggagagagctggtgcatgtttgtggtatgtgtggattagggtacattttgtgtatctccacttagcttggacacagctggtgcagtttttttgcattccccacatgtttctcatggaggaaatcatgcataagtaaccttaatttttttctttttatcaattcctttagaacaaatttactttttcaaaacaggcattatagcaaaactgacaataattgtgccatgaacagttggaaaaattatcacaaaagtggtgaagtaaactgagccttctaacatgaaaagctatatatcagcagaaaagaggaaagggaaccaggccaaggaaacaacatgcatagaggggaccaagtgtgaaagagaacatcatgtttggcaaactgccagcatgttatttagctatattaatacatcatattgtttgtttgtttgtttgtttgttttgagactgggttcagctctgtcgcccaacctggagtgcagtggtgcaatctcagttcactgcaacctccacctcccgggttcaagcaattctcctgcctcagcctcctgagtgtttgggattacaggtgcatgccaccacgcccagctaatttttgtatttttagtagagactgggtttcaccatgttggccaggctggtctcaaactcctgacctcaaatgatcctcccatctcggcctcccaaagtgctgggattttaggcatgaaccaccacacccaaccattacatcataatgtttttaaaagttttatcaaacatattttcatcatcataagtgttgtaattcacttccttttccaacatttgattatttatttcttattccccccaatgacgggaaaaataatttgacttcatttgatgtctaaaaccttcattttatatatgtgcctttctttttgtgtaacccacctaataacatggcaacattgtaaaaatttcaaatactttcactctaactgaattaactttgccttgacattaaatattacaaatagtctttccatgttagaaaatatctttcacatactttgaaataacaaaaatggcaacttcatgaattctaatccaggggtaatcatgttttcattttttgtgttctgatatattacaaacttgatggtttaaattaatgttaattagaatttttaattcagccaaagaaatattgttccttgaggtttaacctattctatttcaaattaacaaaatacaaaatgtattcttatattacatggattcattaaatcaattaatagtcacttattaaatgcctaccatatgcataaaatgatcttagggtctatgagtctatttcatttcatttcatgtcttataatttccaatgttccctcttgttgagtattgtatatctgtactcagaacactcttgatagaagcacatcgaatgggaaaaaatacccgagtgaaaacaacattattatttcactcaactgattaggttaattgatttcctgatagacgtaggccttattccacatggatgatcaaatttattatagtttccgatcctttgagaacactgaaatctaagttttacagtgacttactgctttatatagacaagtatcttgtttagctcagttacttgaaacacaaaaaattgtaataatttaaaaaatgtgttgcataattggcaaaattactgaacctattcaaactacttgtagtacactgaattttttagggttctatgaagtactctacagaagttttctagaaacttcttttattttctgcaaaaattctgtaattttttttgtttggggtattcactctctcactacatcttgaagacagttgtgtcattgaaattgctgagattgttaatgtaatgactgttataatgcaagctctgttaggtaaatcctttgattcttatttttatttctcatgatcccatccacctttttgctcagttcattttttgggcactttacagacagaaataatatgagaaagataatatactcataatcagttaattctactctttttggggataaataaaagaaaaagaatttaaatggacaaatggacactcaaagtatttcatttatttaattcctcccccaattgccattgatgaactaagctacttctcactcctcatagtttttttttttctttagcttaggaacgcatatttgtaatatgaaacaatgctggataagacttgcctttctgtgttaaataatatgtaatattcatcagtatagaatttatttggaagaggccttggaattccataatctagaatgttaggtgacaaaataacaggatacaaataaaggcaaatatgtatccaataagataatttcaaaatatactacaatgttgtagtaatcgaaacagcctgatgctggcataaaaacagatatatagattgaaggaacaaaagagagaacccagaaatacaaccacacatatgtgatcaattaaagtgtcccaagaacacacaatggggaaaggaaaatcacttcgataagtgttgctgggaaaactggacatcttaatgcagcagaagaaaaaaacttgattcttgttttaccctatatacaaaaatcaactcaaaattgattaaagatttaaacataagacctgaaactgtaaaactagtagaaaaaaacatagggaaaaagctttttttacattaatctgggcaatgcttttttactataaccccaaaagcaaaggcaacaagagtaaaagtagaaaaataggattgcatcaaactaagaagctttttcacagcaagggaaacaatcatggagtgaagagtcaacctatgaaatgggagaaaatatttgcaaacaatacatctcaaaatgggttaatatctaaaatacgtaagaaactcaatagcgaacagcaaataatctgattaagaaatggttaaagggatgtcgaaagaatttctcaagagaagacatacaaagggccaacaggtatacgaaaaaaaatttcaacatcgctaactatcaggaaaatgcaaatccaaaccgcaataagatattaactcatacactattagactgactcatacacattggaatgactttttttctttttttttttaaatttattattatactttaagttttagggtacatgtgcacaatgtgcaggttagttacatatgtatacatgtgccatgctggtgcgctgcacccactaactcgtcatctagcattaggtatatctgccaatgctatccctcccccaacccccgaccgcacaacagtccccagagtgtgatgttccccttcctgtgtccatgtgttctcattgttcaattcccacctatgagtaagaatatgcggtgtttggttttttgttcttgcgatagtttactgagaatgatgatttccaatttcatccatgtccctacaaaggtcatgaactcatcatttttatggctgcatagtattccatggggtatatgtgccacattttcttaatccagtctatcattgttggacatttggcttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaagggttgaactagtttacagtcccaccaacagtgtaaaagtgttcctatttctccacatcctctccagcacctgttgtttcctgactttttaatgtttgccattctaactggtgtgagatgatatctcattatggttttgatttgcatttctctgatggccagtgatggtgaggattttttcatgtgctttttggaatgactattttcaaaaagacaaaagatagcaagtgtcatcaagtgtggaaaaaaaacagttttacagttgatgtgaatataaattggtacagccctgatggaacagtattgaggttcctcaaaaaattaaatctggaacagctacatcatccagtaattacactacttgtatattgaaaggaaatgaaatcagtatgtggaaatatcatcactcctctgttcattgcagcattattcacaacatccaagatatgaaatcaacctaagtttccatcagcgaatgaatggataaagaaaatgtggcacatataaatacagtggaatattattgagccttaaaaaatggaggaaatcttgtcttttataaccacatggatgtatttagaggacatgatgctaaattaaataagcgaggcacagaaagacaaatactacatgatctcatttacatgtggaatctaaaaaaatcaaatccataaaagcagataataggatggtagttggcaggggctgaagaatgggagaaattggaagatattggtcaaagagtataaagttgcagttttgcaggatgaataagtttgggagacctaacctacagaatggtggctatagctagtgctgggagagtagaccttaaatggtctcatcacacaaaaatggtaatggatgtgttaagtggcttcattatggtaatcatttcttaatttgtatgtatatcaaaacatatacaattataaattgtaaatatatacaatttttatctgttaattatacttcaataaagctagaaaatttaaaaacaaaaaaatttaaaaataaatttctaaggtaaaggaactattgtttttaataaaattaactgtttctcacatgcatataacatagaaatccatctttaagtcttatagccaaatattaaatattttaaatcagaaaattaaagagaagaaagtggatgataaattctaaagctggattatgaggacccagattttggagatattggtgatatcatccattaattcacattttaaaataaatttatcagtgaagcaaagttatagaaatgtaactatataggtggaaaatgacataactactttcaaatggtggaattgctaattttttatctttgtaagactgatttttgaggttaaaagaaaaagaaatctagcatctccaagcattttatagtaataacattttccaggcaagtcaaagcactgtttgaagaatttccacatgtctggcatttattaaacctaaaagttaaaattactttctttagttttattagactacaaacattttgtattgtttgtcaggataactttatatgggatctagaaatgataaatgggcttgtgatgaactctcctgaaggaaagccaaagggactttggtttctgtcatatataaaatacggcattctggtttacaaggaggttatctttgtccacagatcactcttgagatagaatctagggcactctggccatctctggctatttgcaagtacagattatatttcagttctctaaatgtttttgctggaagaaaatctgtgcactttaatcatagtttattttcatcattaagtagttgaaatgacagtgaattgagaaagattcaaaaacaaagagtaagacttccaaatcattatctgattatattcctaaggagctaagcacagccccatttaattaaagaaagagcaaatgagcaccttctaaaccaaacatgctgggctttcttcctcccccctcccctcatatcttgtatagaagtggtgaggcctatatcagatggattcctggggtgctaggaaagcaatagaagagagtgagtcccctggaggaaagggaggaaagggatattccaggtagatagaaagcacatgcaaaagaagtgatactaaaataactggagtgagaaaatatagtccaactttctcatgtgcatagatacaaaaatcctaaacaagagcaaaatattagcaaatcaaatgcagtgattcatagaaagtataaaatatcatgatcacattgggtttattctagaaatgcagatatggtaaaacatttaaaaatataccaaaatatttcacaataaatgagaaaaaattatacatcagtagatatatttgaccaaattcaatatccaatcatgatttttaaaaaaaactttggaaaatcaaaatagaagggatgtctttaatgtaacaagtttctgaaaatagaaaaacatgcacatgagtaaaatcatgcttagcaatgaattattgaaactttacgccttgaaatgaagagtgagaaaaagatgcacattctcaccacttatatttagtattacactagatgtcatagccactgaagacagaaataaaaaacatccctatttatagacaacttgattgaacatatagaaaaatcaaaaacaatatggactgctcagttagaattagttaagaagttccagaaggtcaatatacaaagtcatttttcattctatgtaccagcaatagcaatcaaacatagaatatgaaattttaaaggggtatcacttagaatagcttttacaattctaatgtttcagcataaatctaatggaaggtgtgtaagaccactaccctgaaacctgcaaaacctgttcatggatttgaagacctaaatatcatttctcacaaattaatctatagatttagtgaaatatctatttctcacaaattaatctgtagatttagtgaaatatctatttcaactatttctggtattcatccttttgctgcagaaactgaaaagctaaaaatgcaaagtatgtagcattattttgcatgtgtatgttgtaacaggtatggcatagttcaggatctggctgtttttctaaatgcttgagtcttgttggttgtagcagtgacagtgatggcagattatctggatgtgtcaatgtaatcacaagaatccttctactggagaggaaggagaatcaaagtaagaaaagggagacatggtaatggatccacgaagtgggatgatgcactaagttgaaggaagaggccatgagccaagggtggtaggtagcctctagaagttagaaaaggcaagcaaacaaattatctcctgaaatcttcataaataacatagcccaaccacaccttattttaaatgtctaacttccaagatcatcagagtaaatttgtgtggttttaaattatcaaatttttggtaatttgttaaagcaacaatagaaaactaatacactcatttgattcataaatatttgtagagcaactaatatatctcggacactggctggctgttggggataaatgtattagcccattctcacactgctaaaaagaagtgcctgagactgagcaatttataaagcaaagaggtttaattgacttacagtttcacatagctggggaggcctcacaaaacttacaatcatgcagaaggggaagcaaacacgtccttcttcacatgatggcaggaagaagaaatgtcaagcaaaaggggaaaagcccattataaaaccaacagatctcatgagaactcactatcacaagaatagcatggaagtaactgccccatgattcaattaccttccactgggtccctcccacaacacatggggattatgggaaaaacaattgaagatgagattttggtggggacatagccaaaccatattaatataatagcaaatgaaaacttgaagaggagagaatatttttagacgcattttatgaggccagcattactctgataccaaagcctgacaaaggcactacaagaagaaaaattacaggctgatattcctgatgaacatagatgtaaaaattctcaacaaaatagaagcaaataaaattcagcaacattttaaaagaatcagtgatcattatcaagtggaatttatccctgggatataagaatcattcaaatatgtaaatcaataaatgtgattcaccgtattaacataatgaaggagaaaaaccatatgatcacctcaaagatgaagaaaaatacatttcacaaaatttaacattctttcatgattaaaaaaaagctctcaacaaattaggtataaaaataatgtacctctacacaataaaggccatatctgaggaacccacagctaacatttaaccaatggtggaaagttgaaagttcttctatgattaggaacaagaaccccactctctccacttctatgcaacatagcactggaagtcctagccaaagcaattgggtaagacaaagaaataaaaggcatccaaattggaaaggaaggagttgaattttctgtttgcagatgacatgatcttatatagagaaatcctaaagactccaccaaaaatctgattcatatcagtccattagaactgataaacaaattcattaaagttgcaggatacaaaatcaacatgccaagatcagtagcattcactaacaaactattgggaaaaaaagattaagaaaacaatctcgtttacatagcatcataaaaaatatattcatgagtaaatttaagcaaggaggtgaaacacctgtataatgagaactatacaacagggatgaaagaaattgtagaagacacaaataagtagaaaaatgcctgtgtttatggattaaaagaattaatattttttaaatgactactcaaagcaatctgtagattcaatgaaatactcaccataattccaatgacattctccacagaaatagaaaaagcaatcctaaaatatgtatggaaccacagaagaccttgaatagccaaggtaatcttgaacaaaaagaacacagctggaagcatcattttacctaactttaaaatatattacaaagctatagtaatcaaagtggcatggtactgtcataaaaacggacacatttgccaataaattattgtcttatgatatgttctaatctaaccagaaacaccggaataggctgtttgttttttgtatatgttgtatttgatatgtgttttgaacatctacatgggtatagccagtaataatagctaacactatacttgtcattattctaagcactttttatgtattaactcatttaattcttgtaacagtcctgtaaatatataatagttgaggaaacatttatagatgagggaactctggtatgaaaatatgaagtataattaacgtcagatattaacaaatatcaagaagaattaggattaaccagaaatgccttgatttggtatttttattataaaagttttcttttttacattttctgaagccatattgattaatcactgtttcttgataatgtgtcaggtctttacacatatgtttcagcagttaatttttatgttgagtaattttttcagctgtcactaacctgttcatgtcatgggcaccaactcacaaacatacatctcagcttacatttttataatatcctctaagacataagtaatttattctgcttctgctgaaaatttccaaaatgtcatgcccagtgatctccatggaattaattcttgtcatatatttattgacatattacagggttttctatcaccactgactgccacttttcaaaactagaaccattatttcaagtgtcagggtactggttacattcattctctttgatataaacagatattttaactggtagttttatagaaatgttatttttgaaaaccttatgaatcacatatctattataagcaaaattttaagattaagatgatggctattttatctttgtccccttgtatcttggacaagtatatacttagtatttgttgcatgaagtaatgaggtatagaattctatttactaattattgtgttcttaatctgagtaatgagaaattgtttgcaccgtgattacaaattggtagcaaacttagcaaaacaaaaaatgtatcaacattatttgttgaacaccaattatgtatcatcatgctgttcttaaatcaacatattccactgaactttctacccctctcagtaattctctcactaatgcttaattattgttacccatgactccattctttaaacactcctaatacagcactcattccctcagcctcagagaagagtggaccagtcattgtcaagggccatttttttcaatacactgtcaaaggaccacaaatctgctatgaacaggatgatgaatcacatgaatgaatatattctgtaagtttgtgatcacttgattagtgtcagtattccccaataaaataaaagctatatgaacaatcatgtctgtttttacttagcattacatcaaccagatgacaaaatttaagtgcacaaagtatattatttaaaagactgaagttaagttcatttaatttaaatgagggatcatatgttaaatcctaaatgttaaaatttaaaaaaaaaaaggttaatcttatccagatgggaacatagctatttatgctactgaaaacacatgtgatcatcaacccaagaaaaaggcaaccataaaaaagaaatttttttcctcatcgaatcaagattaggtagtcacaagctgaaatcttggttccttctttgttatactattttcctacaaacgtttctttaaatggtcttagaagctgggagccaaaggtttttaaaattgaataatcaccttttcacatgctgtatttgtgttcatattttgtgaatcctctaatgattcatttaagtatttactgtgttctccaggtgggctttctatagctttccaaggcatgatttaaaaatattaaaaataatacaagattttgtgtttgccaaactaaagaagttttgaaaataaaatgtgagactctttttttcccaccataatttctgtttctgtatctaaggccgtttaagtaaacatctaaaaacggtttttataatggtaagagaatcatgaatttcatttacatatttactgttcacatactgctgtgctggtaatggcaaatgcagagtttattcaaatagttgtctttgaaacacatataagaggtcaaagaatatccaggtggttctgagccctttagcagacacaaatacacacaaaatgaggtttcgagatggatttctgaaatgcccttgggctatgtaatgctaaattatacctgaaaattcattctattcaactcagcaggctgaagtagctcatcaatgtagtgtaattataactaaataggaacaggaaaggaattaggaggacaggattgctgtgtataatacttttgtagacaggctgaaatgaattctattaatatataatatttatgcaaattttaaattggaaataattagaaattttggagtaaaaatgttgatactattcttagaaacaaaaatatgctgaatatgatccataaattgaaattgatattttttaaagcccataaagaattacttatcatagtattggtctttgtctattttaagcattatatttttaaactatgaataaatcttcttaatgtctagaccaacattttcaaaattgtttggttatgtgtgtgtatgggcacctaattttctgacataatgttatctctttttaattggaaatttgctctgggtcattctaacctacttgattattttccccgaagaacattctccaagtccataatggaccttagattagtgcaaatattatcatttcagtggacttcatgcaccaattaggctttacttgaatatctttagaatcacaatatatgcacctctagaattctttttaacttttaattcaggagtgaaagtgcaggtttgttatacaggtaaacttgtgtcatgggggtttgctgtacagattatttcatcacccaggtattaagcctagtacctattagttattttttctgattttctctcttctcccaccctccaccctccaaaggccctagtgtctgtttttccccgctatgtgtccatatgttctcatcatttagctcccacttacaagggagaacacactgtattctttttctggagtatgaggataggtaagtatcagaatgcattctctattgaaatctcacatatcaaatatattctcccattgtctgacactttaaaagcatgtatatttgccaaaatgacaataactccaataattccaactaaagtaaaatcctaggtagtgttctctattctcaactgttttctgaatttggtttctttgacaattagttttacaacacatgagatagtggtatcatgaactgggtacagtttttgcagctcacaaacgtacacactccagctctgcttctttcttgcaagctctttgaacttggcccttgaacctcggttcccttatctgtaggatgaggactcctacctcgcatcactgctttaaaattaaagcaacataaacaaaatccctcatacaaagcaagcacttaataattgttcatttttatgattccatttagcttctgcaattaattagggaactattttaattaaaatacctcatctatatttaattcattgcttacattataaagctaacattagtgaactctaggggtgatgatgtaaaattataatatagagtcccaatgataataacatatattctttgaagcagaatatgcaagatatcatacagtggagtgcagaatcccagttcatcgtttttttagcatcatgtatttattacctgcctcacaccaagaagaatttgtgccccactaccacatatataaaataaagtagaaatacaatgaattttatatagataaaacacagcagaggaaagaaaccccacagaatagaaagatgaaaccagatgctctagttcagagtccagaaagaagaaagtaagggcaagtttcaggaaagacagacgttgactaagatagaatcagccaggaaaagaggaaggcagaactctgagaagtcagcagtgtgtacaataggatacttgctactttatgtctctgccttcctctacttcacgtgccacgtgccacttgctggtccccaccattgtcctgagtcttctgtgcttggttaagaattttctctagctacaatctggccactgaggaaggacgcatcctgcaaacacctcagaaccgtgttttgctaggaagctttaccactcacaaccctgtggcttttaagataggtaggtacatagatagatagatagatagatagatagatagatagatagatagatagataggataaatagataacagatgaatagatagatagtagatagataagtgtatacatcctattctgtaaactctttcatagtaaaattctatgcataattttcatgatcacagaaactaatatgacttcaaggatgttttaatttctcatcaggattccctataaactcagtactatcccttcatctcaggacacagtggagatgctctgagacaaaagttgtgagctgctgaggaagtattttttataagtaaaagatctctagggagcatggtacagcaattctcccacatcatgcttgtctagtccactcggctgttataataaaatgccatacattgggtggcttataaacaacagaaatttgtttcccagagttctaaaggctgggaaatctaagatcaaagtgctggcagattcagtatcttgtgagggccttctttctggtcaatagaaggcaacttctctttgtgtcctcaggtggaagaggcaagggatctctctggggtctttttaataaaggcactaatcacatttgtgagggttctgctcccatgacctaattacctcccaaaggccccacctttaaatacatcacaggagggattaggtttcaatgcactaattggagaggaacaaaaacatttagaccatagcaatgcacatctccaataaactatataatcacttccatatgtctgtgaggtagtttgttgcagatgatagtaccttttatgtggctatcatccgaaaagagaccttgtacctttttaggttcaggattattttacgttatacctttaaggtaaaatatagccaacatttattaaaaatatattgaagggaggtgaattatttacataggcataagtaatttccttcatacttttaagtataatcgctaggaaattaaagacatttttcaactcttttgtaaccattaaatacttgaacccatccaaaggatatgataaagaagatagaatttcattatccttaaaacactgcaaatttatccaagtataaatgagaaaatcaggcaaccaagaagataaactaagtctggataatcaaatttaggctacaaaaagataaaactcagataaaattgaaaggaaagcatatagagaaagagaagcaacaaaagcaagaatgctaaaaaacaattaccactaaggagatgcagtaaaaataaaatcaattgtaattgtagttataaaggataaacattttaactgtttaatacatgtaagtattaaatatttcagaatcataataattgtaaagatttctttgacattaatgcataggaaactggacaaagtccaaagaaatgaataaaggcttaataataaaacccaattatagtttaaaaaaaatgaaagtctcttccagatacataaaaaaactgaacaaaactaaggagtacagaattgatttgtttgcttatttcacttttagcaacagtcaagaataaagaagcatctttctggaaatcgttatttttccctaatttgaaccaataccacaaatgaaaacttggaccaaacttaagaaagtcttttatttccttcaattcaaaaaagaacaatgataaataaagtaaaatgaggtgttgaatgaaatgacaagatgtttttaatatgatagccgttaaatattttagtaactatttttagattatctacttacaggacagcacttgacttggggcgaatggatgtgggtccagatctccagacagttgtcaagacagcaagtaatttaatatagatgagtgtcaaagatacagatatatatttgtttaattgctgaaaagatgggttggtgattgtgctggggttgaaaattatttggttgttatccttgaaaaaacctgaggaaagtattcatataaagaattcataggaattgtatgaatagggaggtgtttcaaaagaaggaagaatttatctctaagaggagaaaagccagtgttaccacaggggcagctgataagataaggaggaaagggtaagagaagggtcccacccatacatcaggggcgctgggtgatatgaatgacctaggagaaaggttaactgtgagtaactttacatctaaacctgataaacattttctgttcctacctgagaaaggagagttgagatatcacttcctatcactcttggaagccctgattgaagcccctgctgggagtacatggtccaagttgcatgagttcatatacctcatcttccttcagttatcttttcagcaaacttgtaggagctgtctggtctctatcggacatctgtaaatgaagaatttgggcaacagaactttgctgcatcttttcggttttaatatttaattattctagcaattctctgaaacggaaccatcataaaattcaagttaatgatttctatacactctatatacagtgtcttgacaaaatacttagaaggtttatgaaattcaacacgttttaacttgaaaaccagataaagatgtcaatactccgagtgagctaataattcgatacatttgatcttctggaaatatccagttagggtttcatttggaggaaaggatgagggctggaggatcaggaagagagggggtgaggtgactccagtaagacagggtactcacccctgctgcagagctgagaaggcctgttctgtcatcccaagtcagctctggctccaaacttgaatgtccctgccgggaagccagaagccctgcagtcaactggattcacccctcctagaaggtagtttagcacaactagttgttgtggaaacatgtcccttgtggggtgtcatctcctgtttcctgcacaactactcaaagtatcccttcacctcacatggcatgttatgttgaactgtctctggagaaatattagccagattttaatcaggacactatgtctcgccctctgtgacactttattcagacataacctcttagcttcactttactgaagcatcaaataagaatgatgataagaataataaaaatgaaaccaataataacaatacgtacatcataggactgttttcagtgttcaatgaaataatgcatataacatttagaaaagacctcagcacctaatgaacattctctaaattttagctctttttaaatcacacagcattcactccctgtgtcacattctggcaaacatgatgtccttggtttcagtacattactagtgacaccatagagcccttttaggtaagtttcccctagaagctacccagtgcattgccacttaattcagccctaaatcatattggcctagttcctggtaaaatgctctcaacacaactatgtaagtcatgctgtgtccctgaccattacctctacgtgttctcatttggctaaagtttccccattttcaaaattgggatagagatactcaagtaacagaagattatgtgacataatgtatatttagcatagggctagttgcatagtctctctctctctctctctcacacacacacacacacacacacacactcattctttccctttctctcttcctctttccctctccctcctatctcactctcccctctttcttccttttcttcctctctctccttcctttcttctgttattctattactgttaaaaggacagtttatattatacatttatattaaaagtatatatcttataggcttttatttctactgattccttccatcaataaatgaaaggtatagatacaattatttgatttttaatgagaattaatttatcccaatgtatcaatgctcactagatttgcattttaagtgtggagtataaagattcaatttaagtaaaagaaaaacagattgtagggagtagatgaggagaatgtttgttaattaaggcataaaactgattttgcaaacaaaacaactctagcccatttgggattcttgaagagggcaggaagaagagtggggtgcctggacgtgcccttctcttcagcttctctctctgtcccttatgtctatattttttcttcctacttttcggaatgaaggttccccaggttccactttcaccaaggactctgctccccctcagccactgcccctgcctttctctcacctgcctaccctactgcagcatggtgctcatgaagttggcttgtattcaccgggtatatgtaaggtccccaatccctccaagattcaagccactaggcccagatgtgaggttcaggagtagatgctctaaatgcactgaggcgagaaaagtaacataagaaaggattgaggagctggaaattgcctatatggagcctaagaaactcagccctgatataaggtctggaggagaaaggtgggccaaacattgacgagtacaagtctggctgtttgttttagtgtgtatctgtttatatatacatgtggattttaaggtgtataggtgtgatgatcgatgaggctggagggtgggggcttcttgtacatatgaatgaagtgaattgtcacatggtctttccaaaaactgttcagattgatattaattatacataatggagaattaaaagtgtgaaaagtgaaaaactacaaatttgactgtatataatcaaatagtaatgctaatatcaatgacatttgagtcattagtccattactgcctaatcatcaccacgtttattcatatcataaatatataccacctatatactgcctaaaacagaaaaactgttttaattctattgaattgccacagttttcgtgccttgttggtcttatggcattggtgtctaagaaatcagcaaatagcttttataaaggagacattgcttattaaatatggctttgttcctgtgaatttaaaatacatcattagatcttcatacctgtgaatatgtacaatttcatcaaaatctatatactgagaactcacgtaatgagagaatgcattcaaattaacactgggactaaaagatgtgaaatgacaagtattttaattatataaaaaagttactgtagtcaataaacatgaattggctcttgtctaaatttattgaaaaagaatttgtgattgtatggactttatcattgaaacttgtttattaaaatttattcatggccgggcatggtggctcacacctgtaatcccagcactttgggaggccaaggtgggcggatcacctgaggtcaggagttcgagatcagcctggccaacatggcgaaaccctgtctctaccaaaaatataaaaattagctgggcgtggtggcaggcacctgtaatcccagctactcaggaggctgaggcaggagaatcgcttgaacctgggaggcagagtttgcagtgagcctagatcgcacaactgtactccagcctaggtaacagagcgagactctataccaccagccccccaatacacacagacacacacacacacacacacacacacacacacacacaacaactcatttattccacaaatgtttattaagagcctactttgtgccaggcattgatctaacctctggacatacatctctggaaaaaaaatgaagttttatcctcagaaatgtatgttctaataggaagagaaagacagcagtggaatgtacagtaatgcagacactgactatgccctaaagcaagatataaccataggggtctttgacaaacagtcttaccaaagagtttagttcatcaaaagtcaaggacactgaacagaatattgctgaaaacttatagaatattattcttggtatatgtggttacaaaatataattatttaagtaaaaaaaaatcctttacactgaaacaatgcttctatgaagagttatggagatgatatttcccgctactagtaggtagcctggatttgttcacacttaaaaaagaataactttgaacagctgagtatctccacttctgcttcttggcaaaaaggtgaaacttaatacataacaaggaagtcttatgacatagaaatttttcactagcatgtgggtccttctgtattttaaataacaactaatttcagacacccaagtcagcacccaaaggtgtctttgaaaccatgttctcatttggagtgtttgggagaggcagtgttcctgggcttctgctgaatgccaggcattgctctcagaaaaggacagtacaagctataatgaaggcagagcttccaccttgtccacttgagtgacagtgtgaaacatattcagatagggatatgccccaactactgtcaaagtagagaactgaggactaaactgaggccccaggggttgggggtgggggaagcttctggagaggcttcttgcaagcaggagcagagtgcctgctacatagtaggcactcaacaagcctgagaacctattgtgtgcaccttctatgtaaagttctgtggatataaatgtgaaaatgtgcaatttctgttttgcctgagaagtatagactggggaaatagacaaaactaaaattgagaattgctttaataattgaacatacaaagtgtatcagagattctcagaagaaaagaatttagcagagtttcaaaataatatacaaatttcagtattctatagtggttaaaagatatatgaacctaatttttaatttatataaatactaaacaaggtttttatatttagattttcagttttgcaattcttgctaaatatatgaatctattcttaatccaacattgcttcatggacagcagtttagtagtacagatttcattagagaacttaactgctataggatcgggggaggtgaaggaaatacaattttccctagaagatttacattaaacagagtagttacaggctgtagcatctcccctgtaattttatgagaatggtattaccctggctttcactgtgtgattgctggttaccttctgtcagtgagcaacagtcttactgcaaagcaggagcacaacccgtctctttgtctccgtggtcaaatcaattacttcttagaaagtctaatttttttcaaaatgaccatgtacaagagcaaacgcagacatcagagatgtaagtaaaatctgacccaactttttcatatcactggggtagggaaaacatacttgatttcttaaaagactaatcatgacttcttcagatacatcctggtagtagaaaagatactgtagcttttctcaccctaacctttatctttattcctgtaacatgcatgaaagatgttgagggcagaggggataattcgcttgttaccatggaaacccttggaaaggtttacaaaatcaacagagaaacagatcaaatgcaatttcagtctagctcagcatccttcattcaggcatgatcactggacagttctcttttttgcttttctaggagtgatagattttctttcctggaagtctattgaaaggtttgggaagctagcctaaaacttctcgttattcatccaatttcaattacaactcttagggagtagaaagcagttcagaatggaggggagagagttaattgtgaatgacaagctaaatatttaacaggatattcattgccaaacttcttggtccagagcatgctagtgacataattcactacaggcaccatttcaaagggttaaaaggagtcatctgcagtcttccctaaaggaactgattctggctgaaaaggagcagcacaattaccctggcgtaaagtccagaacaaagattattatggaactgaaagctatcaggatcttgctaaaaatcaaaagattgttataacactattttacggtaaagcaatatgcctctcaagaaaagctttacaatcacctctctctagtaagtttaactctttatcactttatcttttctattgtctaaagtaaataataccatatttagcccaaaatggtctgtcactgtctctatttatcgtcatagacaggtaacggcaacttactctgtactcaaagtctgtactttttcattatttcttttgatgtctttaaatgttatcaaatattttgaaaatcaaagtctatcagtcacaattatcctatcaaaaagccaataaatcatataaagataatttttagtgcgataatttattctttggtctgttttcacctaagatctgaaaactaacatttctcctgttcaaagaagtttcatgcaccacagaaagctctgagggctaggctgccagtttgattctgcaagcttgattgccttttgatgccagttctttcttgtgataaagaaacaatatatgataactgctacttttttcaggtaaaaatgattggtgtgaagtctacacatatattgctgattaattttcttgtgatttcctcttacaagaatgaatctaaattatgcatagatttgaaaaccatcttgtgcctttactcctgtatcttttatatatccctcattttttttccttgtggattatcaatgccttaatgcacatggaaaataagagattcacagaaaaattatactgagtgtctccccttaaaatgtgctcactgaagtctgcgattaagcagcaggaagaaattgtgaattacatgagacaagtcagaagatgtataattatacaggcataaacacagtagggtgtactggaatggttcagttaaaaaaactaatgtgttacttaaatttaattgtatcaactattttatgttgcattaagtttttctatattctaataatataaaatatcagagagcaggaacataataaaattaaagtatatagaaagcttagcaataaaagcaaatagaatccttaaatgaatttcttaaactaacaatatttgcaaaagtagaatgtaatacaatggtttgcattccaatgcgtaaacagaaaaactggaattttcccatcaccaaaatccagggcatttccattttcagtcatatcttttatgcgtgggtttttgatcatataaaaggcataaacttacctagaggcaattgtaatccaattaaggcaataattgtacattcaagaaaacctcactgtaggaaagaaggaaagtcttcttacaattttctttaaaaatgagatagtacataaatcaactttctaatttttctcattatccaaagatttaatatggtatcttttagtaaaaataagtgtttcctttcagaggatctgacaaaaggaatagtaaaggtgcatgtggctatgtcaggagtttgaggaaaaaggagagaacaaaaatacttatgagagagattttaaagtacaaattgtactaaacctttgaagattcatgtggggctttgaaattcattctctactcatattgagattagttatttataattcactatacaagaggaggagagggagggaagagtgcccattgccttgcttctgatagtacaattgctaggtaaaaggaacagcttagtgttcactcaaatagcagatcttacttgtgcaaaactgcattaaatactttcaactgtatacagaatattttgagtggtattaaaaaatgtttgcatatatcagatgctgatattgccagagccaaacaggtacagaccaatttaaggaattctaatacatgcaaacctgtttttttaaaattcggattgatttgggaattaatgtttaacttttgagtccatttaaatactaagtttttatacatatataataacaaaatttatttaactgtgaagtttatgtttaaattttcaaaaatttctgtatacaacaaggaaaacctgtaacctcccttgctgaaactccacatgaccttgagaaaacatttttggagttttataaaagacacatgaaggtacatttttaaaaaatgaatatgtttttaaaacactgacgtagaggaaaaagtagagtagaagccataggattttgaaaatagcacaatacctgtgccatggcaaagaaaacagtgtgaatcgagtttcagatatgtaacatttcatcttattttactgaattggaacagatcatgtattttttattcctaataatatctttgggtgagcttatcgaccttatccatattatcatggaaatacttgagatcacttcagaaatctaaatactagtcatcatagccctcttcttatagtcttggccaattatctattatttctgtgggttgcaatctcttctgtaagtttagtagattgcactgagaaagtgttctgtagggtaccttccatctctaaccctcattgcctccataacacaaccctcatcaggtcattcccctactcaaagacattaatggtttctcattgactagataatggtggctctgggcttgtgtgcttcagatccttgggtgcccatggagttactacaaggttactacatattaatatttacataaatatgaatcattgtataatgaagaaaaatatatgtgtatatggacatacacgtgtatatatacataaacatatacatacatatatgcttttaaagttctaaaatatgtttaataaaaacaaatgtatttaaaaggtggtgtactgcatttgtaatagctttttataccatatattttactttaaaaaaaaactatagtacatgcagccctcattatgttttggtattcttttttttaaaaaaaaaacttcatactcccgaaggttgagaatcactgaactagaaagtgagtacaagcaagaccttataatgtagaaatttacatgattgtcatctgcccactactttcttctcttcctggtaccacctatattctaccctttatcaagctaccaattgtcagccaggcgcagtgtctcatgcctgtaatcccagcaatttgggaggccaaggcgggaggattacttgagttcaggagttcaagaccagcctgggcatcatggtgaaaccccatctctactaaaaataccaaaattagctgggcgtggtggcagacacctataatcccagctacatgggaggctgaggcacaataatcgcttgaacccaagaggtggaggttgcagtgagccaagattgcaccactgcactccagcatgagtgacagagctagactccatctcaaaaaaacaaacaaataaacaaaaaagctacgaattgtccttgaaattcactatattctcttatctctatgcctttgcctatttatcttcttgttgatagatggccttcacctgcaccttcacacctctctgttgaaggtttcactcacatgccacatccttcctaaatgcctctccagtttctaagtcaaattgctctttcccttctatcttttcagttcatatatttttgtttgtttgtttgtttgtttgttttgagacagagcctcactctgtcaccaagctggagtgcagcggtacaatctcagctcactgcactgcaaactctgcctccaggttcaagcgattctccttccacagcctcctgagtagctgggattacaggtgcccaccaccatggctggctcatttttgtatttttagtagagatagggtttcaccatgttgcccaggctggtcttgaactcctgacctcaggtgatctgcctgccttggcctcccaaagtgctgggattacagttgtgagccactgcactcggcctcagttcatatattgtaatttttcttaaaatttctatattctgtcttatatatagaaaattatctatttacaccactaatctctaagtttctttcatataaggtattctttattcttgtttgatacattctcagtgcataatatgatgctttgcccatcaaaatccatggctgtctaatgaagtttatcgacttaaatatatatttttgaccacctactactttccagagactgctctaatggtagggctatagcaatgagcaaaacaacattttattgaagataagatgacacacaaataaatatgtaatatgctatgtaatgctaagtgctatggagaaaaataaagcaagtaagggagaaatggagttttggaatgtggagtgaggaatttctattgtctatggggaagtcaggaaaagccacttactaaggggacatttgatcagacaccctaaagaaggaggaaattggttcagtttctctctggatagttacaagtagaaatagcatatgcaaagtccctgaggaacattgggataattgaaggaccaagaaagagtccaataagtagagtgactaaagatgaggtcaaaaaagcatgaggaacattggatagatagagtaggacagacaacagattttaactgaaaagtccatttcatttgtaactgaattaagacataatatgtatatactaacttttagaaatcactatccatatttctaagtgacttgtgcaataatttttaaatgacaagttttaaaagtatttttaaaataatcactctccatacatggcaaggcatgcagtcattgactggaagacaatcaaattttggtcatccagaagtccaaaagatattgtttgaccaggaatattttctgacttatcttcttataaatatccttgtattctttattacaagaattaaaattaagtctacctctctttaaaaatcttcctatgagaaaaagtaaatttacattttgatagaattgttctaaggctttttaaggcattgacagggaaaaacaaggctgttgccagtctcaattgatgtgtaaaattggtctctcagtgatcaacagtgataataggtttgatattttgtaatttttagaatatgacttgtcttagcagtcacatatttattaatgtgttgtgttttatagaagtcttgtttaaaggtacttattgaaattgattacaaattaaatagcaatataaaaatggattatttaaaacaaatacttatgttgataccatgatttctttgtaactgtgaagacagaagaaataatttgttattaattcccaaattacttcatatcttaagtgttgatcttttttgttacctaacgagttgaaaatgtgatctaggttttaaaactttttttaagtttataccagaaaaaacaaactatttttaggcttgattggtaaaggctctctagaggacactattaaattcaatctttgatttctctattattgatgcttgtagggaattctggtatgatatatgcaatgtcttcagccctttttattctcaagttctagtatgaattctataactggtagaaattgagaaattgtaattttatagattcctccatggaatcacatgtgcatggatagaatcagtgcagtctgaatgagcatgcacaatgggactataaatgccagtttgggagcagagacgtacaaaggctgactgataacaccccgatacagattgaccttaaatggaaatgcatattggtctgcctcatatccttaatcacaggcttttacaggctccagcctgtgactggttctgcctgcagaaatatattatctctctctctttctctctctgtgtctctctcagaaaaaaatctgatgatattcatgtatttttctgtttaacaatgccccacacattcaaaggtcacttttgtaccaggtgagcatttgtccatttctctcctgtactttcagaaaacaacttgactatcatatgtcacctgctcttttaatttctcttctaagaatctgtgctgcatttatatctacacttgcataaaaaccgtggcatttactctgtccccaggtgtttaggtaattgttttctgcagagtatactttatcacttcaaaaaatgttacagttaaaaaataatgttaatttgtatctgttgataaaagaattatacatgtgaaacaacaagacacttaggaaaataagattggtgttaaatgaagatattagtctatcattttaacatactgtcatgtggtttgcaaacattttcttccattccatggttgtctcttcactctgttgattatttttctttgctgtgcaaaatctttttagtttgatgcaattctatctgtttttgcttgtattacctgtacttttggggacatatccaaaaagttttggctcaaactaatgtcaagaagcttttcttctatgttttcttctagtagtttcatacttgtaggtctcatatttaattctttagttcattgtatttttgtatatggggtgaaatagagatcaaatttctttcttgtttgtatggatatccagttttccaacaccatttattgaagagactatactttccctattatatgttcttggcactttggtagatcagttgactaaaaatgcttagatttatggctggactttctattctgattaacatattttcaatattaaactcttcatgtatttttaatattaatcataactcaaacagctcaatagcaataaaattaataacttgattgaaaaatggacaaagaatgtgaaaaagtcatatctcaaaagaagacatacaaataatcaacatacatatgaaaaaagttcaaaatcactaatcatcagggaaatacaaattaaaaattaaaaccacaaggatatatcacatcacacctgttagaagaattgttataaaagtgtcagtgagtacataaagtgacaacaagtgtcagtgagtacataaagtaaagggaattattttacactgttggtaggaatgtatattagtacaaccattatggaaaacagtgtgaagtttcctcataaaataaaaatagaactaccaaatgatccagcaatttcatttttgggaatatattcaaagaaaataaaattaattatctcaaagagatatctctacttccatttttatagcagaattactcacaaaagtcaagattggaatcaacataaatgtccatccacagataggataaaatatatgatatatatatatctcatataatatataaatatcatatctcagacatatacatgtttcatatatcatatatatcatatgtaaatgtccatacacagatgaatggattaaaaatatgattatatgagatatatgtatctcatatagatacaacacacacacacatactcacacacacacacacaccccaatggaatactattcaatctataaaaagaaggaaatcctgtcacttatggcaacatggataaacctagaggacattatgctaaatgaataagccaggtacagaaagataaatactgtgtcatctcactaatatttggaatctaaaatagtggaagtcattaacagaagcagagagtagaatgggggttaccagaggttaggtggacaggaagggcaatggaaacatgtttgtcaacagatacaaaattttagttataaaagcaatacgttcaggagatctattgtgcaacatggtgactacagtcataacaatatatcatatgcttgaacattgctaagggagtagattttaaatgttttcacaaaaagacatggtaatggatatgtttcattcattaagttgacttagccactccacaatatgtacatatatgaaaacattatatatatatataatttttattaatcaataaactaaaataaaatactgtcatgaatgcaagcagtttgacatgactaaagaaaagataaccattcataagcatcaatgcagtgtaggaagtagtgttttctatgctctaacatatgccatctttgaaacatcagaaagcaactttcttaaaaaccatgatctgtcataattatgtgttttgggaaatctttttggttgagcaatatgaaatcaccagttttgtaagtcaatggttaaatctaataaataccagctattgcataagtgggcaagaaaaggggagaggtgggtataataagccattatgccagcacaagttggcattaaaagcatagggctgttacagttaaccaagtgtgattatgtaatacactaaaaatatctaattacattagggaatatatgcattgttgctctttaggatatataaggttaaacttcctacaaaaaaaatgaaagtatgttcagtgtcatcaacatagattaactagatgactttattttttcaagtgacatatcagagcttttctagaaagtatctaccttcaactaaacttacaatgtttattataagcatttgaattctaattttacatattttatcattaaaactttgttttcatccaaagggaaaattgagtagttctaaatgaattgggtaatgataataaaattgacaaatatattgaatgtttaccatatgtcaggcactgttttaagcattttgttatagatgactaatgtaatttacataagagagcaataatcaaacatgtaatagaataatgaagtaatttgtgatacttcatttttattataatttcaaaatgttatttatgattttatttctaatctctaggaaattggacacccaaaattaaattaaaatatgaacattgagtggagttaaaaagcaaccttatatatctcctaaggaatctaataaattaactttaaaaagcaaaatataagttttaccaatatccctaccctttaaatcatatagaaacagaaaaaatatcttgaggaaagttttacataaatataggcaaacaaaatatctgcaaatgaatgtatttgtctcatatgctatcttttctgcaaaggaatgaaaggtttccagaacttagaataagtgaagttctctgcagtgattttagtaattcattgtgaatcattacacacttcttgatctagaacagctaagttgtttggcataaccttttgattcattttcctttttctacttattgattttcttagcactatttactgaattacactcttattctaacaatggaatttctgacacctttagttatataggaaaacattatatgtgtgtaaatattgactcaaagtattaatggtctcttattattgacatattatctctagaacttcatttgtatttaaaataaaaattatgtccacatttatttccttagactccgtatagagtatgtggcatatatttttgtaatgttccatgccttgggctacctatcattggaaaatgttatatttcatattagacgattcttttgacccctagtaaacctgaaactgccttagaggaacagctgaatgtatttccttaaataaacacattgttcttcaaattgctagtgtttgtcttcttaataggctccacaggcaatgggaatgttgactttgaagtcacctctactgggttcatgtagataagtctatttcataccttttttcttcccacacttaacagtgtctttcaactcacgtttgttttaagacaactataaatgcatacatactacatggaatatttaatttttatttaatttatagtctcagtaattagtgagaggttggctcacaattacataaaaataaacttagacaaaaatcagaaaaggtttacttttaattgaggtatgaggaaaaattcatttacttggtcacatgcttggccttcataaggtagcaaaagataaatggtcacttgcattgtataagtggtcgtaaaatttttctcagcactgaactgtcctccagagctatttatatgaagctagtcattttctaatgatcacttgtaacatagatgatacactcaattttgataaatgggtccaaactctcctaaagaagctgtaccagtaatactccatgaagctttctagagtttgtttgcttattcactatccagacagaaatattttgcatatttttcaccatcccagttttcaagaacccaagctagagtttgagaaaattctatttgaatggacataaaaatttatttgattttgaaataaaaacaaatcattaaaaattctactttaaaaatatgctttgaaacttgagtatctaggaaaaaagttaataaccaagcacaggaacaaaatacaagaaattgtagcataaagatcatagatatgctttgggaggccaaggcgggcagatcacgagatcagaagtttgagaccagcttgaccaacatggtaaaaccctctctctactaaaaatacaaaaattagccatgcatgatggcacacacctgtaatctcagctactcaggaggctgagacaggagaattgcttgaacccaggaggcggaggttgcagtgagccgagatcacgccattgcactccaacctgggcgacagagcgggactccgtctcaaaaaaagatcatagatgtgtttgttactatgattctctttttggtctctgaaaatgggtccctggaaattagaaccatattaagttaaccatttcttatatattagaaacagttgtttatcaggttaaagatgctatattttttgtactgtataaacagccatctaacatagtcatttgtttggggaagatactagcctttgataatactatttctcttagattactactggcagcaattaatcaacagttgtagtaatttaccctatacttcaagccaaattaacagtcttgccttgcttatatgaatattaaaggataatgtggcattgggcctggaattctcagtaagttgcccacattgttaatatttaccaatattaacttaggaataggctgcaaggtgtaaggaatgtctgttttaatattcattttaaaaatacatgttttaaatattgtaattcagtgtaatcacatcagttatgataatttcattttgggtccaggataattaaatctggaattgcataagatgcactacaatggtaatattatttcattattctttgtaactaacattccaatcactggtatagattgacatttggaatatgactatcatcacacaattctttgccctaggagacttcctaatgggcattttttataccttgctgtagccttttatgtacttaataaccgtacagtttcatgtagcttcataacaaataactatcattgccatatttatgtggtaataaaactagtttaaggtatttttatgaagctatttatggcttttagtcattattgagttttttatgactattataaagtggtatggcttaagaaaaattataaactcccctatgggtatttgtcatgattgaaaataatagaattctttttgttgttatgtcttgggaaattttattatcttctgtctagaaaagcaaaatactagggatcttcaatcagattattaccaaattattaagattttgttctacgtattgaatgaaagcatatattccattacttgtcccaattgaaataaacataaactgccaaatttcctggaaaacagtatatctagaggtcatttcagttgttaagtatgtgttatcaacttaaggttttattagttgctccttgtaggtattctgggtcagtttcattattatttactgaaagcattaatattatttactcatacaaactctatttcttagttgttatagtaaagacagattttttaattattgcataaaattgtatgttaagaaacattctctggccgggcgcggtggctcatgcctgtaatcccagcactttgggaggcctaggtgggcagatcacctgaggtcaggagtccaaaaccagactggccaacatggtgaaacctcatctctactaaaaatacagaaaattagctgggcgtggtggtgcatgcctgtaatcccagctgtgaaggaggctgaggcaggagaatcacttgagctcaagaggcagaggttgcagtgagccgagatcgcaccactgcactctagcctgggtgacagagtgagactctgtttaaaaaaaaaagaaaaagaaagaaaagaaaataaacgtctaattttatgacttttaaaaagcaaggcatttcttgacctggtattatcttactttgaaggttcatttgttgacatctcaccttgcatatttcagattagtatatgatactgaaaattctttctgttctctgaagcactctttccatcattcatacattatgttgtttccatttagaacactctcctctcctcttgtctgagctaattcctactcatccttcaggtgccagcttagataatcacttccttctgatacatttctctaagctgctggtggctggtagagtttatctttgttatggattcctctgtaacctgtatgtattctgtatgtaattgataatttatctagtcatttggctataacccccaaagacagagatcaggtcactattttcattctatatccccagcatggtctggcctaggaagccctcaattaatagacgttgaaggataaacagaacggattgccttatttatgtacctgttgtagcaactagaaattttagtcatttgccccaaatatgttactatgatataggctgtttgtgaactatctcttgcctttttatattcacagatgtgtatgcatgatatcacctgccaagtcctttttgttctcaggttttggagttactttttctactgacaaccctaatttccttatttgatgagaagtatgaaaaggaatctaaaaatacttatatgctgggcaatttaacaatgtttaaggcatactttgaaagtgccatgaaatccatattataattttctcacaagccctattgttgtactaattattaagcaatgatactagtttctagttaattcatggcttattttatttattatactttttaaaaattgacataaaaattgtacatatttatgggttacagtgagatgttttgatacatatatattggataattatcacatcagggtatttagcattttcatcatctctttgtggggagaacattcaaaattctctcttccacctattttgaaatatatcatgcaatattgttaactatagtcaacacaccagaacttactcctcctgtctaactgtgaccatatatacagttaatcaatctctcattataccccagcccctttccactctccaatctttggtagccacaattctactctctacttcaatgagaccagcatttttagattatttatataaacgatatcatatttgtctttctgtcctagctcacttcacttaatgtagtgtcctccaggttcatgcatgttgtcacaaatgataggattccaatcttttttatggctaaataatattccagtgacatactgtgttgaaatagaaaaaaactcatcttaaaaaatgtgtatggaaccacaaaaaacccaaatagccaaagcaatcttaggcaaaaagaacaaactagagtcattacactacctgacttcaaaatatactacaaaactacagtaatccaaacagcatggtactgtcataaaaatagacacatagacaaatagaaaagataacccagaaataaacctgtatacttacagccaactgatttttgacaaaaatgtcaagaacatgtagtggggaaaagacaacctcttcaacaaagggtgctggaaaagctgaatatgtacatttagaagactgaaactagacctctatccctcactgtataaaaaattaactcaaaatgtattaaagacttatgtactataaaaagactagaagaaaaataagggaaatgccttatggcattggtctgggcaaagattttttgaacaagaactcaaaagcataggcatcgaaagcaaaagtagaaaaataggatttcatcaaaccaagaagcttctgcacagcaaaggaaacaatcaacagagtgaagagaaaatctacagaatgatggagaatatttgcaaactatacatttaataaggggttcatatccaaattatatgtagaactcaaacaactcaatagcaaaaaaaaacaatgtgattaataatgaacaaaagatctgaatagacatctctcaaaaagagacatacaaacggatagcagatatatgaaaaaattgtcagcatcacttatcatcagggaaatgcaaatgaaaatcacaatgagatattatctcacccagttaaaatgggtattattaaaaagacaaaaggtaataaatgctggggagcatttggagaaagggaagtgggaatgcaaactagtacagccacaatggaaaacagtatgaagattccttttgagactaaaaataagatggggcaagatggctcagatctgtaatcccagcatttcaggaggctgaggcaggaggatagcttgaggccaggagttcaagggaagcctgggccacatagtgagaccctatctctattaaaaaaaaaaagaaagaaagaaaacaaaacctaaaaataaaactaccatgtgatccagcagtttcattactgagtactggttatatacccaaaagaaatgaaatcatatgtccagagatatctgtattcctatgtttactgcagcactgttcacaatggcccaagatatggaatcaactcagtgttcatcaacagatgaataaacaaaatgtgcagcatatgcacaatgtaatagtttctatttaatttaaagcttccagattattttatcattttaagaaatgaagactcatagctgataacacgttcagaattaaaacttgtctctctatattctgtttcctcccccatcaagggttgtctctgctgctaagtgtctttattccttaaatcaattttgcatcagttagaggaacaaattgtttttccacagatttgtagccattaatctcagcagtaactcagtgaatattttttttaacatcaacatcagaaatacatggacagaagggaataatttgaaccaagtccaggacatactggctgaatctatgaaagttaagacttcatgtcatataataaatctttgtcactaatttatgctactttaaaatttggggatatgattagaatggtcatataacataatgcacactttcttactctgttctttcattgtcttctccattattactgctactcagtaatggtatcaactggaaattcttgaattgtaagtaaaaatgacctcatttccgaagcatttaaagttattgcaggtgaaagctctctcaagggctttcagtgtttcaatacgtggatgtacaatgtctgtcaataatgaatgccacacattaaattaacttgaatagttatagcccaaactttattctcagctttggcaaatttctaacataaaagcttagaatgtaagaattgaaaaaaagctattagaataatacagatactctgaaaggacctctagattgctacacatatttctttcttttctgagtataattgagatttccaaaaatttttactgaatgttcattttatattctggacttggtaatttaaaaaaaaagataaaattgttaaaagagcaatgagtaattcaaagaactgaagacaaaatattgtatggttgataaattcatatcaaccttcttagctgagatgattagaacaccagggtaaagtggccaaggtcatagggttgagctgtctgtggcccaggtagtttatcctctttctgggtcacagaccattttgggcactatgcccagacattctttaaagaaggacctagtcccaacacaacagtggatgaaagagggaaacaggtcagggccaatacacagctgtcagaactacaatgtctcaaggtcagtatattcctagagtgattttatatatatatatatatatatatatatatatgtatgtatataaaatattgtgtatatacatatatacaatgtatattgtatggtatgttttgtgtatgtgtgtatatataatattatacatatcactctagcaatatactcactttacatatggatacacataacactagatatatacatatatatatatagtgtgacaattttgtataaaaaagggagaataactgtgtttgaataacaattatttgtttttgttttaatttataaaggcagtaaaaatcaaccaggttcacttcacttactttttgagcaggtgtcaagttcacacacttgaaatttcacaggacacaaaatatctacaatttcaaaaaaagcttgcttcactgaagtatatgaaggtagtcccaatatttttcattatatccttgcatgcataagtaaaattttagataatttaaaggacattgaaataattaagtatgctgttgtcttttctcttgaggcatcagaatgggtgtaactaaatttatataggaaacttgactttgttcaccatgaaagaaccgaagaatctgagatttgttttattgaggaaggcttaggcttggttcaggccctactgtgagaagaattagtaggaaaagttccagctttatctagtgagattgacattgtgtcatggcatctttcttaatttaataagtataaatcttacacctccactaccagtgcagtactgacttactgtcgatttgaacctaaagttatcacatgcatcacacttaatcatagtggttttcataaacttaaattcagttgggcagaattctctggatatttatattgattctatgctccagtttttataaacataacccagcaatgacatggaataaagcaaaaaagacttcagagttatcgaagctaaacttttgatttcatagaggaaataggtttgttctattgcccaccagaaatggtgactaataaatgtgtctttccatctttcttctatgagtaactaggaatttcttcagcattagttacttcactttttttagaaaaggaatgttgtcactgaaaagttaagatttaataaagattcacatgagaatattcttctcttctgtttaacatcaatctttaagtagttatttttattattgcaatagtctctcttcctaataagtcatttttttctatactcaccattcccccacccaaacctctaatgctccctcattaccctttattctattaaaatgcttatcatgctgtaaattatatttatttctttgggtcactctttccagtaaactataatcattaagagtagttctgttacctttgcatcaccttatctggctctgtacctggttcatagtaggatctcagtgagtatttgatgaacaaataaatgaatgaataaatgaatgaattcagtaatattgttgagtctgtttttattatacttttaaaacttctgcttatattcagtaatgaaacatgaagaaattaaatcagatatttacctttactaataaaattgtaccagagggagccataatattattgtcagtttctaaaatgtgcaaggctacaaagggtgaaacctctttgaattaatgcctcttaatggttggaaatttaatcagtagtcttcattcacaatttaagaactttacattgtctctctttcagtaacagtataaatgacaactttcatatctgaatcataaataattcatcatcatgtattcacccctttagagtgctaagcataccatagaggaatctttgttaaagatatttggctagccatctacttagttatgttagaggaaaaatattcaaagctcttgacctagtattccaatttctggcaaactttaaaagtaccatctttgacattcatttagaattcatctccttgatcacttttggcccacagtcacaggctttgattcagaacttctaaagcaactttgttttgacctctgctctgttattttccaagtcattttaaaaccaagaccagaaaaatatcctgcttcatattttatcaaagttttcaattatcccattggattttatttcatcatcttccccacactatgtacagtaagttgtttaagattttgtaggcaaatttctcatttccatagaatttgtgcttagaaattcaccagataatcatcaaatcaatagtccttaattaaatactaagtatatatactctttatttttcacaatgcttaattaatctctccaaatagaatacttcaatgctatgttcatcatggaagtaataagctctaagaatattttatgttgcaatcactaattaattatgaagcatagcttcattttttccttgatgtgctatcaacctgctgtttatcatagtctgaatcttatggcaggtaaggtggttatatatatttcaattatatgtaattaatgaatattgtataatttttctactgcctaagatctgcctaaatcaatactattttttaattatcttagtaccaatgctattcaagtgttttatgtcaaaaaagtcattttgatagtttaggcagagtcttaggttttttctttcttgatataatgtgactgctaaggccattaaataatatatgaaagtacattgctatgacaaaatatcaaccaagaatggatataggccacacttatttctttttccattactatagaaatttgatttgtggtaatggcagttaattattttgaacaatgaatccaatcagtctagtcagtttaccaaggaaaaaggaatgtattaaacagtaactttgataatattgggatggactactgaaacagattaagtagactgattcatgctttaatcaaagcaatgttgtgtcctttagtagctgatacatctgttcacacatagaagaatgatgttttgtgagcaaacttaattttcagttcctttaataacaataatttttatattcagcatgttctagttgagttctcacattaggtaatatacgtctgtgagcccttcaatttagaaatatgagttattagtaagaaatatgagttataagtaagagattattaaactaccagaatgcagataaatgaaacccataatgaataatacagattcctatatactcttttcataaacattagaaaagatgaaaagcttaatttagttgaccaatgacccacataaatatattttatggatatttttctggatgtatataggagtcacaaacacatttaatagtattaagcaatcttagtttgaaatcatcagtttcgtttaaatttaaaatgaggactatgaaaacaattatgctttataagcaactgtttatattttcatgagatttaaacaaagcaatttaaatttacaaaaatttaaggcaactaagtatttctttgttataaaagtaaattcagatgtaaaatagcctcaaagcaacttgaatatataaaatcaagaaatccataaacaatcatcattttgaataattgcatttatagccaaacctgctcagtggtaatgtaactaatctagatcacacttatataaaaataaaattgtgtataattttatttttatatataaatatatataattatatctaattttatttttatatattttatttatatatttttaaaaataaaattatatatatttataaatatataattatatataattttatttttgtaggtatagtcctgtgcaatgtcttccttacagataatggttgaaaattagagtataaaagaggtatttttgttactacctagcagttcacttgatgttggtagactataactaaaggataatctgtaacctaatatgatttcaactctattttgactttcaaaagagagaaataaaatagcactatatcatttctaacaagtgtttataaggtagaaattgccttaaattcacatttaaaagaaaccatgcaaaaccttataaaatagcaatatatatatgtacatatatatgatgtagagagaatctattactcttacatggaggcaatttccaataatttgctatatttgtcctgctcttctcagttttatgaagtttttttatggctccagcccaagtattctcagattttaaatgaagagagcattaaattcaccaatttacttagcaaacatttattcaatgggaaatgtactgtgctaggccttgtgagggttgtaaatataaataagggcgatccccatcctcaagaagtttacacagacacaacacaaggtagttaacaaaatgcctttgcagccctcaggaaaataagattagttctgctacagtgtttaaaacttgaaggatgggtagactatcaataaatggaagtggagaataaagtatagaatgaaacagcagatgaagcttggaagacactaagtgtgtttagagaatgaagaggggttaagttaagcaccaaattccccttggaaggctctactgaaaagtgggttatgagacattataataaaaatacacatcggatttggaagatattcaacagtatacttagaagcgtgacattcatgccaagataatgttatcaaatgttgggcatctcttaagatgtatgagacatgattctgcgcttctgaattcatcatcttagctgatcttcacaacaagcctgtaaggagttattaccttcattttataaaaggaaacattaaaccctgaaggtatgcaacgatttcccccaaaattgatgagtgtctgaatcaaaaaacaaaacaacaaaaatctttcttattccagaggactaactcttcactatattttcttttcattttttttattttattttttattattattatatttcaagttttagggtacatgtgcacaatgtgcaggttagttacatatgtatacatgtgacatgctggtgcgctgcacccactaactcgtcatctagcaataggtatatctcccaatgctatccctcctccctccccccaccccacaacagtccccagagtgtgatgttccccttcctgtgtccatgtgttctcattgttcagttcccacctatgagtgagaatatgccgtgtttggtttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacattcgggttggttccaagtccttgctattgtgaatagtgctgcaataaacatacatgtgcatgtgtctttatagcagcatgatttatcgtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatggtgagcattttttcgtgtgttttttggctacatagatgtcttcttttgagaagtgtctgctcatgtccttcgcctactttttgatggggttgtttctttttctcttgtaaatttgtttgagttcattgtagattctggatattagccctttgtcagatgagaaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtgtgaggtttaagtctttaatccatcttgaattgatttttgtataaggtgtaaggaagggatccagtttcagctttctacatatggctagccagttttcccagcaccatttattaaatagggaatcctttccccattacttgtttttctcaggtttgtcaaagataagataattgtagatatgcagcattatttctgagggctctgttctgttccattgatctatatctctgttttggtaccagtaccatgctgttttggttactgtagccttgtagtgtggtttgaagtcaggtagcgtgatgcctccagctttgttcttttggcttaggattgacttagcaatgtgggctcttttttggttgcatatgaacttgaaagtagttttttccaattctgtgaagaaagtcattggtagtttgatggggatggcattgaatctatgaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggaacctaggtattttattttctttgaagcaattgtgaatgggagttcactcatgatttggctgtctgtttgtctgttcttggtgtataagaatgcttgtgatttttgtacactgattttgtatcctgagactttgctgaagttgcttatcagcttaaggagattttgggctcaaagaagtgtgtagagggaaatttatagcacttaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccagaagctggttttttgaaaggatcaatgaaattgttagaccgctagcaagactagtaaagaaaaaaagagagaagaatcaaatagacgcaataaaaaatgataaaggggatatcaccactgatcccacagaaatacaaactaccatcagagaatactacaaacacctctacgcaaataaactagaaaatctagaagaaatggataaattcctcgacatatacactctcccaagactaaaccaggaagaatttgaatctctgaatagaccaataacaggatctgaaattgtggcaataatcaatcgcttaccaaccaaaaagagtccaggaccagatggattcacagctgaattctaccagaggtacaaggaggaactggtaccattccttctgaaactattccaatcaatagaaaaagagggaatcttccctaactcattttatgagaccaacatcatcctgataccaaagctgggcggagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacacaaatcaataaatgtaatccagcatataaatagaaccaaagacaaaaaccacatgattatctcaacagatgcagaaaaggcctttgacaaaattcaacaacacttcatgctaaaaactctcaataaatgaggtattgatgggatgtatctcaaaataataagagctatctatgacatacccacagccaatatcatactgaatgggcaaaaactggaagcattccctttgaaaactggcacaagacagggatgccctctctcaccactcctattcaacatagtgttggaagttctggccaggacaattaggcaggagaaggaaataaagggtattcaattaggaaaagaggaagtcaaattgtccctgttggcagacgacatgattgtatatctagaagaccccattgtctcagcccaaaaactcttcactatatttcattccacttaccatgaatgaggatctgtacaacgttctgagcagcaccatgggacataacaaaactcgtaatttggggacattaatctaacagcagcatgtcacatgatttgaaagccacaagactagaagcaatgacaccgttcatcatggtagaggaattaaaaaacaaaggctgatacttgatgatgggaatgagaatgtaaagaaaactaaaataaaagagataatgaaaaaatatgctgtgatggaatttaggttagtgaataagaaagaggaggaggagaaagaaggaaaaggtggtgcagaaggaagaaaaggtgcagaagaaataggggatagaggagaagagaatgtgagaaagaggggcagaaacatttttttggtgaaaatcccatttggcaaaatgtaaactaacaactaagccacttggatgattttatttactttttatgataactctatgcattagatactattactatctctaatctatcgaatgggaactgaagacttggaaagcctcccttgcccgtggagacagagtctgtagaataggaggctgagatctgtacccacagaattgaattcagcaaaactcatgttcatttggccctccctgtctgtaactgtgagatcagcagggatggttaaccctcttttgaggataaggatcagagaagtattttatttaagggcatagagtaaagttttctgctgtaaaaaatcttcctctattttggggtacagagaggcagcatacatattgattatgcaagcagtaaatctggtaattatctttgaaacgtctttctctttaccttccatttttaatcgatcaccaaacgtcagtgattttatctcttaaattgttctataatccatccaattctctccactttcactgctaccttgctattgcaaacattaacatcttgtatctgggctactgcagttgccttctaaatggtgcctcctacatctgttattttcctgctacagtttgttttgtatactatagccaggatgatgtttttaaaatccaaacctagtcttcacattctgccccctaaaataaaagtaaaatagtaatgtaaaaaaactatcgctttctattgccctttaaaaaaaccaaagtccttcagtgaccaaaagatatttcataggcagcagtgccaacctctgtatcttccctcatttttccatgtagcgctcacactggtgttgcttcatgtgcttggataagctgggactttgttcatgctgttccctttcctaaaacattctctagtcctcatccctacccttccccctttatttgtttaataaacgtttgtccttcagacctcaggtgaaatgtgacttcctcaggagtcttccttgatcctgcaaacagagaaaattcctcttctatagattcttatggctctgtgcttttcctgtggaatccttatccctttcatacatatatattaataagtgtgctttttgttcagtatctgtacctcttgttagtctaaaagcaccatgaggaagatatcacgatttttttgctcttttatgctgagaatttacatccaacatagaacaggtattcagtaaatatttgttgaatgaaccatgaatgattaatagcctcatctgtgcttaaattctagcttctccatttactaaatgcatggacttgggtaattttcgtaagctccacaagcttctctttttccattggatgaagaaggatagtcacaatctaataagtaagattattcatctaaagtttttgacatatagaaagtactgaaataattagctattattcaactacaaaaacttcagggtcacaaagaacaaaactaatgttttttgagggagaaatgtcatttcagtacaaatttaagaaatataaaatacattttaatgttcaggtagtacctgaaaaggataaaacatgtaatttatctgagaagtctaattttattatcataattattaaataattatatatatatatatacacacacacacacatatatataattttttttagatggagtcttgctctgtcacccaggctggagtgcagtggcgctatcttggctcactgcagcctctgcctcccagattcaagcgattctcctgtctcagcctcccgagtagctgggattacagggctcaccaccacgcctggctaattttttgtgtttctagtagagatggggtttcaccatgttggccatgctggtctagaactcctgacctccagtgactacccacctcagcctcccaaagtgctgggattacaggcatgagccaccatgcctggcctaagtaattatttttgaaaattagtatgcattttaccttggtcctcttgtggcccagagtcagatattagttgtttgggaaagtcatagtgaccgataaaagtggaaaatgtggcccagcatactattaaattccctttttcctgtgctgatgcttactgctgtcaggtaaatggagattatgaagagggcacaaacgaatcactagcttctggctcaggaagcagatatagagcaataggcccttcgttatactcagctttagttctgtcacctgtcatcagcatctgtcatttgtttcagaccactaggatatactttctcatccacctgtaccatctccaaaatttccttatgctaccaagttaaaaaataaaactagatgaactgtaaggttcctttccattctgacagtctattattttatccctcatccatctacctcatcaaggagagttggtcaccacaatgctttgaggacatacaatggaaaagtaaataatattattaatagtattgatactaggagcacaaagttaaagtcctaaatatggagaatgagggaaaataataacatgtcatttataagaaaagagttaaaatttagcctgagctttaaagtgctggtcttgaaatctagtgaaccagaaaatttgaatccctccctgttcctgccagtctgttttctcatctgtatgttagtaataataacaggatttacattatatggttgttttggtaaatgggaaagtatctgtcaaatcttttgcactgtgactgggacacagtgatcactggtgaatggtggttagcattgctactgcatgaaatacctgacccatcactatcagccaagtccagagatgctactgatttgcatgtgcagaaaatgctaccaatttctgaattgtatgttcaaagaagactaacaagaaaatagtaaaaaggcagaaagaatacttcctattgctacaaaaggaatgttagttctgtatacaaagtattattttgttgcaaatatacacaaccttttcacgtggggctatggctgctaataaggcttttactctttgtgtaaaaaatgcgtgatttatgcagacagactgtaatatgaaaaccctgcatagtctatttgaatcagcaagtgggcagccacatttatctctgtttactgctgaatagctttcattgttaattccattttctattcctgttgtgcatatcaccccttaatttaaatctttgacaagctaatttaataaaggggatggtttttagagtggaaaaaataaatatctttactcatctttttaaaaattataattagcttaaacaaagaccttaggtatagttcctgtgtttattagccataagagaatatttatgctaaaagattagtttttcttaaatttttaaggtacaactttataaaataattccttcactatttcttcattgttaacatttcattcatataaaggagttgtattttgggtcttggaatgaaaatatccagcttccagagcaaaaaattttcagtcaatcagtatagagaaacagaattttagaagcaataaagtcctagaatgctaaaatgcattgtactacctggtgatattctgttcttgacagtcactaaagacatgttgactattcttatgagatagttctgttctgagtccctgcatcttggttgttctaactgaaaatggcattatctatgaaataggaaaaaaaatctatgaggtatacattagcatgaattctgacgctacagataaatgtaaaaaacatggatagtgtggaaaaatattacagtaaaggagttatgataaggtgcaccaaagtacctaggaataaaaatggaaagaaccaacaattaaataaattagtttcaaatttaaaacatgggtttgcagaagactaatatgaataatactgctataaatcatgatttaaaacatgaatatatatatatgtcactgaataaaatgaaatatatagatatgtttgtgtgtgtgtgtgtgtgtgtgtgtgtgtgtgtattccatttacctgaaagttcagtcacattttattggccacaaatggtcagaagcacagtttcatttgccatattgatggactgttcgttaccaacttagacacttctcagtaccaagccgaataccccaaggagtagcctgggtatcagcagactagataatgaattcttgacacttattcctccagtactgttccaagttcttcatgctgtatccacaggacctaaaacagtgtctgccacactgggctcatgaaataaaaattaataaaggataaaaggaaaaactcctatccaactaacaatttagtatcttaggttaaaaaacaaagcaacttaaaggcaatttttaaaaatttttctcatattaacattctacaaattctattatgcatggcttcagaaaccacagagagccaaatttagctgtgtcagtcacctccaccccagcagcagagtttcccatgtgctaactgccaactgagcctcaactgaagttcatgtattgagtctcaattactgagtcctaacctagttttagacaaatgttccatttcctttcttaggctggtctgctagcctgaaactcagcccacttaactggaacactgacaatctatctaccctttttactagtacccttatacaatgaggttctctccagccaattattgagcatgtggttgaacttgaatcaaccttcttgcaaggacgattttactatcaactatgggtaaaaaacatgccccattccttaagatcatccaaaccgcgagagagagagagagagagagagagagagagagagagaacgagaacacacaggtccagagatgtcattcaggatgtcatctcagacacagaaatttttatttctgaccatgctccttggagaccagcctcacagttgtctcaaaatactgcaaagtcaaacacatgtgattatgacacattaggttctaagatattctcccagaactgcaacactccaacacagtctctagtcatacttttctagcaatgtgagaaacacaggaggcagatgtgagaccagttaattttaaattcataacgaacaaagaattagaataataagaaaaatattatatctaagtttcttcccagtgcagtaaatatattcatatactgaaagaattaatgctgttttcaaagatgccggaattccacatcagcacaaaaagtatggattaagcttctctgtaaccagccttgggctaggaatttgatacaataatccaacaattctatctattacgttaagaagataaggaaaaaaatcatcttctctttctagtaagtataatttgggggatgactggaaacaagtaaaggacaacataagacagaatataatccagtggaaactttagtggtacctgtgtgttataggaacttagaggttgaaaaagtttcatgagagaggtgcaatataagctacacatgcaaaatatgtaaaaatagctcaggcacctgaaacatcagatttgtgaaagatgtcatcatatttcatactgtctatcatgtgtgagtataataggtaataggtaaacagttcgatgtccattgaactataattactccatttgaaatgcttagaggtctattatcaggtgattcacaattacatttgattgattattctgaatttaatgttttctaaaacaatattcaaccacttcttattgtattccagtgtccagagtttctttctatgcctacctagaggtctttacctgaagtttagaacaatcattgttcttattgttatctacttcatgatagatattatgttaccccttcacctattcctagtatgaaaacacctttaaaagaaatatttcattgtgttttcttttcctaaatcctacttgctattcaacacattttgaaggatgaaactgtaatattactactaaaataatgctgttttcaaagatgcctgaattccacatcagcacaaaaactatgtattaagcatttctgtaaccagccctgggttaggaatttgatacagtagtcaaacaactctatctattaagagctcaaagaagtaatagtgagaaagccaagacagaaattttctgtctgattccacattctgtggtctaaatcaccacacttttatgcagaaatatttttaaaactcaatcactgaaaagctattagctgttattattagcagttacacttaaattttgttgcagtaaaactaaaggtaaataaatccttaatttcattgtaactcataaggtatgttaccaaatataaatattatattgacctttatgcaacattgcttgatattaccctatgtactactaatagtcaaacttttaatggagatattttagattacctcttttctttctttcctgacctaataatctatatcttgcaggttattttacacatttatataatatacacagactagtgctattgggggaactatatattaagtaaaggacattcccatatgaaatgtgtataatttcaagataattagcctaactttaaatctagtttatcaaaatcaatcatgttttcatttaaaaatatattgattgtatgtctgtcacagactaaatgtttgtgtccccaaattttatatggcgaaacctcatcagcaatgtggtggtgtctggaggaggggtattggggaggtgattagtgtataaggacagatcccttatgatgggatttatgcttttaaaaaaagaggctccacagagattccttcctccttctgccaaatgagcacacagtgaaaacatggccctctatgagccaggaagcatgctcttaccagacacagaatcatctgctggcaccttaatcttggacttgcctccagaactgtaagaaataaatttctgttgtttatgagccacccagtccatggtgtttttctatagaagcccaaacagaccaagaccatgtcagacattgtactaggtgttggtgtgtgatcgaattaggtgtgatttcttcccttcaggaacttacaaccaaataaaagattcagataagtaagtcaatgattgtctaagttctgtgattaaatgaagcacacagggctatgggagccaaaggacccccatctaaatcacatagtatagtataattaggaaaggctggaggaggagtgactggtccagttgagttttaaagagtaggaattggaaggaaagaaagatgaaggacattcctagtgggaaagcagcaatagtaagaagtacaaaaaaagtcctcaagagacatagttaagaccatgctatgatcttcaccataatcttaacctcagtcaagaccatagaaccacgctatgatcaaagatttaaaatgctatcctgaaatccatgagtcattgcaggaatgctagtggagaatgggtatagatcttacagacacacttcaaacttagatttgcatcactggcagaaatactctttcagatatttttcttaccctttcttattttttacttttaccttctttctatatgggaaaataagttggaaaagcataattgatattgcctctgcagctacatcttcagcatagcatcgttatatattactatcaacatgagcatcatagataacaatacaatgttattttatactaattgggcatactttagcacattgtaaaccataactctagatatcttgacattagtatgtataaggtcttggaaatagctgtaatactgtgataaatgcagtgaacatcaatggggaagtactaaccgtaactgcccgaacctattgagtgtttaattaatgaatgtttgcaatttttgagagacttaatatcaattattttatcaaccaatgggacttaattcaaaaattaaatatgtattcctaaaccaatcattccatgtgaaactgattaagatgtggaaggcccatgaaatatgaaccatttaacatgtgaatacacgtcatgaagatgacattggaaattccaacaaaaatctaaaataagataatggaaattcaaaattaattaatgtgtccatgattaagatataattttaactcagacaatttacattcatatgttatatcttccttagttcctattaagaattaaactcatttagattattgtatttggctgaaaagattctggtaatgccatggtgttcttttgtaagttcataaacaattatcaaatgcttttgttggttcataaacaattatcaaatacttcacatcgtataatcactggaaagagaaaaaagctatcacagatcttagccaattaaagagcttatagtttagtatcaaaaaaaactaggaaaaattaatgtcaaatagaaacatgtaaaataagataatataaataaatgactaagtgtcaaggaaataaagaatataggaaagatatgaattagaattgttcaaggataaatggttccacctacaccttgaagaaaatagtaccaattgttgagcaggaaagagtgaaaatattttaggtgaaatacttatgtatatatgtatttcatatatatatatccacacatacacaatatatgtatgtatttcatatatatattcacacacaaacatgacagaaaagtcatgaagacaataattatcaatgtagttagatgtagttaggggattgaatttaagtggttcacttgaaagaaacagatgaatcattaataataatgaaagatgaattttgagaaatgaatctgagactctgagtatgatttaatgaaaatctttaaagttaaacttttatacaaactttgatgttaaaactaactagaacaccttaaaaagagtgaaataatatacataagaattggagtcactatatataagaagaaagcagtaaatccaaacattagcccaggtttgctttgtggggtttgcttgagggtggtggctttagcaataacaaagaattatatcattagagagtggttccaaggtaaagcaggaagaaaaaatagaatagaagaataaagcctaagaataaaagtctgatgagataaagaaatgtgaggaaggaagacatgctaatacttatgaacgagcagatggaaaagtgtctttaaggaaggaaggcaactagcttagttttctgcgttatacttcgggtgtgcataacgtccaagagctcaaaaacagtgtgaaagactaaaatatctagattcatccactgggagatgatttcaaaacttggagcaagtcagttactctctgcaggatcaaatgctgagaaatgaggaaaaaagattaagtattgaaggttattgttaaaggtcaggagaagaaaagagaaacaaagagggcggaataaaagcaaccagtgatagagaagagattatacaataaagcataatttattctaaaaagaaagtaatttatttttccctttttcctaatctttagaagctgtgaaaagtcagtcatttaaaggtaactttttattgtggtaagaatacttaacatggatctaccttctgaaagttttaagtgtgcaatacagtattgttagctacacacacaaagttgttcagcagattactagaacttaattattttgcataactgaaacttgatacctatttatgtctataacacatttatatactcctgaatttgcgttataactccagaggttaaaaatgaaccacagttgaattgtgtagtgtggataaaatcgatggctctgcataagtggttgagaaatttctgttattctggcacaaacttttggtaattgtaagctatcaaagtctttgccagactgttcagtgatgaaaagtccctgggaataggtaataagagggttgtgttcttaatgtaactaaagtaccaggtgacatctatttgagttactattataattacgcacttttgtatattaggtactctgagacctgaagagtcttgcaagaaaaaaacaaaggcaagaaggcaggaaggacaggatggagggttttttaatattggagggccagaagaaaaggagttatggtttatcaggccccagtccccaaaatggagttgggagcaacggtcattttagaatgatttgactcctctcctttgtatggcttatcctggatgggactcagtaaagacatggaagagaaagaacatcgtgtctcttggagtagatgaaaaggaagatgatgaccacagtgttggcctctctgaggcactgcttgatgcagcctcctccagggtcactgctcatcactccattcctcagtgcctattcctcaggagtgatatcacacagctagctgtcttagtttgcatgtgctgctgtaacaaatacctcagactggttactttataaataatgcaaatatatttctcatggccctggaggttgggaagtccatgatcaaggtgaaaacaaattcagttccaaaggctgctctccgcttccaagatggtgccttgaatgctgtggactcacatggcagaagagaaactaaagggtaaaagtgattagctggttctctccagcccttttacaaagtcattaatcccgtttgtaatgactgagcacttatgacttaatcaccttctaaagacctgccacctcttaatactatcacattgggtcttaggctcatcatatgaattctggggaacacatacatccaaaccatggatatatttataatttacagaagaaaatatcactttcaaaagaaaaagaatttgctccagagtgtataaaccttttattgtcatagaaggaaatacttactttaacaaaatttaagttttacaatattccatactgcatactgttttcattgttagtagactaaaaatttgggccattaacattcaaggtttggacattagacaggtctattatttccagggccatttttttttttattttggttctctttcctttgagcctgggtgggggatatgggaggaactgagaatgagagaagaaaaagaagaggtgaaaagatacaaaagaaaagtttgtggtcatacaaatgatacatttttaaggagctcaaatgttcttgataacattttctattacaagtttaggtagggaaacactggcaaggctctaaacaagcctcagactacagccttatgaatctaagtggataaaaatccagtcttaccatcaaatatattcatggacatttggttaccatttttatatgtaatagcaaaattttctgccaacaagaatcagtgttcagataaaatagtgtttttaaaaatatgtgagaccttcaaaactatggttaaatttgtttttacctataaaaaagctattagcaaatattagacaattgcaagtgttacaaataaacactacatgaaaatactgtaaatatctgtataatcatggaagttagttggaccaaaaaaattgttttaaaaaaaaattaacctgaaaaagttaactatatgccaaaaaggaagatgaatatatccacataatcgattacctcatttttcaagtttattccattctctgcctcagtcccatgttccatggctgtgactccagaaggagtaagcaagaatcagaggaaactgggaggggtggagaccaactctcacaggtcaatgattttaatgtttaccaagcattaaaagcaaagaaacggaggtataatggaacatcccccaaggggagaataaaattagtcctaaaatagtacattacatattggttttggtgaagtgttgcagagaaacaggctgtccttcaagcagtccggttatgttacccatcaggctgacttgtgcacatacggtttaaatcaagaaaggatagttgtcctaatttctttgtgctcataaggggaacaatagttgaaagcagaagttactactacttattgagatccttgaatgtgagatccttgaataacattaagcatggtatcattcaatttatccatcccttttctgctgcctgacagagtcatttctcttctgttatttcctggcaattttaggaaaatatattatggtcacaatatctactagttttaaaaatgtattcaattatttttgcagcgcttctgatagctgtaacactttgctaacctcagacaaattgactacaggattaatgtaatcatttctacagaaagtatttcacagctttaaaatgacagcattctaaaatacgatagtgattccctgacacaggataaagctaactggagaagtttttcgttctgtgtcctttcctctgcttcagaggtcactttgcatttgagttctccttaggctttcatttgaaactgcatgggatcacagtgattatcaggaaatgaaagatccaaccaatgatgaaatgtcatttagcattcttgctgattgtcttcccctcaccaccaacaaaaaaaaaaagtgtctcttatggagacgctgtcaatttatgctcaacatttgaaaacatattggcctaagaaaagggttctcacatttcagtcacaaattttattcacagctagggagttactgaatacagctacttagtctgcagaagaaaaggctgaaaagtaactgagtagttttatgctttttgagacaaccaagacatcaggtcacatcttatcttaacatgctacaacaaaaaggcacaagacaatgtctagaaattaatatgtactttttagtcaacattaaaaggaaattagagaaatattatgcagccttaaaaaggaaagcaatcctgacacattgctgctaatggataaattttgaagacattacgctaactgaaataaaccagtcaaagaaggatacacattttatgatttcacttatataaggtacctagaatagttaaattcatacagacagaaagcagaatgctggtaggcaggagtttagagagagggaggaatgaggatttattgtttaatggtatggagtttcagtttgggaaaatgaaaaaaattggagacggatagtagcaatgattgcacagcaatgtgtatccacttaatacctctgaactgtacacttaaaatggttaaagtagcaacttttgtgttatgtatttggcaacaatttttaaaaaataaaaataagaggaaatgggcaggagatagttagatattggagaattgtgagaggaatggaatcagaacaggaagcaaacatttgcttagccactgctcactctgtaatgtccataattctaagctcaaagctcctcctgtcatccctagccccacagattctggtctcctctttgactgagataggtacagggaagcagtctgagctccactgtggattgcccagacacaaaccaagtgttgcttattttgccttaaaatgctgcaggattgagcttgacattctcctgtcattgcctttttctctttaggtcccattgaagcaaagcaggaagccactcttaaagagacaaagaaatttggagtagcccagtacactcagagtctaatttcttgacctttgtgggaaacaaactagattccatttaattatacagtagtctcattgaaaacagacctcagaatgtgtattactcaagtattgtttgtggaccacatcttgaaaattgcctatctaaactactcacaaaaagaccaaggccattcagagcttttcaaaggaaggtcattaactgtgttccagaattatcttccattttgctgatactcaaatcagagcaaatcatctaattcggtgaagaatagatctagtaccggtatcaggatgatggtctcgatacagaacttctcatctccaaaaatgatgataaaagacgatatgaaggagttgaagtacagggagttttgctataatatttgtttgaaaccatgaattctgttgcaaagtaattgatatactattgaataatttataaatagcataaattttcagtattcttacacataaattcatctggaaaaacattagttgagcacaaaacactcacctccatgaacccagctgaacagacacatgcaacaccccactcccaaaacaaacacacacacacacacacacagacatacacacacatctgagtattaccttggttcaccagtcatcatggtccatccatatctagtgttaacaatgttctgtatgatttcagatcaccctccctctactccttcacattaatgcacatgctgtaatccttccaaagcccacttccacaagcaaatatcaagtcttcttcaagacgaactgccacgtttatgatagtatttatatagtttttaatggtttaatttatgtaaaattatgctactgttttattaagatcctattttttaaatgcgtctatgatgaaaaaattttagtgctacacaccaaccccagttttttcataagccctagggtttctattgtgtaattaagtgtactacagtgatttttaggcatacatatgtattagagaagaagtgattgtattgtgtaagtttgtgtcacagcattactctctattgattcacagtgcaaagaaaatgtgccttctttatctctaatggcccatagtatattttttttcatgaggtctccacttgcaaggtagcatataagattttactctcatgaagtatctcttattttataaagaaatggccttctaggccctctcctcaagaatctcaaacagaaactgggaaaactgtaattttgtctttggctttgttctagtcattggacctaatgtgtatagatctcactatctatccagtgcttccatccctgtctcctttccatatcccttgggcctaaaagtatatgactttcattcctgtgtttttttagcctggacttctcttacatattattccccttccaaggacagctagcatcatggttcagccagattgatgcaagcaataggcactccaggctatggaagaacctatgattgagttgcagggtatctcttgatattaactaggataaagaattggaggaaattctttcatctctcaacaaagcctggctttaaagattatgttttaccttcagtctcaaaaatcctacactggatatcaaaatttaaaagttgattgtttctttttgcattcctgcaataacaatttgaattctctccaaagacagaagatgcctgtcacaggatggggaaaatcacttgagaggaaatgtaaaaaatagcaaaaacaatcaatgttttccaacagatattagctctatcacatatactatatgaccctcttctctttgagttggcataggtactacattttatatgatacttaaaaatataaacattgaaaaacataaaactgaaattttagtaatgtttaaagcatattgagaaaaatctcaccttcctgaaattctcagattcatgtcagaaaattttgcttgtgtaattttctaccctagaaagagcatagccatttcttcatcacatcaaacccaagtacagtatttggtaaagaggaaataagagaatcagtcatggtccatgaagagaagtcctgtgacctttctagtgtattggactataccaccaaactttactcttgaaatacatattttctcgtaacttgtgagtagaaaaataaatatttatttcataataagaaattacatacaaatgttccactattcccctaagatagttcaacatgaaactagccccatgcataaagttgaagaaatatggaagaaatttgttggagtagacttaaatttcaaatacttaataataaagtcatttaaaataattaatacaatttacttaataaccaaatattatgctactatttaagatgcttactgtctaagttttttatgtagataatgtaaggaaagttactttatgtaaattaatattcaatttattaaagttatacattcaagtcttttcttaggttaggttcaattaattgcaaattaatgatcacatatttatctggaagagtaggaataataagcattgtactctgtaacaaaattaatacaaaagattattttatctgagcataaaaaaagtctgcaagagataaattttcagtgaaaatataccatatgtccagttaaaattagactgtgaagaataagttgaagaatccaatatttctttaaaattgttaggagtatgtttaaacagaaggcatgattgttttctcttttaatgcttttctgaattttgatacccttactctgcagcatccagcagaatgttttatgtaaaaaaaaaatggtgctaataagtgtgtgtggagaaaatgaataaaaatatttttattggaaaaaatatttagattcatcttacatgattttttaaaaccaatttatacattaggtaattgttttgaaataagagcaatacaatgtctcctttgactaacgttcaaattaattttaagagattgaatttctctatatagttaatctcatttacagagagttaattatattatcttaaacacttatgacattaaatatgtaactttagtacatctgattatctcaccattttaaatgtcggaaagtgcagacaagcctagcatacagtcttcctaagaacataagcagttcttgtaaagatttctaaattttatttattacttcagataactcaaataaactaaagcgattacactatatatttttaagttgaacagaaaaataataatagtgacttgacttaatttattatctctctaattatttgttaattttttcaaggttttacacatacttaggaaaagagttactattttagacagaatctaaatcatgtgatagacatttgtcacttaatcacatatttgagccacaccccccaaaaaaataacctgggaccttacattctttcggattcaaaccaagttacaagtaaataccctgaaactttttgtagttggtttctatctgcttgttcaaaaacagaagccaaatccatatatttctgttgggaattagttttgtaagttggtgaatcacttgtctcctttgtcaagtgtcatcttaatactttttaaactgcttttagctgtttgggtaggaaggtagaattcttaggttgcaggtatattccagcaccacttgaattaatttatttaatcttactaactgaaaggattcttcattcttttcatattattttctcttttgactcttggccatgattcaacagagagtatatgaatacaagcatatatttgaaggtaggaatggtaggtctgtagtggaatgttaagcacaattgacctaattgtcaaataaaatgtgcagctttcagttgacatggtatgagcttgaatgatatttggataatatggatgaaagatggataagataggagagtagcagctcagatgaaaaatgggaagatctaattcaagcctggctcttgtatttaatctttggaagatctctcaaggacaagatgatctattgtaatcctgccccattttcctaattctgaaattctttgagttacttaaaaaacaaaggaagctatatattgtcttgaaagtttttgaagccagtaactactattgcaaaagatgaagctaacagtaaaacatctctttcttatgttatcatgctacctgaatgattcactttaaatagatttactttgtatcttaacttcaaactatgctaatatttaatccttgaccagaaccttggaatcttatattggttgaatgcaaatatttactaattagatttatgtacccataatcaacattttctaaatacttttaccaacacatgatgttactatttaacctaatgattatattttgatgtaggttttgatccaatgaaaaatatcaacgagccggcatttccccatcttctcttgttttgtttatgtcctttgtctcttttctactttccttggcaactaaagttcccctaacaccttcttatctgcaattaacttgatcatatttgtttttgctactttctgaaaagagaattttctgtaatggcagcagcactactctgagaattgaattccacattaagttaacctctctgttgtcaaaaaattaaagtactaaagtgtttaaaaaaaacttacatcacaaatgttcaaaaaatgcagattgaaatccagacacaggaatcctttgatgatagataattggaattactgtaaaaaaataagtattattacctttttccaatggttctcagcctaaacactgttattgttgaaaccttttcactttttatccacattattctaatagtgtctgaactgatctctctgcctgatatatttgcttgtaccaattttttttatagacttctggccatatggctttgccttaaatgcaattctgcacctattacactccttttgagtctagtattcatttgtttcacaagtcacttgggagcacctactacatgctgagaatctggcattttctcttaggagaagtcaccaataaatacaatattccacatactatgaaagaggtaaacctaaacatcatagacaagggttcctcgccaagaagtcaggaacaagtgtcccctagaagtgatagcaaaactcagttgaatgagtcagacaaaaatccacaggacataaattagtaagagaaagaatgtagcattgggagagggaaggatctatgtgaagcaggttcactgtgcactggttaccaatttgtctgagtctagggagacaacacatttataagcaacaggcagatgtatcacttacagataggcagcaagaaacaacagaagcccaagatttattgtgagctgaattcaattctgtgaacagaagtccaacattcattgtaagtcagaaagctgcccagggaagatgagctctgggctgctcatggccccacttgaaccacagatgtggaaccctgagaggcagctcatcctggcttatataccttggggtcacataaatcactgagctaaattattgaagggcattctgctctgggagaagcctggaacagaacctagctgctccagccagttagctttatctcaggatgctgcactctcagcacactctgtgattattcttaagaattacacataagaaaggggaaagaactgggtcactccagagccagccagaaaactgtcctgcaatctgtagtacagtaaaagccttgttactttacataatcaggaccagtttctgattaaagagttaaagagaagaattatttcttttacaaaaagatacatcagtcttgtattggatacagattaggcaacaaaacaaaatacagcggtttttaacaagatagaaactacctttacacattagtctgaacgcaacctatctaagaatgatgtggtaacttttgtaaagacccaggtgctttctataaagctgttgtttttaccccttgtgtgatggcctctggctcctggttgaagatgatcaatcagccattccagagggagtgttgtccacctgctctcatgccccctaccatggtttgaatatttgcccccttctgaactcatgttgaaatgtaatcctcaatttgccagtactgagagatgggcatttaagaggaaataagattatgaggtttgtgctcttatgaatggactaatttattcgtagattaatgaattaataggttagtgaattaatgggttattatggaagtgggactgatggctgtatgagaagaggaagggagacctgacctagcatgctcagcccccttaccatgtgatggcctgtaccacctcaagactgtgcatagggtccccactagcaagaaggcccccaccagatgtggccccttgaccttggacttctcagcctccataactgtaagaaataaattatttttcttcatactttacctagtttcatgtattctattataagcaacagaaaatgaactaagactccctctttttcttccctgcatttatcttgctgatgtggggaggataggaaagaaagtgactatagtcactgtctttgtacatacctgctcttgagaaactgttagtcctttatcggccatatcactgtgcttttcacctatttcctgtgaccatgataagtatgagtgatggctttagcaggctcccttgacaagttggtcagcctctggagacactggggctttagtctgacacccagttggtaaacatccctcaaaaatgctctggtttatgctttttttttagactgagtctcattctatcacccaggctagggtgcagtggcatgatcttggctcactgcaacctccgcctcccaggttcaagcagttctcctgcctcagcctcccaagtagctgggattatatgcatgtaccaccatgcctggctaatttttgcatttttagtagagacggggtttcaccatgttggccaggctggtcttgaactcctgaccataggtgatccacccaccttgacctcccaaagtgctgggattacaggcgtgaaccaccacgcctggcctggtttatgcatttttttgtccccaagatgatatggtttggatttgtgtgtctgcccaaatctcatgtcaaattgtaatacccattattggaggtggggactggtgggaggtgactggatcatgggggtggatttctccctttggtgctgttctcatgacagagttcttacaagatatgatgaagtatgtagcacctccccacaaccttcctcctgcctggccatatgaaatcctgactgccccctttgccctgtgccaagattgaaagtttcctgaggcctcccaagaagcacatgccagtatcatgcttcctgtacagcctgtggaaccatgagccaattaaatctcttttcttcataaattacccagtctcaggtagttgtttatagcaatgtgagaacagactaatatagaaaattggtactgagaagtggggcattgctataaagatatctgaacatgtggaagcagctttggaacaggcagaggtcggaacagattggagggctcaacagaagacaggaagatgagggaaggtttggaatttcctagagacttgtcatatcactatcagaaatgctgatagtgatatggacgatgaagtccaggctaaggaggtctcagatggagatgaggagcttattgggaagtggagcaaaggtcactcttgttatgtattagcaaagaatctggcagcattgtgctcctgctctagggatctgcggaactttgaacttgagagtgatgacttaggttatctggcagaagaaaattctaagccacaaagcattcacagtgacctggctgcttctaaccacctatgcttgtatgtgtgagcaaagaagttacctgaaactggaacttatatttaaaagggaagcagagcataaaatttgaaaaatttgcaacctggatatatggtagaaaagaaaagcccattttcagtggaggaattcaagcaggctgcagaaatttgcataactaaaaggaaggcaagtgctgatagccaagacaatgggaaaaaggcctcaaagccatttcagagagctttgcagcagttcctcccactagggaggaggtaaacatgatttcaaagtacaggcccagggcccagttcccctgtgcagcctgggaacactgctccctgcttcccagctgctccatctccagcagtagctgaaagggtcccaggtacagcttgggccactgcttcaaagggtgaaaaccataagctttggcagtttacatgtgataataagcctgcaggtacatggaatataaaagttgaaacttgggagcctctgcctagatttcaacggatgtatggaaaagcctggatgtccaggcagaatactgctgcagggctggagccctcatggagaacctctactaggacagtgtaaaggggcaataagtccccactaaagcactgcttagtggagctgtgagatgaaggccactgccctccagcccccagaatggtagatccactggcagcttgcattgtgtgcctggaaaacccatgggcactcagttccagcccctgagagcagccatgacaacaggggcaaaactgtccaaagccttggaaatccaccccttgcatcagtgtaccctgaatgtgggacatggagtcaaaggagattattttggagttttaagattaatgaattccctgctggctttcagaattgcagggggcctgtggcttctttcttttggccaatttctcccttttggaatggcaatgtttacccaactcttgtaactccattgtactttgaaagtatctaacttgatctttattttacaggctcataggcagaagggacttgccttgtctcagataagactttggaccttggacttttgagttaatgctagaatgggttaagactttgggagactgttgggaaggtatgattatattttgcaatgtgaggttgtgagatttgggaggggcctaggcagaatgataagatttgagtttgtgtccctgcccaaatctcatgtcgaaatgtaattcccagtgttagagatggggcctggtgggcagtgcctggatcatggggatggcagatttccccctttggtgctattctcataataaaagttctcatgagatctgattgtttaaaagtgtatggcacctcttccccaccctttctcctattccagccaggtgaagtgctggctccccatttgccttctgccatgattgaaagtttcttgaggcctccccagaagcatgctagcatcatgccccctgtacagccaattaaaccgcttttccttataaattaccaaatgtgaggtaatgtctttataacaatgtgagaatatctcatagtggttttgatttgcatttctctgatggctagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcacagaagctctttagtttaattagatcccatttgtcaattttgccttttgttgccattgcttttggtgttttggacatgaagtccttgcccacaatgtgcacatgtaccctaaaacttaaagtataataataaaaaaaaaaaatgtgagaatagactaatataccaggttgaacaatttttggcaagtctattgctaccaattacaattttccttcatagataactcatgctggttgtaggtgggcccaggaggaatctgtcctctatacctctctggaattattaattcatactggtgattcttgtccctctctacttagacattccactttgccctctcctcagtttcctttcacttctccaggtagcatcagataagctgcaagattaagtataaatgcaatggtggaactgactatcagtctttctttcatgttgaaatcctcatacttgaagagtgtttttctaaggatcctgcccttggcaggatgttcaccagttgggtaccattctctcctttttcagtgtagagatgaaaggagaggacagttcacaactattgcatgctctcaaaaggcaacttttcacatccaatacctcctcttttactgaatggggacagagagatgaggaggaatgattactgatagatgccaccatgcggtaggtcttgtggggaggtagatggcaataagaagaagaagaacagtaaccattgagtacttatatgccaggttctcttctaagtgttttacacatattaattcatttaattcctccccaaaccactatgaggtggtacaaatttctttttggtagatgtgcttgggtaacttgcccaagtttgcagtcttacaagaagtggagctagaatttgatccaaggcactccagttttaatgcctgtttccatgagcagctatagttatactgatgcttaggtgctatggagcattgagggtcaactgtcaagatgactcaggaagagggcagatatgcaatttgaagtagctgttgaaacatggcaaacacaacatagtatgatgctagagagtggatagatgagaaaataatgctggtgtggcccatcagataaagaagcagtcacatctcctaaaaacagatgctatgtctcacaaaccaaatagcagtctttttgtatatacatggtaggaaaattgttgttaacccgatatcagtgttgtctgccacaaatacacacatgaataacaagctgtcaacagaagcaccttctcaaggcatcaaataaaatgatgtgtagcagttactttaaatctccgtagtcccttttgttcatatttgctgtatcactgtacccacatattcaacaaactctataaccataaataaactggacttcagttcagtcctgtgacatcacataaaatgtttgaattctagacagaattggcaaattgttgtttttacagaatgaatagaatttgcaacatgatcatattagtatgcgtgtgagtgctgtgtctgtataaaagtgccttgttaagtgataagaaatcatctgccaatgttgtttcttaatatttaatcatatatatattaaatatttatacaaaggtgataatagaattatgtggccacagtagaaatacaagagaattctaattctacaatattgtgcctaaaattgtaatccacttaatcatccttcattgcaaatgttttgtaacttgacagctattattaaaaaaggcaaaatgtggcatattgtaaaaaaaaaaaaaatcctcttaccaagtgttcttgacatttgacaatgccattaagctaaaagtatcaaagacagagttttaaatcatgtgaagctgtggttaagctgatcttttccaaaaaggtttacagaaaatgtgttttaacttattgccatgaacaaatggaggcaacctacatttttttgaatttttgagattagtaatatatccataaagtagcagggtcatacattgtctgtaccaatataccatggattatattacccctatggcacctatttctcatcccccccaaaaaaaccaataagattatttgaaatatagagtgataaaatgtttcagacaattttccagatgccgaatttctaagcaaagaaaacaagacacaaagtaaagcaaataacagaggcttgaggtaagcagatataaatttcttcatagatggccatccaaatgaacagaaagagattgtaggatcagtgcaccaaactaccaagacaacttcagtaaatagtttagaacacatagcagcccccactccgtggctaatgataatgaaatcctagtcacaagctgctcctacaattgaaaaatgttgattttgctagctttgaattgtcatctctttaagaataaatattgatgacttagtgccattttaggtagatattttaagaacccactagtaacacacacacctatcttcccaacagccgggctgttaacataataatttatacaacgtcacctgctgatcctggagccccactctgaggagagaagttatgcataattaattatattcatattttaatattcatattgctgattatgattgtcatgatttattatccaaacttcatatgtgaggcaaaagcattataaaagatatgttgtaaaaggtgtttttttttttattagcagaactaattgatttgtagatgaacacttttctttacataatggaagcatattttgattactctgtgaataaaaccacaattactcttctcattttaaaaaggtacaaaattatttgtcttttttgccaatttcttacttgatttagagaccgtgaatgtgaacacaccatttttatttaaaattccctgtcatgctatagcttgcctctctcttaaacagtgataacatgtgtattgacatactaacaagaagaatttgaattaaggaggaaaagaccatctgaaaagaattccatatttctccatgtagaaataaggaactaatctgttatttcttaatatgaataaaatttagagatatttttgataacctatgaatattagattatctgctgttaattaaactcaggcctgatatgatgcctgaaacatcatatgcagcagaagatgccattacaaaatgaaagtacatcatctgtatctactggagtttccttgagatttagcttcaaaaggtaaaaactagttccgatttcacagagaaaataataatggagaccaatttatatacaagtacagtttttcctgttgcaacatttcggtacagacattcattcaaattcttgggaaaaaactgccgatgtgcagtttgtatatctcttatattcatacatggaggagatgatttatatgctagtcaatatttaagctgaatttggggaattctattttagctatgcaggggcggcgaatatgatgtactaacacttccatttaaaagaacttgtgagcactgaatttgtaatctaaatgttagtagaattaaaaagagggatggaggtggaactgggctacctgccatgtaatatagtgtggctagtacatatatttggttagccaaaacaaattaaactcagaaaggaggtaaaagatgctttattgcaatagtcatattcaatctgaaagtcaacataaaagtgtcttagcgtgaatggttattttctttctttaatgaatgtatatggtaggctggaagtcattaagctttaaaaatttagagaatatttctatatggcaaagtaaaaaacctattaattaatctgagtttctggcatgctttgttccattaagtatagacttataggaaaaagcaaaatataggagaaaaaacaacagagagaaaaactagaggttaattgcctttgttgatttccaagtagttttgacagctctgatccattaaaatatgtgtaaaaattgatgaatgtattcttagtaagactgtgttttgagaaggtttttctcaacactgaggttttattccattcgtaatccaaataaaagctgactaaattaaattaatagaaatgtcagcttctgtaagtgtgcattcttatgctaaaaatattgggtaattttctcatagctttccaatggagtttgcacattcacatcagagtttatttggtggaaaggagtaatacctgattagtactttttctttttcttactattttccttctttgggtaggtaaataaaaaccttagagtaattgcatgagttatctattgctgcataacaagttatcccaaaatatcatagcccaaaacaacaaacatttattatttcactatttctgtgggtcaggaacctgagagtagtttacctgaaaggttttgggttagagtctctcctaaggctgccaccaagttgttggttggggctacagtcatgtaaaggtttaggtggaggaggattattctaagttcacctatgtggttgctggtgggccctggttcttcaccacgtggccttcccacagggtgcctgatgacatgacagccagctccctcagatagggggagaaaatgaagggtaaacacaagtgcacccaagatgaaagacaccatctttttatgacctaatctaggaagtgacatcccattttctgtcacattcaattcattagaagagaatcactaagtccaacccacacttaagtggaggtagttaagttctacttcttgaaggaaggctattgtattaattttctattgctgttgcaacaaattaccacaagtttagtaactttaaagactcaaatttagtatcttaaagttctgtagatcagaagtccaacataaaggtattagtagggctatattcctttctggaggctccagggaagaattcattttcttgtcttttccaacttctggcagcctcctgtattcctttccttgtggccccttgttccatattcaaagccaacaatggtgggttgagtctcatatcatggcactatgacctcctcttcttccctcctcttccaaacgtaaagacacttctgattacatgtgaatgtacccagattatccaggtaaatctccctattttaaagtcaatttaatttccctttactttgtaatgtaacatatttacaggttccaggaattggaatgttcacatctttgggggactgttattctttctactacagttgtcaaataatttgtggatatattttttaaacctctacagtaataatgtacctagaatcatcctcctgcccaaatacacacactcaaggtccagtcctttcagaatatttattaaagtctagtggatcactaacccaggtaacaaactgcctgcactagttattcagtatccaaaagagatcaacatccatacctttctctttctcaggtatctatggttgcccagattaagtaagataaaatttttaccttaaagtaggagaaagtaactgggtttagtttaagaaatatatacatctggtgtcagaaagaatttgttataatctgagttttgctagaatactgccatgtggtcttatgcaggttactcatctcttttgcctaaggttttcttacttataaaatgagggaaataatattgatgttgcacagatattgtacagattcatttataattcagaaattgattatttcatcttctctgttgtccaaaatctactgttttataaaatgactgctattgatactgttacgtatctgtgatgtgatctttttcttctaaatcttgaggttactgataaacaatatctttttaaaaacatagtctagacctccaccagtgatttatatgtctcagccctttcaggcaggtacccagcataaacatcaagactcctttttgaggaatcacatgttgccccatttgcctatcttataggccattgctagacatagtaattatgccaaaacccttttaatatttattcataaacaagccccaagctaatttatccatgtacccttagatattatttttcaaactgaaacttctcattgttactaactataaaattaaaaattataaaattgattgttatttgtgaatgacactgtaaatttagtttaaaattcaacattgaagataaaattagattttttttccatgttgatatgaatacaaatttgggtggaacagagcatggtggtaaaaataatgttcttactaaattaggagacctatagaacaaaaatgtacttgaagttggttatgttatacaaataatttattgttgcatccaaagagctgtgatattctaccaattcatacaagcagagatataagtatcacattttataaatattttatgtatatacagtcatgaaacagaaatacaaaaatttttgtgataatctgatattgagacgaaaagaaaatatcagcgtatttccacagaatctatctctttactacctatcacagttggattttaaaaatgtttacatttaccacataaattatttacattttgtttacattttattagaaattagttggaaatctctaatcaaaatgttaagcaaaattcagatttttaagtttgtaaagaatttcagttattaaaagtaaatctcatgaatgaaaagacaaatttattctcataaaagcaaagaagggagtaaataaacattgagagatctgaaggaatacaagatttaatttgaatgccaattattaggctctgaaatatctcaatttgaaggaaaaggttttaatggagcttctatttataattagatagttatcttctgtatcagaatagaatgaaattgagaatgcctgtaactgcatgatatctacatttgctgagacattcagaagaaaattaaaacatttttgacagttttaatcatagaaaatatgttaaaagcactctgtgaatggaggtaaaaagaccacacttataaaaatattggggctaaaatatgtacacatttcactacaaaaatagaatagggaatctcttccatttatcataattggctctcagcttattttcctcagcacctgtgagaggaagtattttctcaattaaaaatgtaatacttacaaagcaaagtcattggaaaagagtcaacaatgtcaaaactattaatgaaaaaatgcaactttaaagacctttaaaattgtatgaaaaattagaaataatacagaaaaattaattttcagaaaaatataactgaccaggatatgatacataagtcaaaaaaactaagcaaagtgtctggaaaatcattcagttcatttatatttaatattcagagagtcaacctaaatttgttttaattacactttaaatatgtttattaaaagaatttatggaacctatagaaccagtgataattacattatccaatgaattaattaaaattttgaaattatataattttaataattttaatgccccctttaactgtaaagtgaccacatagatactaaattgcaagatcatcctaactagaaccttgttcatgaccactttttaccttccacagcaatgttgagtcacagaagctcagataatacactcattaattcattgattaactcattcccatatttaacaaacacttattaagctccatctatgagtcaaatattgttctaggttcattgaatatatttttgagcaaaacaggcaaacatgggagggggtccagtaatatacaacatacataataaattttaaaatagcattgtgtattaggagttataaatcctttggaaaacatacattcaagaacggtaagggggcttatgagtgtgaggagtggtagggagatgacaatttgcaatattaaataggtgagaaggtgacacttgagcaaagatttggaggaatttagggagttagccgtgcattatctatggagagagcaggccaggggagacgaaactgctacagggaagggcaacaaagcaccaggcatgtttgagaggcagcaaggagaccagaatagctaaagaggaataaaggggcagtagcaggatatgagacatgaagggcaagagagggaatgcagtgggatagaaagaggagagatacagatggcgcacttcaaaaatcctctaaacactcttgtttacacaacagctagaagaatttttatctcattggatgttttgtgttcttacttttatattagcttggctttgttattaaatatcatatatcccatttctctcctgtctttggtgaaggatcttagatcttttgtatttccttgatgccttgctctttcaggtttgtattctcagtcaaaagagctctttgaagttttgcttccttatagaattcttaagaatcacatttaatttaatggctttttactttacatatgctcatagacactttatgaaaagaatctttttgaaaataaaatcactaaatatttggtaatttcccaacaaattatataggccttgccataagcaatggattttttaagttaaaaagtcagctttatccacagaatatgatgtttggagtgacagctgaactcagggtcctggcatcactaattattagctgcattaccttgtgcaaataagactttctgaacttcaatatctataactgggaatcaataataagacccacaccacaagatcattgtcagatttttctaaatgtgtgtgaaaatttgatcaactatgaaatgacatacaaatgttaccaaccattattatcatcagtgcattaatatagcattattccattctgagctttagaatggaataattagaaaagcatttttcaaatgtctttcctgaaagctttattcttctgctcagaattcctagtattctcttttcaaaacatcttaaaacaataaaatatttaaagatataattgaaggaaaagatttaagctaaatgtgttatattctagggttgtatacttctctccacatgaaacacatttagtttcctaacattagctctggcatttcattatatttatgaattataaaatacctcacatagcagcctcggttttttaaatgtggaatacaaagtcatcacaaaaaggacctaagaaaattaagtccatatatacgcgtatgaaaagagagaaatgagaaaagtgaaggaacaagaaaagaaataccaaaatcttggggtctcctttgcttcaccaaggtaaaacctgagagttctcaaggaaactgatgatcccgactttctgttggttgaatgttaccaacaggatattctttaaggaatgttttgtcctcaagtatgaaactaaataaactcttgggatgcaatgaaattaatagtgctaagtctgttcactaatgatgaatatatagctgagatttttcaccatgtgatttttagtcttgattttcttaacagttgtattcaccgttgatgtcaataatcactgagcatatttgtcaaattgttaagcaaagttctaaacatattcaggaggctactggtgaacacttgtctggattttcttctattcattgggtttctataggctttatctcttgataaaatatacctccttcatttttaacttttgtagagagaaagatgttcatggaatatagaaaatattttttcagaaaacttattcaagataacagaggacacaaaataactttttttaaaatccaaattataagctttaggaattaagtaaatacaaacttgttaattaacggcattatcatttcgtgtttgctttgtatcctatatgaaacgtgcttctgttctcagctaaaatttttagactagacatagatgaagcatgcaccaaagccacaaggattcgtcaactttcatggccacttatgcttcaaggcaaatcaaaggtgttttgacaattagctaatagaacaaacaaacaaaagaacagagacagatctctatgactcaactgatagagctgaggcatttgccgagtttcctggtagatgtggttcgataaaacgtctaacgttagaatctgtgtcttgggaagaaaccacctcatataccaagaacgaaccctgagggtggtctcactgatagttctcagtgtactgccatgttcccaaagtgtgaaggctacatctttattatgatgcctgttacattttctatagttagcggcaggtttgcttttctctgtgatatccttgagcatacaaaaatgttcatgtttgtttacccaaactttagcatggcaccgggcatatgttgtatgttcaaataattatttgatcaatgaaaatgaatgctccctgacattttaattttattcctaatataacctttgaatgaaatatataataaatatagaaaggcatccaaatatatatgtgctttttttcacttcagtttctattagggaaaaaacagtctaaatctaaataagtcacatacaatgatcaagcttaccaaataactagtaagaagttcaagtttccactttgatttgcccttgcagacacagcctgggagcatggagaattttctggtaacaaatgggaatctggccaaccaatgatctctacattagcattctaataaccagaggccaacgtgccatagtgctgtgtcagaactaatttatgaaactaggtccaaaggctcattaaaatggtcacaattcagtgactgcccagtaaaattagactacagtttcattcttataacaccgaatattttaacatactattaaggacatacttcaagtgttaaaactagctttgatgctgtgaagggaaaaacaacaacattagaaagctatttacttttgtagaagattggctccaatctcagattttcgctcaaaatgctacaaatgtccatattttagagccctgggtgtgctgtacttgcttttgcaactctggtacatttgtgggtttttttgttttgttttgtttcctcagagtaaaagcactgctgtgtagctcttgtaaaccacagggctgtgaacccacctggccaggaaattgcaggcagcacagttgggagttgaattttcttctcctctgctgccagacagatctctctacagcactcctttaatcatgcatcctcccctgtgatgccagagctcctgggacacagagtgcattgctttacaggctgctttccacagccaaactgggtttgagtggcatagaaggtgtgacattcaaaatcttatgaagaacaaggagaggtagtggggaaagttctagattaggagtctggtgcagctgcagttcaatctgctgctaactctcagacagtcctgtctgctgctggggcagggtatcacctcttttgctggttcaatgcttggcacgtgggctttgctcaataggaaaggtggttatagtgaactgaactaacagtacaaataagaaagccatttaatttctcagtatctcaaacatctatatatacgaagtgggaagaatggctcctgctgtgcttatttcacagggttgttctgaggatctcaactaataataactaccaaaacactttttggtggtatggtgcttatacttgggtaatgtatggttatgtccgttcacttgtcaaacataacagactgttttctttatctcctgaatttttattcaatggaacagtaatgaatccctaaatcttctaaatgtgaacagtaaaagagacagaatgacttttcctggcagtctgcatgccatgactgaattatttagacttctatttaaacctgatgaggaaaaaaaaaaaaccctaagaataaagatttgtcttttaaccaattatttcagaaaaatgtttcttttagacttattcacatttagaagatactattgatagtgtggatgtcctattataaattagataccatttccatatcaaagttaaatatatctgaaaaatgacagagccagcagggattgctagtggtagagtaagttgcaaatgtcagtttattgtagcagtgtaaattatatttaatttaaaagactacgtttaacttttaaaatgagggtactccaagttgaatccatggcaaataaataaatataaaatattttcctaaacatgtcagggtatctcataaagcagtatcctagaggagctctgatttgctggatgctaatagatatatcgtccaaaatatcctaaattcatgtatatgtaagaacatttgagttaaatgcaagtgaatctttttttgcagttttatctgttaagtgtaaatagccaagaaaaggatataatgtagcatttttactaacagttttactgtgataaatttgtttcacgatacctaataacatctcccagccaggcgtggtggctcacacctgtaatcctagcactttgggaggccaaggtgggtggatcacgagttcaggagatcaagaccatcctggctaacacggtgaaaccccatctctactaaaataaataaataaataaataaataaataaataaataaataaaattagccaggcatggtggcacacgcctgtaatcccagctacttgggaggctgtggcaggagaatagcttgaacccgagaggcagaggttgcagtgagctgagatcgcgccactgcactccagcctggcgacagagtgagactgtctcaaaaaaaaaaaaaaaaaaaaaaaaaaaactcccaaaacattgttctgataaacaccattttataaaatgtgttggcaacatgtgtttggttagacttactggagcccaaagttatgccttttggtctgtataaatttaattaacaatagacttattgagcatctattgcataaacaacagtgcgtggggtgctgaagggcataagaaactgagtgaaattatgactgccctttagaagtccaaagtcaaagggcacccatactcagtgtcatggaaatggtataataaagtaggtgcgaggtgggagagtcacatctatttgggtgcagaattgaaagtatcttcccaagagtcaaaagcatgaaataatagaaatccattgtgatcacctttaatagtatgcttacaaagattggtcaaataaatgtagttacatggctggttagtattctggtggatgacactttggaatagcacccgtctccatttgcttcatctcatttgcctcaagttagaataggttcagctcattgacttttttcagttccataagtttatagttatatctgtcacggcatcatggtattgcttattcagttttaaattaaagaagaaacaaaaattggctaaatttttgagagcagttaatacatttttaattaacttactgtgaaaagatacagttagtagcccaacaggatatttttcaattgtttgaacctgaggtttaatatcagagggataattttggagcaaattttactttttttatacttttttcatgctaacttgaaatattgaaacttcagaatgagatgggtctattctctgcttagagagaatcatgacaaaatgcaaatggcccttctcccttcaagtgggggcgtgccaggcatcaattagccacaggtagagttctcttaacctgtggtttgttctcttctgctttatccctatggctggaatggagtgagagtagctagcttctccacgcagatgtgatgtgtagtgcacccaaacataaataagtcttatcaaaagaattcatttaaatggtgcctgtttggttttatcaatcctcactcagaagaacataattctaatagccagataacaacgtggaccagcctggtatataggcatctgtaaaggtacttctgcacaatgactacaaatttaactaggctttttgaaatatgccaaaagcatttattgggagtgattaaacccacatcatttcttgagaacagtttaagagctctgaacgttgatattttgtataaatctctttgtaaatccagaaaacaaagaaataacaccttactttttgtgtctcatgttttactacaaagcccctagcttatgagagcgtagaaaattgaaccttggtcattcttccatttactctactttgtgagtaacttacacagtgccaggataatcagggaacaaaacctcaggagacttctctgttgttggtgaccacagagttactgctaggatgccatactgtgtgtctggtcccttcaaggccaacagctcttgaggcatgagaacctaagccttggcttccaatgaagctggattgtcctgaatacccaattaatcttgtatttataaagttcaatacaaagggactgctcgttcattcgaatcttggcaaagcttatgttcactatgattacctgagctctttgcccactgtaccctcctccatggaatcctttctgcccctttcacccttctccctgtctactaaaaccaggttttagatgataaacaacatagcactgcagaatatgtaaatatgcatacagatatccttcacttaggatggggctgcatcccaaaaagcccagggtaagttcaaaacgctataaattgaaagtgtgtggctgactaggagctatggctcacttccactgcccagcaaagcgagagaagtatagtttctacagaatgcaaattgctttcctaccattaaaaactcaaaaatcgttaagtcgaactgtcataactcggcgaccatctgtatttaagcataaatttccatacatccaaaagaaaattctgcatttgaacacgtttcattgtatataagtggcaaagtattttctttggcattttttaatacctttgaaaggaggttaatgtgtggaaatactgagtttaacaacatttcatgaaaggtttttcattgtatgaatatgctgtcaatctaagtgtgttttcagaatcactgacagtatattatttttaagaacaagataaatgctacaatattttgtcaataaacttaagtctcaagctttttatttattgatgagaataattttacatgttcattttatgtcattaagtctaagctagaaatatataaaagatgtctgatgatattttcatgcgcatgtgccctctaccatcattacagagcttaaaaaacttgtagaaatctgtttttattttacatgctttttttgttacaactgtgtcacatctaaaagattcagacagcctcgatctggctgtgccttattctaagtcatacaagagtcactattttcctgagtgattcttgggtctttcctctactcagaaccctaaattacatcccactcaaatcagctttgaagctctaatggggtttctaatgatcttctcacacccaataatccacccacaacatgttctcttttcttaaatataccagctcacaatctgctaaaaccacttgttcactaaaacctaatgtctctggcccagcacggtggctcacacctctgtaatcctagcactgtgggaagccgaggctggaggatcacttgaggtcaggagttggagaccagtctggctaacatggtgaaaccctgtctctgctaaaaatacaaaaattagtagggcagggtggtaggtgactgcaattccagctacttgggaggctgaggcaggagaatcacttgaacccaggaggcagaagttgcagtgagccatgggcgacagagtgagactctgtctcagagaaaaacaaaaacaaacaaaaaaaccctattttctctgatgtgaatatttatcaacacataatttacagttttcattcctattttcttaaattccttattagttataaattacatacagaataaagtaagtaagttatgaggaataatgctgtaatttacagccatgctcttaccacccaatttaagaaatactaccttactattaactttaatgtcttctgggtgtcgtttccaagtcccacactttttctactcctttagaggtaaacttcatcctgaattccttgtttatctctgccttctttttttagaaaaatgtttatttccataggttttggcgaacaggtggtatttggttacataaattctttggtggtgatttgagagaatctgatgcacccaccaccctagcagtatacactaaacccaatttttagtcttttacccttcaccccctcccaccttttcccccgagtccccaaagtccattgtatcattcttatgccttcatatctccatagcttagctcccacttatgagtgagaacacacgatgtttggttttctattcctgtgttgctttacttagaataacagcctccagttccatccagattgctgcaaatggcagtaatttgttcctttttatggctgagtagtagtccatcatatatatatacacaccataatttctttattcacttgctgattgatgggcctttgggctcgttccatatttttgcaattgtgaattgtgctgctataaatatgcacgtgcaagtatctttttcgtataatgacttcttttcctctgggtagatacccagtagtggggctgctggatcaaatggtagttctacttttagtttcttaaggaatcaccacactgttttccatagggttgtactagtttacattcccccaccagtgtagaagtgttccctttttaccagattcatgccaacattcattattttttgatttttttattatggccattctcatgggggtaaggtggtatagcaccgtggttttgatttgcatttccctgatcattagtgaagttgagcattttttcaaatgtttgttggtcatttgtatatcttcttttgagaattgtttattcatatgcttagcccactttttgatgtgattatttgtttttttcttgctaatttgtttgagttctttgtagattctcgattttagtcctttgacagatgtataaattgtgaagattttctcccactctgtgggttgtctgtttactctgctgtttcttttgctgcacagaagcttttttttctagttttatcccatgtatttttctttttatacaatatatcattcaattttgcaattaaatttacatgaaagaattcatactgtcagtatttttccagggcattatttttgttcagtgttaggtttctgaggttatcaatatttcaatatttcctatggccctaattcattttctctctctctctctgtctctgtcatttctctactgttgtatagtattccttttggtaaatatgctaccatttgtttatcctattaaaaatacaatgggtatttgtgttttttccaggaatcttttcaattccaatgtactacaatgaacaaacttgtatataccgtatggtacacatgtgtaaaaggttttttaagtgtgtacttcctggatcacagagtttgaacattttaagtttattagaaactgatgaattatttttcaaaatagtttttaccatgtacatttatatctgcattctacacaaattctatttgctcagaaatgccagcatttgatattaccaggctttgtaaaatgtaaattcaatgggttttatttgtatctcatgatgttttaacttgcatttcccactactaatgaggttgagcattttttcatgtgtttattcaccactcatgttttcccttgtgtaaagtgcttttactaggctttttattaattttctatttggtgttttgactctctttactatgatatgcatgagtttcctatatattcaagaaacaaatcctttgtcaaatttatggttcttttcactgtctttatgtggctttttatgaccagaaattcttaattttaatgaagcagaatttatcaattttgtattttaaggttagcgattttttatgtctggtttaagattatcctcccatattcttagctcaaaaagatattctattttattgctttctaaacattttatattttttcctttcatatttaggcaatagtaattgatttttttggtatggtgtaggtagatgttcaatttcatatttgtccttgtggataaccaatcattccatcattatttatttaagaatcagtctttccctcactgatctgctatgtcggctccatgtgtttatatatgtcaattgtatgcatgtacagttttgtcatatatacgtgtgtgtatttcatgttcattggtccctttcctatctctctaccattactacagccttaattaccacagctttaaaataaatattgataaggcaactttaccaacttcataccttttttccaagtgtatcatggctatgtttggcctttgttctattgtacaaattcagaatcagcttgtcaagcttcaggcatatacataaaaaatattggggattttattggaattacatggaatccataattatcttgaagataactgacatatttattatattgagtcttctaatttttctgtttatataaggtaactgtaaaatttttcaatacagttttataatttttttcattaaggtctttcaagtgttgtaatagattaccccttaatactttgtcttttatagtatgtaaataatatactttagactgtattttatacatatgattgttgtatagagatatacaattgaattttgtatactggctttgcattcaataaacttattaaactctcttattaattgtaataatctgtggatgctttacaattttttacatgaacccacatatcatcagcaattagtgacagttttatttcttctctctcatttctaaaattgctttcctgtcttactgcactgactaggacatctagtacaatattatataaagtttaatatagtgggtgtccttttaaattatctgatcttaaagcaagtgtgcccaatgtctcactagacatcatttcttgaagcattaggtataatgtttaatatagatttttgtaaatcttctttattaagtaaggaatttttcttctcttcctagttgctaaggcttttgtcacatatttgtcacctatgttgaatcagatgattttatgtctcacattctttaacctgggcatagtgacctgtgcccgctgaaccacaaggatgtaaaaactaaaactcatgttctggcagcaacaagtatctttaaggaacaagccaggtgcagtgttctttttccatttgatttcctgtttccactcaggtggaatgttcttcaaatcccttactttcttgctagttttatgttgcattctttaaaaggatacatttatattttatccagaatttttggttgttttcagtggtggatagctcagtgtatttagtccactgtgcaagaaatagaagttttccctttcctttctgtcaaaataatatccctcatttcttgaagcacatctcctttagatttccctttctatcatcatttggaaattttaactttgttcaatctagttatttatattactttccaaaccttctcctcccaactttccaatttcttaacagttttacatatttctttaagattgaggttggtcagttgtatgcatagactgttttgtcacatacttaaacctctttttgtgtatcccagagacaataatattttcagtttatgaaggcaaagtatgtgctctcttctcattttgacaaccttggaattcaataactacatattccagttgctgagtgcattttgttgctcctttagtaaacctggtatgatttatgatcaaatccttctagcttccttttctatataaatggaaaatatatcataggaaatttaataagtcctcctatgaacagaactctatttcatacaaatgtttatgcatactgaaaaattcttagcgaaaaatgaaaatcagaagaacatttcattctctttttgtttcatgaagcatttctggccagtcacagcggctcacacctataatcccaacacttcgggaggctgaggcaggagaattgcttgaggccagaagtttgagacagcctgggcctcctagccagacctcatttctacagaaaattttaaaaattagccaggcatagtggcacatgcctgtagtcctagctacttcagaggcagaggaaggaggattgtttgagaccaggagttcaaggttacagtgagcaacgatttccccactgcactccagcctgggcgacagagcaaaaccctgtcttttagggaaaaaagaaaagcatttttgattctcctcactttgctcaacattttgattgtttatagtactcatcgttttctaatatggtatatagtttttaattattatgtttgtttctcactgtcttcccccagtaaaatgtaagttccacaagggcagagatataatctgttttgtgcatgacatatcccaaacagtgcctgacatagagtaaatgctcaataaacatatgttgaatgaatcaatggtgtacaatatttgcataaacaaatagtaaaaagaaaaataaaagttcatgatttacttttctcagatggtttcgtattttcttaatcagtactgttttattttatgctttcagatatcaacatggcaggagagcccaaaccatacagaccaaaacctggaaacaagaggcccctttctgcactttacaggtaagtagataagcactgttttactctatatattagtgaaattttcttgcagctttataaggcaatataacttgtaaggcatccactatttaaaataataatccttattggaataaagtacaacaaatgttgttggtcaacatataaatatatcttgctgcattggcaaggatctcaatgcctaaccttctcatatctgcttatacaacccttctacgagatacttatctaataaaaatcactaatgactctacctgacaagtaggtggaaaggccaatgttggttaactttttttattttattttattttttgagatggagtctctctctgttgcccaggctggagtgcagtggcacaatctcagctcattgcaacttctgcctcccaggttcaagcgattctcctgcctcagcctcccgagaagctgggattgcaggtgcccaccaccacacccagctatcattattattattatttttagtagagacacggtttcaccatgttggccaggttgatctcgaacttctgacctcaggtgatctgcctgtctcagcctcccaaagtgctgggattacaggcatgagccaccacgcccagcccttggttgactattaactgcatgccatgttctttagctattttacatatgttgtttaatttaattttcacaagactcttgcaatgtagatattcctgttctcataatgcagctcaggaacctgagatgcagtttcttagtgattttttcaaggtcacaccactggttaacaatggcaccaatactcaaactcatgccctctgtaccttaaattccactcagtcagtcagccttctttattacaaagtacatgtttctctcatgaccatttttcccagacaacaaatatagtccttctcttctccagagagacagatccaattcctttaacctttcctgaagtgcttgggtctgagtcacttaacactctggtctttcccctctacgtgccccaatttgtcagtgtctatatctatgcggagaatccaggtgaagagatttagcacctttgttgttctgtatatacttctattatgttaagtagaattgagttgattttggggaagagtacaagagtaaacttatataactttcagttctttaagaacagccacttctgaaaaaattatgttctgctgttaaaccatatgtcccacttcatgtgcttttgccattagtttttgtactgtaagtgctgactttgtgtctattgctgtttaattctcttttgttagatatagccaattgttccaggctattgagatctcctgtcatcctatttatttggttttctcccagatacatatcatcagtccatcagtatctgcatctgaagagttaacataaaagtgttgagcaaggcttcctttttctctgatatcatttggataaaggagaattaagttatatgtgttaaaattgattattttctgatttagtatagtaagaagagtgctcaaaaatagcctggagcactttccttgtttttgttctctgaaaactagcatatcttcttttcagccacttatagcctcattttttgaactctaagatgagggtcagaactagatcacttctgaggtcctagtcatgcctagtaccccagggctctctactgtatggtattcagagatttttaaagctatactgaaaaatacatcataatttctcttattttggttgtttttgttttaataaaacattttcttaaaaatggaaagcaatagagtataacaaatgttgatagtgggtcatggggtaatattgacattaaagagcagagatgatgttatcaacaagaagcaaatgacacattctgtaccttgtttgaggtaaaggagatgatttataaaaccgagaaatttttatcagattcatttgtaaatgtatacattagagctgcagctaatgcagaacatttgaaaagtcttattttcaattactgctaaaacaagctgccaatggcttttttttatcatcaaagagttgctactgtctgtgcaatgatgttaattttcatattttctcttttcttggattgttttgattttcttatgagaatggaagctcatgacatgaatgtcattttcactattatttctctattactgttatattcaattgtgttcaaaagaactagaagcagaatttcatttaaatatgctatattgcatacaagccacattagtgagaaagtgcttatttatcctccttttatctgtttacacaaattaaggctgtacactgaaattgcaaaacagtaataaaggggatacaaaaacgtgaatgtatagctgaggaagcccttttatacacattttctcattctcacgtaagcttaagaaaaaaattaccttaattttatgtggacaaactatgctttcatagtcattcacctgttcatcagataactctacaaaattggtagtatatactatgctgtataaatgagaaacctgagtttccaagacaataaagggtttgttcaagacaagatcacaggattaggaaatgtgctcggttttcagccttcacgtctagtattctcaccactagattatagctccctgtatttagtcacttgctaccatctaaacaacacagatagggaaagtagagattttctgagcatcaaaccaatcatcaatactattactgtccatgaataccatgccagcaagtggcagaggaaatactatacaataaacactacataagaaaaaacagatataccacctatctgtgtgatcatagggcacaggttttaagcttcaagtaagtaagttctttttgtaacatagtagttgtataattttcctgagaggatagagttgcataaatgaggtaaaagcatttagttcaatgtagagaatatggtggcggcttggaaaagggatggtttttgctttcctgttctttgcatctctgagtctgtgttttgttttgttttgttttattttgcttttgagacagagtctcaatcggtcgctcaggctggagtgcagtgtcgtgatctcagctcagtgcaagctccgccttccaggttcatgccatacccctgcctcagcctcccgagtagctgggactacaggtgccggccaccacacctggctaattttttgtatttttagtagaggcagcatttcaccgtgttagccaggatagtctcgatctcctgacctcgtgatccgcccacttcggcctcccaaagcgctgggattacaggcgtgagccaccgcacccggcttctgagtctgttttcttatctgtaaaatgcgagagggggactctttttactcggtcattcattcattcatttatacaagatatatttagtgtgtatctactatggtctagggactgtaatagtgcttttctaggaaactagcatagaaaatggcaagaacagggtgaagagagagcataacgtaatgaaagtaagttatttgtatgaaggtagtctctgatttaccttcctgctctaaactgctatgtctctataactattctatttggaccactaagtgaactgccgccagactttcttcttcacgtacatccactttatctccaataccaatcacaaagtggtattcacatgaaatatccactgaggcataactttgatttgtttcttcttttaataggattttcaactcagccaaacaaccttcaataaggccttattatgtgctaagtaaacatggtatacatagaaaataaaacagtgagacttcaaaaagcttacagtcttatgcataagttagatgcacagatgaataaagacaactgagaagtatgcatacacttctgtaagagaataaatgaggaagttactgattctgcctagggagcagggagtaaaaacatctggaaagttaaaggaagaagacaacacttgagctgacttttgaagggaaagagagagggaagggcatctcatagtaggagctaggatagtctaccttgtggggaatggaaaactggggcattatggtgcccaggctgtgaatatatctatatatcaggttaaggagagctgacttttattctgtaggcaacaaggaaccacttaaacatggtgactgatcggaaatggggtgtgaggagagagagtcacaaatatgtccagggttttctagttcaggctactgagggaatgatcacatgagctgaatagaagaaataggaaacacatgataagcaatggcaggctcaggtgtaagatcgaggaaagggagcaaaaaggaattatttcagtcttggacatgaattcataaagacagacaattcattaaaatagcacttgcaataaaaatgtctcccattagagtctatttgtaaatgaaacataattaatcatttgtgaacatttcataaatattggacctggccctaatggtgaatagctaatccattctctagggaaaacattgtaacttttaataaattgctgcttcaaatacgttatgtacattacacaatatctgtggcactctaaaataataattctcccccaggaagtgagttttccagcatgccaactttcaattaatgctcaataattgctaaatgagaataattgtatgatggttttacttctatttgtaaagtagacagacctttcctctttgatggaaagctaacaaaaaatatcagagaacaaagacactatttataagagatgaacaacaatggattttttttcacctagaggtgactcccttctacttgcagggaactcaactcagtaagacatgtagtatatatagtttcatcccattgattctgtaaaaatcaatcatctggtactattgccaaatattgcttttggctatcatacaaatgcctcttgtagcaaccttcccatcccacccagatgaccatgagaatcaagattgtcacaagtcatttcaagagtctttaagattgtcagaagataacctacagttacagccaccattttaagatcatcacaattggtggtggtcaccatgaatgtgggttatattacagtaactccaatgataaaaaataactttcagagcacagaccaagtaaggtgactgcagcaaaatatctccggtgattcattcaccactggacctacgtgagttttgttttcttccttcatggtggctctagcacatcatgggaaaagggacccttgaatcacctaaaatgttccctagaaccttgaaagtagaaatgaaagtaatgtaagctaatttcagctaatgctaaatagcaaaaatcagtatgaaggaaaaacatcctggtcatcttcacttcattgacttatactgtttgctgagaaatgtttaccaattagctattgatcattttattcattttctgtctccttttataacatcaaggataacacacattccctttcagaagcttaatatttccattatcattatctccctttgcactggcaaaggcttccttccatttcacctacccagccagatggttccactcaaactacagtgtgaggaggagagggaaatattttctcctacccgccatattaatacatcctgtccttctgaaactgacacaagcccaaacactgacctgcctccctggtttactttgaatgtatgttattgcttaggtctacatagcaattgcagtctctttctgctcaggatcctatctttcctgtgcaaccaaattactaatgtatggttatcaagatccacaagagaaaataccaaaaacggtgtatatttctaaaactcaaacctgaatatccatacatctgggtaattgagggagagttctctaattcagaaatctccacaaatgaatgttgaaatgcttttgttctagaaaaggggtcaaacattcactttattgattgtttaaatttgtgcaaatgttttatgtgtgcttgttcagtttgcttggtgggaaaaatgttagacatacctcctaaaataacctgagcattatcagtgctttgaatttgatttttttgttcctcagctttttgggctgcataaaggaagatataaaatttcctaaaaggtaatgtatttaaggagcctgcaactattagagatactctacaaattttagttatcctcatcattatgattattcaaagaaaacatctatgataaagtattttaggaggtttttcttgttttttgtttgtttgtttgttttttaagacagggtctcgcttcatcacccaggctggagaacagtgggcgtgatctcagctcactgcaacctccgcctcccaggttcgagtgatcttcccacctcagtctcctgagtagctgggactacaggtgtgtgccaccatacctgtctaattcttttttgtatttttagtagagacaggatttcaccatgttgcccaggctggtctcaaactcccaagcttaagcaatctgcccgcctcagcctcccaaagtgctgggattacaggtgtgagccactgcttccagctttgaaaggttattttatatgtttttagctatgatgatgttgctaaatctcacacagtcaactaaacaggttaatgttttctataacttctttaaaaataaaattttttaaaagattattttacttatagtatgttcctcacattttaacactaagcaaatataacttatagaccttttatttaaaatgttcaaaaaagtgctgacacaatacccattaaatagttctgctgcgggcaattctctctgctaggctaaagaatggcctatttgcagttttctgttatgtttttaatgcatgaatatccattaatatcttctggcatatagaaagaatagagtagaggtagagggagaacttaatgcagagaatccatctctaagacctttgtggtttatgttgctagtcttcaggttatttgaaagactacattactatttgtttggtttgacatagtttatgataaaaatcaaaggaagtaaaaccatgcaatcaattttaaaaggagaaaagtagcaagagtcaataattcagtgggaattgagggaggtgggcaggtaggatcaagcaaatcaagcaaaaatttaattatactaataaaacttatgcagtcacaaagtattacatgagcacaacaaacttagccatgtgattcatggtagtcaaggcgaaaacaggagcaaaataatctatgtaaccatgtagtaaaagaaaatacttgaatatgtgtgagaagaaactatgttttcctaactctgttttctgatgtaaacttattatataggccttcataggaagtcatctaaacagcatagcaggtaccaccttgagtagcatttagacaatacgtgcatgctgtgcacacgcgcgcacacacacacacacacacacacacacacacaggttttaaagctgatgccatttttcttatgaactcaataaaagaatcacacgatattcctttcctttctgcttctcccaaggcagtttactatactgtgacaaatttatcatcctataaaattctaggagtagtgttccatgtagctagatctacagactaggccttcaaattaccacacagctgcatacttggaggagatagaaaggaaaagtgggctgaccccttgcttggcttatccactcagcttctaagtctagaagaaaaagacaatgcttgaatgtctagaacctgtaacagtgaccacttgagctgctacttaagactcctctttctttgaggtagggagaagtggaaaaggaatagtaaaccaagcatgggatagaaagggctgaaatttcacatcattcttacagttggcaggtgccaatgaagacaggcaactgattctttctaactgttggttttactacaccttggaaactgtagcctgtcatgaaattgttgctttcttttatatataaaagcatggttctgtgctgaagctaagatctcttcatcagcaggactcacattatgatcttttatgctatattctcctggcatctcactgtggggtattgcggttagagcaccaacaacagcgctagtccctactggagcttagcaggaacgtgtgcatctcatatgctaggtcattgcgcaagtgctccctgcctgggatgaagatgctttgtgggttttatcttgcaaagggcaatgcccttgcttgcttgtaagttgaagtatcttcattgtcagtgttgatttcatttgttttcattattttatgggtattgttcattgtctttctatccagtgacctgtttcttgttttaggacagtccttagtagagaatgtagggtcttgagcgtccaacctatgataaatttgtaagtccattgtttgttttaattttgaagtgttatctcattccctttgtgctcaccatatcaccttctccttctcaatctatccctgtattcaagattccaggatatgtttttccttccatattactgtatggagggtagcatgaaagaaattgaaatgtctctaaagatttatctctaaatgaatcaaattaaagactaaaaatttttaatgttccagtgttactctctcatcatactgttggggaaatgtaattaaaacaagtattttcccaagtcagaaatcctctccacaaagctaatagagaaagaaaaagcttgtattatcgaataaacattaagccaaaatgtggtgcacatcacaggcaacctaagagactgaagaccgaaagagatcttacctttttatgtagctaaacacatgcaacctattacatacatattttcaatataatcaacaagtagtcctcaagtaagaggattgacagcaccatttgtcatagatccttcattctaactgtttctggtaattggggtgaccatttatttatgttaggtaattgactttatgcaaaagaaaaacaaacttttcatattctcatgaaaggaggtagttctgcaatttggaataagcctcctgcccccactctgcctccccaggtccttgagaaagacattcccaggtcacaaagctgacaaaatgccaatctagtcttcaagtggattcatatgtatttaaaaaagaagatgaagtaattgcaattcacagttttctaaagtaaatccccaaatcaaaaggaagggagggaaatctctttctttattttcaatagggagaattaagccacctgtttttaatttgtatttgtccttggaagcacaaggaagaaaaatcaaggcagaaaaagtgagcaaccagccaggaagtctaaaagctagggctcaggttcaggtttcctgcctccaactctgaaatcattctgtgtttttcttctaattttaggtttttagggttttgtctcatttctttttaaacaatagtacaattggcagtgccatttaaggactgactactgaagattgatggaaagttcctcttttttcacgcattctctggcagttagaaccctgtgctccacctcctggttgctcctctaaagcccctgcagccacatcagggcttcttctataacacagtcttcacacatgcagagatgctttagcagcagacggaccgtgtaacttctaacaatgaaataaatggtaataaacaatttgacaatgtgtagaagaatgtttgagcccatataaaatgaggagaggagagaagaagaaatgaatattaacagtgtagatggacgtgattaatgagaaaccaaacagccctttttcctcggtcatctagtctcactcttacaatgtgaatgattttttaaagacatataaaatcatttacaaaattggcaaattctattacctttgtaaaaatgtatttttccctagtccattaaagtttgaaaatacttattacaaatcataagctagaagactttaggttatataaatatttttaatgttaattatgaacaagttctgcacggtagaaaagtggcttataggttttttaagtgttggttggttttaattatattaattagaaaataatctacaatttccttataaaacttacataaactgtttggtgtctttgtgagagtaattcttctgatggaattataagtactagaagtgaagctagataggcctcctttttccatgtttagacagaaggcaaaagggaacaccacaaagtctcactagattatcagttggctatgcatgatgaatgcttcacacgaaaattcattattttagaagttaattaactgttaaactttctaaatttctttctagtggaattataacatgattgataatttatttttattggtatttccaaatatcacaatacttagggatcttcttccaactctgagagttgacatctattttgcttatgtttattgtatgaaggaatcaaaagacaaggggcttgtttgaaataagcgtattacattggagctgaaactgagatgccacatagtttatgtagagtttgggggtgctttttgttttttataattttaacttttgttttagatgtagggggtacctgagcaggtctgttacctgggtatattgcatgatgatgagagtttatgttttaatatttgtttgacattatctcctcttcccactcagtcctgaagatttcagtgttcattagaagcactggactggaagtcaggaaacctgcaactaagttgtgtatctgctactacctgcccaaactaattaagtgattataaaaaaaaatcaacctctttaagccccattttctcatagtaaaatgaaggagttgaattaaaacacctcttactttatttccatttctaacattctgggattctgctgtttacttcccaatccagagactaaagtcagacatacatgctttattgttaagttaataccttttttccttcaaactcggtgcagtgtcttaaagtattcatgtcttttgactaattccatcctttgaagtatatctaaggagataattttaaatatttttaaaaacatttttaaaaaattaaatttttccaagatgttctttgcagttttatttataatagtgagtaatttatttataatagtgagtaatctgatccaaccaaaatattaagcagtaatgggtatggtgcacctattagatgaaatgttcacaaagtgttaataatgacatgaaaaaacttagcatttgattagagaaaaaaacattttaagttctgggatacatgtacaggacgtgcaggtttgttacataggtaaatgtgtgccatggtagtttgctgcacctatcaacccatcacctaggtattaagcccagcatgcattacctatttattctgatgctctccctctccccacctcaccgcccataggcccgagtgtgttttgttccccacctgtatccatgtgttctcattgttcagctcccacttgtaagtgagaacatgtggtatttggttttctgttcctgtgttagtttgctgaggataatgacttctagctccatccatgtccctgcaaaggatatgatctcatttttttatggcagcatagtattccacagtatacgtataccacatttcttttatctagtctatcattaatgggcatttggtttgattccatgtatttgctattgtgaatggtgctgcaatgaacatatgtgtgcatgtatccttataatagaacgatttctattcctttgggtatatacctagtaatggggttgctgggtcaaatagtatttctggttccaggtctttgaggaatcgccacactgtcttccatgatgtttgaactaatttacattcccaccaacagtgtaaaagagttcttatttctccacagcctcgccagcatctgttgtttcttgtttttttaataactgccattctgactggcatgagatgatatctcattgtggttttgatttgcatttctctaatgaccagtgatgatgagctttattccatgtgttcgctggctgcataaatgtcttcttttgagaagtgtctgttcatgtcctttacctactttttaatagagttgtttgtttttttcttgtaaatttgtttaagttccttgtagattctagatattagacctttgtcagatggttagattgcaaaaattttctcccattctgtaagttgtctgttcactctgataatagttgcttttgctgtgcagaaaatctttagttttatgagaacccatttgtcaattttggcttttgctgtgattgcttttggttaaaaggaattatataaacatcatgaccaaaactacttaacaaataaaatatatgcagagaaaaaaatagagcaaaatattaactgtaattttctttgtatggtgggaatatagataaatttttctttaagcttttttaaaaattatacttcaagttctgtgatacatgtgcagaacatgcaggtttgttacataggtatacacatgctatggtggtttgctgcacccatcaacccgtcatctacattaggtatttctcctaatgcaatccctcccctagccccccacccccaaacagaccccggcgtgtgatgttcccctctctgtgtccatgtgttctcattgtccaactcccacttatgagtgagaacatgcggtgtttggttttctgttcctgtgttagtttgatgagaatgatggtttccagcttcatccatgtccctgcaaaggacatgaactcatcttttttatggctgcatagtattccattgtgtatatgtgccacattatctttgtccagtattactggattcagtattactgaagggcatttgggttggttccaagtctttgctattgtgaacagtgctgcagtaaacatacatgcgcatgtgtctttatagtagaatgatttataatcctttgggtatatccccagtaatgggattgctgagtcaaatgatatttctggttctagatccttgaggaattgccacactgtcttccacaatggttgaactaatttacactcccaccaacagtgtaaaagtgtttctatttctccacatcctctccagtatctgttgtttcctgacattttaatgatcgccattctaactggtgtgagatggtgtctcattgtggttttgatttgcatttctctaatgaccagtgatggtgagctttgtttcatatgtctgttggccacataaatgtcttcttttgagaagtgtctgttcatatcctttgcccactttttgatggggttgtttttttcttgtaaatttgtttaagttctttgtagattctggatattagcccattgtcagatgagtagattgcaaaaattttcccccattctgtaggttgcctgttacctctgatgatagtttctttagctgtgcagaagctctttagtttagttagatcccatttgttaatgttggcttttgttgccattgcttttggtgttttaatcatgcagtctttgcccatgtctatgtcctgaatggtattgcctagtttttctcctagggtttttatggttttaggtcttatgtttaagtctttaatccatcttgagtcagtttttgtataaggtgtaaggaaggggtccaaaacagcatggtactggtaccaaaacagatatataggccaatggaacagaacagatgtctacaaccatatgatctttgacaaacctgacaaaaacaagccatcgggaaaggattccctatttaataaatgacgtcgagaaaactggctacccatatgcagataatatttttcttataactttaatacataatgcaatttttctttaaagagaattttataaccaaaaaatgatgtattttaaaattagacattttcagtgaaaaatgacaaacaccatacaaatgactcatgcaggcaatagtgaaggttttgggaggtggggctggtgttaagcaaagccagtgaaacacatacagcacttaatctttagtactagactgctttagtctccatggttattagaaaagttaattttctaaaagggcaacttcattaacattagtctcacagttcagcgcagtccagtgaccctgtgtggaggcatagttcctactagagctaactgcaggaagtggcctatcagtcagcccaggccaggacagaatgccgagttcagtatgcagagcgaagggcaaggagcaggatatgggggccaggagagcagctgaagtcgtctaatcttcaaaaagaaaaaagtcaaaatatctgagcctttaagtggtgcagtggaatgagcaatcaggaatgtgtgctaaaggcagttcttatgactgcagattagtgagcaggtaggaagacaattgtgcctgcctaataataactgccccctggtatttaaagctgtaattcagctgctttgctgctgctttgaaaggacatagcgtgtgtgagctaaaagagtaacggaataaagtccaggttgtagccttagtatgcagagcgtgggacatgacagaaaaacaggagacacatgatgtattcctaactcagagaatctatcatcaatgcagagcaacaaatggtaatgagtctgagttcagtaaatgtatcagaatgtactttttaagaatgtgatacaccaaccaatagctgagtttgaaaaggaaacagaagatgacccacaaattacagataatcaagagtgaaaaagcattttgagttgaattacttagcaattgttaaaggtagtttaaatgctatcttactaaaactatctacaacatcagtggcaaagacacttatgatactgtgagaattcaggaagaatttaaatggaattgtaacataattttatgatttgttgaagattatctttttctcatttttttccttactctttgttactccaactcaatatagcaaatctcatgtttagaggatcgaaaaaaaaacattatatgatctcattgaaaatatgggctgggtgcggtggttcacacctataatcccagtacttcgggaggctaaagcaggcagattacttgagcccaggagttcgagaccagcttgggcaacatggtgaaaccccatctttacaaaaaatacaaaaattagtcgggtgtggtcatgtacacttgtagtcccagctactcagaaggctgaggtgggaggatcacttgagcctacttgcagtttgaagctccatgagctgtaatcactccagccagagccacagagtgagaccctgtttcaaaaaagaaaaagaataaaagaaatatgaactaaattgagtatagaaaagttgcaatatttggcattagaaaataaagatattatgaaagaaataagtaatatcaggtatccattttaactgaaaaagcaaatgtattatgtttttaaatgtaatgctaatgaaataaaagcaagaaagactagtcttaggggtaggtgaagcacatatagacaggcagttagtagtctcactggagtgagttgccatctggggagccagtcagtgtgttacaagtttcttggtcatacaataaagtccagaacaaagctccagtcctggaatgttaattgaaaaaagcagggcaagctagtcagctggtcttcatgagggattgtggggtggcagccattagaacttaagagccaagacagccaaattttagggacaaaccaaattggtggcaagagagatgaaacgcaaaataaatatttcacatacggtcagccctgagggtctatgtaggaacaatggagacttgcaaaagaatttctaatcccagcatttggagcagatcatgggatctgaagcctggagggatgacttacctcttagcttctatgaacagagtttgcccaaagactgaccaaattcagcctatattaaagattcttaatggatctggtgcagaaggaaacataaatttgtggatgtagtcatttattcatcaattaactattaagcacccactggacatttttctgggtaccaaggatatcccagttaatgctacaagaaaatctttagctgaattaaatgtaaaagaatttaattgagcaaaaaacgatttgcaaattgggcagtgtctcaagccagagtacattcagagattccagtgcagttacattgtggaagaagattcatggaaaaaaaagagaaagtgatgtacagaaaatagaagtgagatccagaagtagcggattggttacagcttcacatctgccttatttgaacatggtttgaacagttgaccacctttgattggccagaacttggtgattgccacaagagtaagctacggtctgtttacaatttcatttaggttataattcaccgtgtactgagaaacctttaggctgaacttaaaatatgtaaagaggcaactttaggctaaatttgatttatgacaaagtagacaaaaatctctgtccttgccttcaagtttgaggtaactaaagacaaacaaaagcaaactaattataaattagaaggtagtagatgttatagaaaaaaattaagctagaagattttggaagtaggaagatgacaagtactgcaattttttatagggtgctcaatgaaggctcagctgagaacatgacatttgagcagccgtgaagggggtgatgagcaggcaaagtgatgcctggggaaaagcattctaggtaggggaactttgctagcaaaggccctaaagcagaagcattctcatgtgttttaaaaagcaaggatgccaatgtttctagagaaaactcacaaaactttgggcaaggaggaaatgagaggaataatggcagagatgtaaatggaggcaccaaatgatgtaaaagcctcacaggcctttgaagcactttgggtttcactctgagtaaaataaagagcttttggaaggttttaagcagaagagtaccatgacagaacttaaattctgaaaagtcccattagccatatgttgacaatggattgtggagtgttagggtagaatgtgggagaccaggcaggagatggtgatgtggttaaacggtagcaactgagatgtcaaataaaaatggttatgttactgattgattttgaaagtagtgccaacaagtttattaacaaattggaagtggactgtgaaagaaagaatggagttgaggataaacacattatctgctgctacgtagcaagatttattaacttaaaaaaaaacatttttgtcatattcagcgatgtgggctgagttcagtcaaatagttctgctctgtgtgtcccagattgctttggcactaacagagtgaaacaggagagttccctgtttcccccccggcaggatgtgacagggtgtgtctccttctgtctgttcagccaccgtatgtgtgcactcaaaccccttaagggagggggagcatgcaaacaggcaggtgcagaagccaaagcaagcacccctggtctctggccccaggccagcatccagggaagggagctgagactcccaaagcccaagtggacatgtgttacagtgcactcctttagccttgccatctgaagacagcttaagtgttaactagctcagtaccctcttggtacccgggtccttgtccagcatccaggaagaatcaggtcacacacagacttgaaagatgaatgcggggttttgttgagtcctggaggtggctctcagtgggatggatggggagatggaagggggatggagtgggaagatgatcttcccctggagtttggccacccagcggccaatctcctttccaactgtccccagccaaactcctcttggtgtacggacacttcttctcttctctctgctgcaccgttctgcctttcttctgctcttctgtttgtcctctcatctccccctggagctggtggtttggagtttacatgggtacaggatagggggcgttgcaggccaaaaggcaaatttgggcatgaaaacaggaatgccttttctcatttagggccacgggtttccaggcttaagggtgggcccttcgctggggaaccaccttcttcgacccagtactcccgtgtgttctgtccatatcaacagcatgtaaggttggaagctgaggttggcaggaatggctgtggtggctgagcctttttcttcacatagtctctccctggggccagcttaggttttatcacattatggtagtctcaaagcagttagagtttgtatatgatgactgacttcaagagagaggaagaagctgtttgtactcttcaaacctggattgcaagttccagaatgtcccatctgccacatcacattctttgtataagagcaagtcacaaggaaatagattccacctcttgatgggtgaggggaagaaactgatgatagccagactgtctaccagagatgtctccaaggtttttggaccaagcaactggacatatgaagttgcagttaagtgtgatgggaaagactgacagaagttagagtaggccaaggtgggtggtgagtaaagatatcatataggcaattgaatatctaatctggagttcaggggagagatctggactgaatgtgcctatttgtgagtcatcagtatatagatggtattcaaagccacaagactgggtgagaacagaaaggggataagaaaagatagaaaagagaagaattccaaggactgagctctacaacactctcaaatttgaagtcaagaaccagcaaaggtgactgggaggaagcaactagtgaggtagttaggctgggtggtatgaaactcagggaagaagatgtttcaagaagaattaatcaattgggtcaactgctcttcaaagttcatgttaactaataattcatcattgaacttagcattgtggagaccattcgagacattgacaaaaacaaacaagactttgaatccatcgggtttggtgttatggcttgatcctgcacaattatctcagagagcattccaggaggggatgtagaattataaacctacatcagtataagatagatacagctctatagagtgggagggattctaatgtgaagccaaaatgcagccttgccagtcacttggagcttccaacacaatccaggagtagataatattcaataatccaggtaggtgactggtatcacacaattttgtcaacctgtggcagtttaaataattacattctaaaattaagtgccaagatttaatgccttcagagaacaagggtccaggggagggtgggaaagcttggttagagaggggctgtggttaccaaaacaaaaactcagacaagaaattaaccagccagaccagtatgtgactgggaagagggaagaaacacagctaagcaaaacacacgtaaaaatgagttgtagttcaccaagtctatgtcagacattagctatgacttggtctgaatgagtttcaaatgttttattaagagaaaggatcagagatggtgaggttgaagctgggacctgatgggtatgagactgtggggcacaggtgaagagtatggaatggatggggggcagcagggagatacatggaaggacacacaagtcagctgctcctcccaacctactaggccagggccttgaaaatacatagatcatgtcatttagcaccatttacactctgcacaacttattaggatgggcgatcaaaagactacagagtattgactcttatatcttcatcttaaagtggagtaaaagataaatggcatcggcattctgcaaagagcaggactgaggatgaagatctgaaactggataactctgactgattacctccttccccaggctgcactcttgacagaaggcacagtttctctgtaggatttaacagccattagcaagcaactaagacaattgaaagagacagctgagcagccacatgctagtttttcttaaatttacttccctttacaagtctggaactgagatgagcaaatcttgctacatgaaaataattaagtttgaaagtatttcttttcagaaaatcatttttcttaatagaaacatctgcagaattgtgtggactcccttccagtgtgaggagcagtaaagttaatcctgtaatcatattggagaaaggatgagaccccactctttaccctaaccaaatatcttccagcaccatcctcactgctgcccccaaagctgttggagcatttcaattatcctaggagaatctgccagtggttaatgatctttcttgccaggaggttctttatccttcacctccattcctgttgctacagttcattcctccctgtagaattatgaaagaacattacagtccatccgagggagatgagccctgcagccttaatttccaatgtggcaaaagtcatgagtctgagtgtcagaactgccacagagattcttggttgataccacagccatccattaacctgtccctggagttagcagcccagatggtggtaactgcaaatgaaacttaccaaggggcttgatgatagccctaagcagagatttcagttgcagagatttcagttgagcatgaaagcctttgaaaaagatatcacaggaaatagaggggaaagctgcattttactccagagaaattgattctatataggaaaatcccataggaatgaaggagcctggctgtctcctcaaccttgtaggtaaatatgatgttcttctaatgatcaacaaataaagtattagaaaatagtataaatattctaaaatattaagactcaatgtcttaatcagactgcctgagttatcaccctgctctatgtcttcctagctctaagagcctgagaaagtttactgattcctttttatctctgtttttgtcatttataaaatagacatgataatgatgtcaacttcacaagaaagttatgaggattaaatatgtgaaaatgcttaaaatagagtgtcaaattctaaatattggctgtcatacatggggcattaaatatacattattatttgtacattggtttatggactatatgtctggaaatctaagttgtactgtggattttataccttttcattacttttgtagccttgagcaaatttctgtaccttccattagcacaagttggtaaatacgtatttggacataatgcttttcatttttcttcttattcctgtggcagacataggttaattacaggcccttacaccctgaggcctaagtaggctttagaattcatgtcaacatgatgttcccagcagccaccatcagtcagttgacatgaaaatcaaaactgatttgacctctcagctttagagctcacaagcttttaaaggaatgtttattcgcactttcagccacctcagactatcccatcacagtatcacccccactttgccaccaatttttcaatgttgataggacaccacaaatgtctgcatttgggataatctttgtgtattcatcataacactacacccttgtaagtagccacagctggagaagggatatggctggcacgagagtccactgtgagtacatgcttgaggtcagtatccaactatatcttgaccaaagaagctgactgacagggcatgctcagacttctttgcgcagatggaggtgaggaggtcagtgcctgtacagaccaaccagtgcttcttcccatgctatgctctaaggaagcttcctcctaataaatcttttgctctccacaacaaaaccctaataatgtgtctcctaggcatcttggcccaggccagccagcacagaagcctgggattgttttgtttagttttcaggttaggggacaagaataaccaagagaataagtaccaccgacagattctgatctttggtagatctcagaattcacctacagttatccatgaatatcctttccctattacataaagaagactctttctttattaaatctttaggcaataaatgaatttttaagaatactgataggattatgttatgttttaatatgcaaaatattctgtaagaagacacctaagaatcacttacaagtgcttatctttgatcagtcatcatctgttgctcccatttaaccatttaccttgtaacaaagcttttttaaatcagaatgccttggaatgattaaaatgtcatatggatgtgtttagattacaaatagttaaggatgagatataaactaaattttaaatatcaaaacaagatttctataattcttaagtatattaagttatttataaaatatcatgctaaattattgcataaacaacaagcaatcagttagctaaggaataacttaaaatagcctgggccaccatcatacccagtgtggggccagatagatgaaatatatggccagtgtagcatttattgtgttctttatcttttcttaagagtacagaacagtggctgtatagactttggagttagacctgtgactgaattcagactccgtcactttgctgtgtgtcttagttcgtttcctgctactatcacagagtaacactgactggatgatttataaaaaatgtaagttatttggctcacagttctagagactgagaagtccaaaatcaagaggcagtgtctagtgagggatttcttgttgcatcataatatggtggaaagcatcacatggtgaagaaacgcatgcacaaaacagagcgaaaaagcagatcaaatccacatctgcaataatgacataaatccattcatgagggtaaagtcctcatggcctaatcatctcttaaaggtctcactttttactaccatcacaatggcaattaaacttcaacgtgagttttagagaggacattcagataacagcactgtgtggctttaaacaaattactaggtttttctgaactttagttttcttatatactgttgtcaaaattccatgtgtgagagagcttggcagagtccctggcacatcgcaagctctgactcttgtgataattgttagactccctcgttgtttgcggaagtgtggtggggacagataggaatcagccacattgtttttttctacataaaatatttgcacccacattggtctttaaaactctttgaaatgcatatgaaaattcctttggagaaaaaaagtatgcagttaaaaaaaaagaagtcctgtattccctattaagagattaattcctaaagggtagacaaacaagatttcaaacatcactagatttggacactagctttggcctgtaaatcgactttagtggagaatgttaacacttctcaattcctactccttgctggcttgagtaaggcacacaggagccactttcagagataatcttctcttctttatttacttttatcctacagaacagattgaaagccagtggcatagatctaggcacaggttttctcagtcagtcaacatttggggagcatctgctatgtgttgggtgccatgccaggtacaggttaatgcaactgccagaacagatcttctgcccccttctgaactttgcttctacacatctaaggtcctgttagtgagcccaaataaatattcttcactccactcttttcttcttattcttcactatctctgggcgaacttattctctcttatgatttaatatactaattctgcattgataacatgactcctgaatctatttccagcccaaatgtctcacctgagctttgagcccacatttccatctgctgagtactgcatatcttctccaatatatcccaacctattccccaacctgaactctctatttctattaactggctatgaatgcaggaacaaggattcgaggactcagagattaaaaaaaaaaagtaataacaatgatggttaatatttattaaccatttatccactatttatttaagttatttagttatctaatgtgtgtagttatatatttatttctcacagtagctctttgagataggtctactattatttccattttgcaaatgaaataattgaggcacaaagagaagtcccttacttctccaaggccacacagccagaggtggtggagtcatgactggaattaggcaatctgattctagaacctgtacacttaagccctttggcacatccatcttaaatgtaggtcagggcttgggttgtcatagctaaaaagaacagatcagataatggtaagtagtatcactgcctggaaattttaactacaaaattctgtaaatataatgggtggatatttttataacatgctttggattcatgataaagctctagtctttcaaaagcttgtgaaattatttctgcaaaaacacacatatgccgaagcacaagagaaaaagcaggatgcgggaaagcaaaatgccaatgcacaggggaaaaagcaagatgccacccagacagtgagcaatttgctcagcttggctggagcgtggagtctgtagactgaagtcatagaagacaaaggctgagaaggtacactggaacctgattgtgaatgaacttttagttatattaatactataaatatagtaataaagttatattggattgtactctgtaggcaaaacatgggactagaagttggggagcaaggcagggaaggttcatctaacacaatcattactgagagcctccagtgaagtaggcatgattctaggtacttgaaatacagtttgtttgtacctccaaggagtgtgcagtcttagggggagcttggcaattacactggaaatttttaattcaccacggttaagtgttacagagtgctatgaaaatagttatgaagtaccactaacaaacccattgtgccttataagaaaatacttcctggaaacatgcagagatttgtaacgaggagaattacatgattatatttgtattttagaaatttaattctgttagtagatatggcaacaccaaagaaatactgaagaaggaaggtcattgaagagattaatggatcatataaaagttgatgatcacttgaactgtgaaaataagaattgagaggcaagtacagaatcaagaggacttttggcaacagcaacaacagaactagaaatgttgttggaaaggagttcatgagaatgattccagtctttctttttagtttggtcacctaagtggctgagttttccaagttagggaaaaacaaggaagagcaaaataagcgaggaagggccgggtgcgctggctcacgcctgtaatcccagcactttgggaggccgaggcaggcggatcacgaggtcaggagatcgagaccatcctggctaacacggtgaaaccccgtctctactaaaaatacaaaaaattaaccaggcgtggtggcaggcacctgtagtcccagctactcgggaggctgaggcaggagaatggcgtgaacccggaaggtggagtttgcagtgagccgagatcacgccactgcactccagcctgcctgggcaacagagcaagactctgtctcaaaaataaataaataaataaaataagggaggaagacagtaaatttagtttgagatatgttagcttagaggcatctacaattagagatatttcgtgggcagctatagccacctatcataaatagaatgatgccagagatgtaagttttggaatttccaacatctgaatccaggtgagctttctcaatagagcatagaagtataaagacagacaatctgacagtaccttgaggcacatgtaaacaaagcaaaacaaataaaatagatgacacatgaactttagagtcagaatgtctgaattcaaatcccagctcaaccacttatgagctttgtgattttggacaaggtacttcatatcttttggtctcagtttcctcatctataaaatgagaactacctcagattgtatcatgacgtttaaataaattagtgtttataaagaatgttgaataatacctggccttcagtaaatacaatttagtttttattaaataaaaagtattataattcatttagctccaaatattgaccttcattctgtgttctattttatttctccactatgtcttactcttctgaaggctgtcgtttgtttatcttattctactcctaattctagtgggtcctgaatgaagtattattaaattcactacctatttcacatgaaaagtaaatcttaggaaagataaaaaaaattcctttcttcatgaaacaattaccttgtaaaaaaatcttagaaaagttctctctaggcatatcacaatgtaatgatccgtttctacagattaaattgataaataattttctacaaaggaatattcctcctagcagtttccttcttttacttttttttcatttttcaggaccaacactactaaaatgatctattcatacatttcaagcagtttcagactttagaattaacctgtttctggtatggtcgtgaccatcaggatccactctgccaggaacagtgctagatgctctaaatagaaaatctcatattcttccccaaactccttgagttggctatgatgtttgctatataattgagaaaaatgaggttattcagagtccctgaatcataccaagcctagagaagctgcctcaatatagtgaacaacagctaagcagttggtttcaaagcagagcatcattcaacacgggccagttgtctctccactctacagtgtgtcatcatcattttgaggatgagacaaaaggtagagtggcctgatgggggcacccaccaagatttcctgccctattatttcaccacagaagacacttgggagtcctggtaccttggccttatcatctatggcttggaggaaccaatgaccaataatctttttttctttcagctcagttcatgaaccatcggcaacattctcccctctagacccatcatcagaagacttaacacaaaactgttggaagtctcttgtctaaacagagtacaggtttaatattcttaccagtcttaatgagactctaagttcagttttttttaattgaataacattgttcagaggatatgtcatagtgatggtgatgataagtattacctcagagatgggcttttccctgtaaaatgaaggcttcaagatcagctttaagaaggagttagattgagataaatgtaaatgataaatagatcatgcatgggaaaaaacagtattctggtatagatatataatgctaagtgtaccaaagcaaagccaaatcagatgtgtctggacaatacttagtttttctggaatgaagtgtttattgtttagttagagaagcagtaaagaatgacatggaaaactggtgagggcatgtttgtgaagatcttaaaagtttgggtaccatcttcttatgattaatgaaatcaagaaaggtggtaacacaaaaacatttcaggtgaatatgttagtaggatcagaggttgaaatggtgatgtagagaaggaattcaaattattctgaatttctaaatctaggaaaataaataacttgatatgtattaaaagtaaagaaagcctattttaggaggttgtttccaattccttccaacaaaataatatctcacacactggcatactttttctataaaggccacatagcaaatattttaggattttggacatgcagtctgctctgccacaactactcaacttgttgccgtagcacaaagcagccttaaacaatatgtaaatgaagtcacatggctctgtttcagtaagctttatttacggacactgaagtttgaatttcatgaattttcatgtgtcacaaaatattattactcttcttttgatattttccagctactttaaaatgtaaaaaccattcttagcttggggctatacacaatcagagggtgagcaggatttggccacagtttgcaaactcttggtttatagaacatcatcagaactttcaatccaacatcattttgaaaactttgaatttcttctgaagtcttctcttgagcatttggaaggagctggttgaagtgggcttgaagtggtaggagaaggggacaactattaataactagctagtcagacaaatcatactaaccacagggggcagtaggacaatatatgtccctgtatgctctaatccaacagttgcttgtctgaaaccttcaaaaaaaaagagagagagagagaaatcaatcaataaatactactgcaaacaaacacattctgaactcagtattttgataattgcagagggaaaatcaaaagtggtgggctttgcttttattcaagttgcttatgccaccctaaagtggtgcaatgcagtacttgcccaaaggaagtgagtggcagcattgatggaagcttagtgtgagagcagtgtgtaaagttgaagtgactttgaacaaagaatttcggagagactaactaggctggggtaactaatgaaaaccaggctgggaatggaatgcagagggggacatgagagtcccaaaggaaaaattgatgggacttgctaactaatgagacatggaggctgaaaaaagagagaggagaaagatataaaacctttcaaaagattctcattatattattcagtgccactaagaatcacataccagtgagaggcaagggggacgatgtagtgtatagaaaatggggaacataggaagctggagagtagcacttcaaacaagcaaatcacacacatacactaatgtctgataaatgtcaggctgaaattattggcaaatacagagagaagggatcccattaatgcccacatgctatctttatttcaagtattatcaggtggaaaataaagtagtaccattatcgtgttgatggtctaaatatgtgaacaatctcctgcatcatattatgtagaatccccctcatttcttcaaggcaatttccttttgatcacttggcactggtcatgtcttataaagcaaatatatccaaacatttttcgttgcttcagcttttccctccctagttctgtttgcttatgtagatcacaaatgtatgagaaaaacaaacacaataaggcaattaatgtacctacagttagagatgtgaataatattggaattcagaaaaggaaaggttacataaataaacctctccaaactcttagcaccaactattggttttatctgcttctaccctacctagagctgtccaaagggattgctaaggcacttgcttcctaaaaatcccttttctgccattatgattcacccaaagcagcatggtatatggcggagatgcatgtcagctctgcctataaatgcaccaaggcatatttctcataagcacatttttgcctacacagaatgaaatagagacaaaaaagtaattagtgccttcgttgtttggactcacatttataaaaataaatgtttagcctaattctaagatagtcatttcaactgtctttcttaaaaatcttaaacaccaggatttagttaaaaatatcttcagttcgcctacatttcacccttaattgtatcttaagaaacctataatgaaactagcgtggccaaaatacacttaccaacaggtttccttaattattatctaggaactatttagaagtggatgctttcctgatttacttacatgttgtaaaaaaaatggaaagttaatttatgaaattagaaaagtagctgaaagtaagcctagcccattttataatgagaaaaataaaacacagaatatgttttaaagtggctttctcaaatgaaccacaaccttcaggattagactttccctttgagatattgaggtacagaaaataccaagtttttagaagcacaaaggaggctgaaggacccaaatttgtgagctgacactaccccaccctaaggggtgttaagaccaataaataactatatatggtatgctgcttctctcttctgagtaaatcagttattcaactaacatgtaacaagcacattataaattatttcactattacaacaaccacaaatagatatatagaaacgtctacaaacaaattaccatgtataaagaaaatgagtagatacagagagtgcaatcagaattagattaatactatgatcatcttaatatatcagttaaatgttatgtcctcattccaagactctcattttatttagcttctgcattaatccagctgcaaattgaattagtccagattaggtcttagtatattatttatagctttttactggtgctacattatgcattttcatccaaacaagtataataattttgtcaggttcatgtaaaagcaatttttgaatatacagcaaatttttatattaaaagaaaattttcatattttttcatagacttgaatcaaaggaacctttcctgtctgttgggtaagtatatatttaaatactttaagtattaattatttaattcaaatttccaagaacttctgagatggtattttcagtcatttaacatcatattcaaaatcataacatatcagtgcatgcaacattgctatctatgttttataaagacttaactaaaatgctccctaggttgtattgtgacctcagaaatgcagctaatgaatgtatatgaaatcctgtatcttccataaaggctaaacaaggtacacagtgatcatccatattctcttcatgtaaaaatatactcagattggttttaaaaattcctctgagccatagctccaccattccaagcctgtctacccattgccattctccatttcttttcaatctactctattcactgtttcgtcacccacttccctaagtctgtcttcacaatcaatatctatcttttctccttatctctcatttcactttaatttctccagttcactcacattgactgcttctttgcacccaaagctgaggaaccctgaggcaaatttagataagacgaacgcttgcctgctctgatggtatccttcttagtcacaatacatatctttaagaataatatattgttggccaggcgcggtggttcatgcctgtaatcctagcatttttgggaggtgggcggatcacctgagggcaggagctcaagaccggcctggccaacatggtgaaactctgtctctattaaaaatacaaaaattagctgggcatggtggcacacacctgtaatcccagctacttgggaggctgaggcaggagaattgcctgaacctgggaggcagaagttgcagtgagccaagatcacaccactgcactccactccagcctgggtgacagagcaagactctgtcccaaaaagtaatagtaataaaataataacaataatatgtttttgacatgagtgcacatgttctatttttaggcatttcaaactaagaataagcaatgttgtttgtatctgatcaaatactcctttgactaacatattaaagtgtattatgaaaggacttttgcactttcaatattatagatgatattgtatgaaaaagttgtgaaaaatgcaatgtcttgcctagagaaatcatgctatatttgatgagggaaaaaaagctgtcatatataggcagccacaatactgatgcttaatgaccagaaacatggaatggggttagatttttaagtgaccagatcaattttcttttattactttgtacatggtcattgaatatttctatcaatcactcattcaacaacatggttcccaattcctttctactcttcataaaagcttttcagaaagccactcaaatcatggaaatcaaaataattattaggggatgtggaagacaaaaaatggaatatatgcatttatttgaagactacatggaaaatgaaaggtcgagttggtctggcccaaaaaaagtgataaagcatgcttttttccctacattgatcatcagctcctattgttaaaaatctctacacctgaagaaatcttttagtttgaatgcatgtgtatttgccctcaagtcaaaaggcctgaaatagcttctcttcacgcctcacttcatgtagtttctgtgcagcctttactgttctcctggctattatgagatggaattccttttttattgcatacttctgttttaaaaggcagaccctaagtaatctttgttttaaatttatcaacagtttagcactgattattagaaccctgagaaaatctctccaaaaaaaaaaaaaaatactgtatcgctcagccaatgctcaaagtgggaaaattagcatggcacacataagatactgcttatgtcttaaaagtaaagtggtgtgaaaggcaacccaaatgattctgctgaatggatattttaatttatagctaaatgtttctgttccctcaagaaaattattttaaataagattgtccaaaagtatgtatgctaaggtgggcgactcacttgagttcaggagttcgagaccaggctggacaacatggtgaaacatcatctctacaaaaaattacaaaaattagctggccgtggtgccgtgcctctagtcctagccacctggggggctgaggcgggaggatcatttgagcccagcaggtccgggctacaatgaaccgagatcgcaccacttcaccccagcgtaggcaacaaagtgagaccctgtctcaaaaaaataaaagcatgtatgtagctctctgctgcctttttcagtgagaagatgtaagttctttagtggtgattggtgagattttggtgcgcccatcacccaagcagtatacactgcatcatatttgtggtcttttagccctcacccccctcccaaccttcccacccaaccaagtccccaaagtccattgtatcattcttatgcttttccatcctcatagcttagctcccacttatcagtgaacacatacgatgtttggttttccattcctgagttacttcacttagaataatagtctccagtctcatccaggttactgcaaacgccgttaatttgtttctttttatggctgattagtattccatcatataaatatacaccacaatttctttatccactctttgattgttgggcatttgggttggttctatgattttgcaattgcgaattctgctgctataaacatgcatgtgcaagtatctttttcatataatgacttcttttcctctgggtggatacccagagtgggattgctggatcaaatggtagttctactattagttctttaaagaatctttacactgttttctatagtggttgtactagtttacattcccaccagcagtgtagaagtgttccctattcactgcatccactccaccatctactgttttttgattttttgattatggccatttttgcagaagtaagctagtattgcattatggttttgatttgcatttgcctgatcattagtgatgttaagcattttttcatatgtttcttggccatttgtatatcttcatttgagtactatctattcatgtaattaacccactttttgatgggatgtttgtgtttttcttactgatttgattgagttcattgtagattctggatattagtcctttgttagatgtatagattgtgaagattttctcccactctgtgggttgtctgttcactctcttctttttgccatgcaaaagctctttagtttaattaagtctcaactatttatctttgtttttattgaatttgcttgcgggttcttggtcatgaaatctaggccaatgtctagaagcatttttccaatgttatcttctagaatgtttatagtttcaggtctcagatttaagtctttaatccttcttgagttgatttatgtataagacgagagatgaggatccagtttcattctcctacatgtggcttgccaattatcccagtactatttgttgaatagggtgtccttttcccactttatgtttttgtttgctttgtcgaagatcatttggctgttaagtatttgggtttatttctgggttctcttctctgttccattggtctatgtgcctatttttataccagtaccacaccgttttggtgactatgtccttgtaatatagtgtgaaatcaggtagtgtgatgcctccagatttgttctttttgcttagtcttgttttggctatacgggctcttttttggttccatatgaattttagaattgttttttctaattctgtaaagaatgatagtggtattttgattgggattgcattgaatttgtagattgcttttggcagtgtggtcattttcacaatattgattctacccatccatgaacatggcaagtatttccatttgtttgtgtcatctgtgatttctttcagcagtgttttgtagttttccttgtagaggtcttttgactccttggttaggtatattcctaagtattttaaatttttttgcagccatcgtaaagtggattgcgttttttatttgattcttagcttggtcactgttggtgtgtagcagaactactgatttgtgtacattaatcttgtacccagaaactttgctgaattcttttatccattctaggagctttctggaggagtctctagggttttcaaggaaaacaatcatattgttagtaaacagtgacagttttacttcctctttatcaatttagatgccctttatttctttttcttgtctagttgctctggctaggacttccagtgctatgtgaagaggagtggtgagagtgggcatccttgttttgttccagttttcagagggaatgctttcaacttttccccattcagtattatgttggctgtgggtttttcatagatggcttttattacattgagggatgagagttttaaccataaaaggatgctggattttgtcagatgctttttctgcatctattgaggttatcatgtgatttttatttttaattctatttatgtggtatatcacatttattgacttgcatatgttaaaccatccctgcatccctggtatgaaacttacttgatcatggtgggttatctttttgatatgttgttggatttggttagctagtattttgttaaggattttagcatctatgtttatcaaggatattggtctgtagttttcttttttggttatgtcctttcctggttttggtattagggtgatgctggctgcatagaataaattagggagggtttcttctttctctatcttgtggaatagcatcaaaagataggtaccaattcttctttgaatgtctggtagaattctgctgtgaatccatctggtcctggacatttttttgttggtaatttttaaattaccatttcaatctccctgcttgttgttggtctgttcagggtatctaattcttcctgatttaagccaagaggattgtattttttcaggaatttatccatctgttctaggttttctagtttatgtgcataaaggtgttcacagtagccttaaatgatctttcgtatttcagtggtgtcagttataatacctcctgtttcgtttcttaatgaggttatttggattttctctcttcttttcttggttaattttgctaatggtctatcagttgtatttatcttttcaaagaaccagctttttgtttcatttatcttttgtattatttctttttgtttcaatttcatttagttctgctctgatcttggttatttcctttcttttactgggtttggttttggtttgttcttgtttctctagttccttgagatgtgaccttagaatgttagtttgtactttttcagtctttctgatgtaggcatttagggctatgaactttcctcttagcaccacctttactgtatcccagaggttttgataggttgtgtcattattgtcgttcagttcaaagaatttttaaatttccatcttaattttgtttttgactcaatgcccattccagagcagcctatttaatttcaatgtatttgcaaggttttgaagattcctttttgagttgatttccacttttattccactgtggtctgagaggtgcttgatataatttcaattttcctaaatttattgaggctcattttatggcctattgtatggcctatgttttagaaagtcccatgcactcttgaatagaatgtgtgtattctacagttgttggatgaaatgttctgtatatatctgttaagaccatttgttccaaggtaaactttaaatccattgtttctttgttgactttctgtcttgatgacctgtctagtgctgtcagtggagtattgaagttccccactattattgtgttgctgtctatcacatttcttaggtctattagtaattgttttataaatttggaagctccagtgttaggtgcatatatgtttaggattgtgatattttcctgttggacaaggtattttaccattatataatgtccctctttgtctcttttaactgctgttactttaaagtttttgttttgtctgatataagaatagttatccctgttcacttttggtgtccatttgcataaaatgcctttttccacccctttactttaagtttatgtgagtccttacgtattaggtgagtctcctgaaggcagcagagagttgattggtgagttcttatccattctgcagttctgtatcttttaagcaaagcatttaggccatttatattcaatgtttagtattgagatgtgaggtaccgttgcattcatcatgctatttgttgcctgcgtaccttggttttgttttttgtttttttttctttttaacttatacttttgttttctaggtcctgtgtgatttatgctttaaagaggttctgttttgatgcgtttccaggatttgtttcaagatttagagctccttttagcaattcttatagtggtggtttggtactggcaaactctctcagcatttgtttgtctgagaaagatggtatgtttcctttatatatgatgcttagtttcgctggatacaaaattcttgaatgataattgttttgtttaaagaggctgaagataggaccccaatcccttctagtttgtagggtttctgctgagaaatctgctgttaatctgataggttttcctttgtaggttacctggtgcttctgtctcacatctcttaagattctttccttcatcttaactttagataacttgatgacagtgtgcctaggtgatgatattgttgtgatgaacttcccaggtgttctttgtgcttcttgtatttagatgtctagttctctagcaaggccagggaagttttcctcgatttttcccccaaatatgttttccatacttttagatttctcttcttcctcaggaataccgattattcttaggtttggtcatttaatataaccccagacttcttagaggctttgttcatattttcttattctttattatttgtcatggttggattggtttaatttgaaggccttgtctttgaacttcaaatttctttcttctacttgttcatttctattgctgagactttccagagcattttgcatttctgtgtgtccagtgtttcctgaattttttattatttgtttctttatgtatttccttgaatatttctcccttcactttttttggacttccttgcattgggctttgcctttctctggtgcctccctgattagcttaataactaacctcctgaaccctttttcaggtaaatcggggatttcttcttggtttggatccattgctggtgaactagtgtgatttttgggggtgtttaagagcctgttttgtcatattaccagagttggttttctggttccctttcatttgggtaggcgctgtcagagggaaggtctagggctgaaggctgttgtccagattcttttgtcccacagggagttctcttgatgtagtactctccacatttccctgttgatgtggattcctgtgagccgaactacactgattgttgtccctcttctgggtctagccacccagcaagtccacccagctccagtctggtactgggggttgtctgcagagtcctgtgatgaaatggactctgtcagggttctcagctttggtggtttaatgctctatttttgtgcgggttggccttctgctgggaggtggcactttccagggagcatcagctgtggtagtatggagaggaaccaatggtgggtggggccctagaactcccaagattatatgccctttgtcttcagctaccagggtgagtagggcaggaccatcaggtgggggcagggctaggcatgtccgagctcaggctctccttcgatgggtcttgctgtggctgctgtgggggacggagatgaggttcccaggtcaagaaggattgtggctgcctcttctgcatcatgaaggttgtcagagaagtgggagaaaactggcagtcacagggcttaaccagctcccatgcaaaccaaagggcaggtctcactcccaccatgcccccgctaacagccccaagttggtttgcaggcagtgggtgagccaggcttgagaacttgccccaggctacctgtctcccagctgcgaaagaaaaaggtttggttcttccccagcctgtggagtctgcacactggattcccgctctcccttgaattttggctaggaggcttcttgcccctttcaagttgttacaaaattcagctggagatttccttctgcctgtggtatttttcccccgctcctctggccaccctcctgatggatccctgtggtgccaggcaggaatggcctgcttgaagacccagcgagctcccggggcttttcccactgcttcctctatccctgtatttcactcagctcttgaaattgactcagctccagataaggtcggaaacttttctgccacaaacagaccttcagtttctccagtcgggggtgtgtgtttgggagaggaggatctccctttcccacttctgcagttggggcactcagtatttgggatgtctcctgggtcctgcaggagcactctgcctccttcagagggtctgtgggtcctcttgggattgctggttcattcttgcagttgatctggagctaaaattcaccatgcgagcctctgcacgctgctctgtctgtccaagtgggaactgcagtctagtcctgcctcccattcctctgtgatgatcaaatttatgacttttaatccatagtcacatgtcagaataagtgcatggtatatggtttattacatcagttgacatgtgagtatgtaacattgaatttgtccacagcacacctcactcacattaattttaattctatgttcaataaaaatgtgtgaattatattaatgaataaatcactgctaaatattgcatacttcagtccactgcctgtcagtgtcttaaagtatttgttaatatgcactggtgaaagttgctttcaccctcataggcttggacacttacaagctagatgtgttagtttaggcaattactttttttttaatactttaagttctagggtacatgtgcacaacgtgcaggtttgttacatatgtatacatgtgccatgttggtgtgctgcacctattaacttgtcatttacaggaggtgtatctcctaatgctacccctccccccaccccacgacaggccccagtgtgtgatgttccccttcctgtgcctaagtgttctcattgttcaattcccacctatgagtgagaacatgcagtgcttggttttttatccttgcgatagtttgctgagaatgatggtttccagcttcatccatctccccacttaaactcccaagcttcaggttcttgtttgtgaaatggagattaaaagatttagataataatttatatcaaacatttagcacactttttgacacataagaattgctcataaatgttagctatcattacaattctggaaggtatatttatgtatcatgttctaaagagtcaatcagaaagctttaaaataataaatctccatttttataggcagtgctttgagttacattataaaaagcaaaagaagtttcattataaaaaccaacagaagttattataatggggaaagataaaaattgtcatgaaatgagttatcaagcaatatgagtacagatgtttcagattttaatgatgaatactagtaattgtcatttagattttaatgatgaatactagtaattgtcatttaaattttttaagtagaaatattgatacatttttaatatgcatctcatcttaatataaattggtgaaccaaattcttccctggataaatgtgctgtactaattttgaaataaaattgtttggtcacaacatagacccaatctgaatattgcagtggaaaaaaaaactgtcaaagaaagttacaagaagttatttccttactgagaaagagcatggagttgtgaaaagaagttgagtgaaatctcaggtctctgatctgcaactatatatatgatataaaaagaactttcttcatatgcaccaggaaatgacttctaaaataatgtcattgaggggggaaaaaagacctgttacttctttgttcatttaatgtagtttccctctaatacacctagagtgaggcatgaaagctcatcccaagtgtgattctgtttgcacaggtagatcaacagatgcagtgttttccaacgctacctaggtgattctgataccagtggggcctgggagccatcatctacaaggtgctttcatccacctccattgttttccatacacacatgcacaggttgtcattgtaaacacttaccatctctggagtcccttcagaaaatcttcgaaatgtaatgtccacaatccctccctgttttaaatgcatgtggtggaggcagccacattgaactagaactatcttggagttcactccacagagaccaggatagatgcaaagagcccagaatatatgccatggaagcctccacactgcctatgcagaagtacatataaattcattctgatgtcatcttagacctaaggctgggatcataataaattttaaacttcaaaatattaaataatataatttcaatatttaataaatgtctattttttaaatattaatattttctattttaaactattataagtatttatatatttactatttatatatttattaaatatatttaaatttattataaatacataatactgaatgtttatattattataaataaaatatatttataaaatacatttgaacattaaaattcttgcccatcttaacattttttaagatgttaagcaaccttgttttttaatggagggcttaagtttgggggctcatattccaatcatccttgaaacattatatttttttagagcaattaacataataaaattctgctaggagaatgcttcctttcaatgctgcatcagatatactctgatcttggaaataagctgagagaaaacaggcatcaagtttgcatttagaaaggtgaataaggccaggcgcggtggctcatgcctggaatcccagcactttgggaggccgagcaggcagatcacgaggtcaggagatccagaccatcctggccaacatggtgaaaccccagctctactaaaaatacaaaaattagctggacgtggtggtgtacacctgtaatcctagctactcgggaggttgaggcagcagaatcatctgaaccggggagtcagaggttgcagtgagccgggatcatgccactgcactccagcctggcaacagagagagactctgtctcaaaaaaaaaaaaaaaaaaaagaaaaaaagaaaagaaaggtgaataagcacagagtgatcatcaagattctaatatataaatcttagtttaaaaccagtcttgccttgaaaaagttattacaactttttaatgaaaacacaaatgagaaggaatcaaagatccttcatttgaagactgagatttccattttaaggttacatgtcaaaaaatgcatgaagtttcttcaagcactgactgttgataccttgcagacactgagccactttgagcatacactcacagcaccaaaggaaactttccacatgaattatttcttcttcttcagcatgaagttgaacttttaaagaagactttaatatgaattagttgtattttgaaattaaatatcgatttataccaatttttcatttgatgaattttttcataagtagctttatatgaggatgcttattacattggttaaaaaaaacttcagattttgttcactgtatcagaataatttaactaagtcagaacaatttaaaagttatattgacttatctcacaatatattatttcccaggtttggttggaagatcttcaagaatacatcactggggcaggggcgggggtatggttaatggatacaaaaaaaattagaaagaatgaataagacctatttgattgcacaacagggtgactatagtcaataataacataattgtacatcttaagtaactataagagtgtaattggattgtttgtttgtaacacaaagcgtaaatgcttgggagaatggataccgcattctccctgatgtgattattacacattgcgtacctgtgtgaaaatatctcatgtaccccacaaatatatatgcctactatgcacccactaaagttaacattagaaaattttaaaattataaaaagaaataaaaagaatacatcaatgataaaaatatcagaattattttattatatttatctctattgaagcactatgtgtgagctaagcatggaccagccaagcctggatcgcctaagtcctttgagatgcacgggatctattctactaaatccaaacaagagagagtaaatactttcagggcaacaaggcttgccctgcatccaaaaatgaccttataattgctaacagctgtagttcacgaacccattttccttgaggtttattttctcccttttctttccagtcttgaagtagaatttagatcttcaatatacttctgctgttatgaaaactttattaaaccttgatgttcttattaggttaaagactcacactattttacatttatccaggttttgtaggaaacctcatatttagtaacagatgctatatattattatagtattagccacttgctttaagagcccaagttctgtgatttgatttccttcctctgaatcctattctgtcacttcctagacagatggctttagcaatttgtttaactttcctgagtctccatttgctcacttaaggtagtaactaatcttttattattattattattattattattattattaatttcttttgagacagggtcttactccatctcccaggttggagtgcagtggtgcaatcacagtcactgcagcctcaacctcccaggcccaagtgatcctccctcctcagcttcccaagtagctggaactataggcatgagccaccacacctggctaattcttatcttttctagaaacggggggtctcactgtgttggacaggctggtcttaaactcctgatttctagcaatcttcccacctcatcctccaaaagtgctgggattacaagcatgagccatcatactgggtcataactaactcttaacagctgttatgaatgtgataatacttagtgtctgacacatcgtaaacaggaaataaatatcaattattaaaaacattctttgcagcaattaagttgtaaatcttttctaaagtttcactgaatcgcagaaatgttaaccaattgaatccaaaggactgaatattttagaagtgttaagagaatccaattctcagttcagaagagagtgaaatcagcacaggagtgacagactgccttactagggaagatcactgaggaagagagacaagaaaaaaagcaaaacagcagcctgaagacaggaagacaattccaggctgtacttagagtgatataaaatatggagtacaatattgaaaactttaataataggaacatgaaagagggaaagcaatactgatttaaggatggttggtagcagaacacataaaagcaaaagcagatttatattaatgccatcaaatgatagctgtctatcaagcatttaggaattgagaagttaaagaaactggtcagattattaggaaaatttccaagacaaaagtaggacctgagtttttcttcaaggtgaggtaagaattcaataaggagctattaaaatggcattcctgggagacaaagttggatgagtagcagcagagaaggcaccataccccacgtatcagacattccagtctagtgagctaggaagattcaggaaaagacaaaagataagattggcaaattcagggagaatctgtattgagaaattatcctaatacaaggagctttctgctcattctgtgggtgaagtggagccattcaatgatgtatacctgcttggctgttttgctttcaactgaagagtgatattatccaaagtgagccacttataaagcagttgcagaagttcaggcatgacttgaaaagatgcaggacttgaatagaatgaaataagaatgtaaagaaaatgcctgatgaaatagcattttctttaagaatgtcgaaatcagtgagtgagtggtgtcttaaagttttctcagttagacttgatgggatcatggtgacagcatgacaagctaaaatccatgcgtagtgttgaaactaagggaaggttaacaagaaattgtccccaagctttaaatatgcccatctaacatcacggaattactaatggccaattcaatgcctgtcttttgatgatgtggtttcaattttctctatgtctgcagggaaaaagggataaggagacaaagccaattttcttctaaaaatctacttttttgcgttttttttaagactcagacagtgctaccacaaaattaatgatttctttaccaactgcatttgcttcatttttttccccaaagccctccaggctacttctctggagagtacacaaagtttccacagcgctatttttgtaatctaaagcagttgtgctttcaggcctgatgctacaactgtaattttaatttatcaacctgccagtcagtgaaatgctgtaaaaacatgtgaaagcttaaacccatcatttatttctgcacctgtcaatgacacttttctgtacttgtcaaaatcatttaaactgcactatgatggcatatacaatatcaccagtaaattgggtaatcaatcatgtatgtgcatattttgacagtggcgtgttgaatgcatgggctcctgtatgcatttttaagaagtaggcactcattactgttcaatagtaaaatacagtagagtcatcaaaaagagtctccctcagtcttttacaattaaaaaaatgtcttaagaaacagaggggctgattgtgcctgaaatggcttttatttcttcagcaaaatgttctccttggggaaaaggaagcaattgcaggttatagcaggcagcaatatagtgttacatggagggaagaaaatgtataggatcattaaatagatttatttaagttctgcttataaagaaagcagtggtgcagtactttatagttgatgatatttcaaaagagtgttatcagcacttctaccactatctaatttgttcatataataaagtgtcacattaaacccaatatcacaattcatatcagttttacttcaaaaattggtatcatcatatatcatagggaaccctgccccaaaaaaattttgatgagatctttcatcacaataaattatagaatttaaaaaatcaatctattagagagtgagagagagagaacctgttcaatcattaaatccactcaacccagtaacaatttgatgtcatttaggctgtgtttctaagataaaatgttgttaaaattgtaacttaaatattctctaaataatctaactgtaccctctgaactcttggttgtagcaatcctcaccatttatttatttttaaaaagcaagtcttatgagaaaccctttaaaatctatgaaggatttatgaccacttcataacatgcaagtctaaattagccaaactaatttgtagacatcaaatatttctacataagaaaatgaatcagtaaacttgacatgcataagctctcactcatgggaaagaactaaccttaagtgatgtttcagaatcacatataaaacaaacaaagctttgggaggtgcattaatgtacacagccagcactgtttccttattgttaccagtactgttttcaaggaacatgaatttagttttgttttgtcttgtttttttaattttactctaagttctgggacacgtgtgctgaacatgcaggtgtgttgcataggtatacatgtgcgatgatagtttgcttcacctatcaacctgtcatctaggttttaagtcctgcatgcattaggtatttgtcctaatgctctccctcccctttccccttgccccctgacaggccctggtgtgtgatgttcccctccctgtgtccgtgtgttctcattggaacatgagttttttaaggtgtcaagccacattggaaagggtaatcatatagtcagactgttgaaagatatatttactgaatgtgtatatgaataaaatagaaatggtggctaagattagatgtcatatgtagaatcaatactgcacgaagagagttgttattgtttcaatttaaaaataagatcttagtctcatatacttttaatatcagtcctgaaaataatcactaaaaataatgcaaaataagtgctttgatttcactcggctaccttcaactcatctcaaagaaagctaattaagcttacttgaagagaactcatttctctttgttttagctccattaaatatactgaagactgaattttcaattaaataatacttgattatctaaataattttttggcagtttaaacagcatttatttcagacagttcaaagtattgactatcctttattttgtgttcttcaatgaatctttactgattctcataaagacaaaatagatatcatcattcatttaatgctgaataagtgagatacagagacatgatgatatctccataaataaacacagaatattggtagccattttggaatggagtccagtctgggacttttgcttacaaagctggcaacttcatgtatcttaacacctcatgttttcttctgagtttcatctgcacttgaatgtctaaataatagctttaattattcaggaaaataatcatgtatgtaaaaagttatttattgcttttagagctattgtgaatcccagatttgcactataaaagtgctagcaacagttttaaagcctcacttcccaatcacattctgttcatccagccaggagtgactgatctttattttatcaatctcaaaatgtgaccttttcaatgcttttaatgacattttcaaagtacagaaatgctttttgattcaaaaggattttctactttattctgcagaacaagtcagctatcatagtataatcaatagctgccaactattagcaaaagccacacatcacttatactttaagagcttatcaggaagaaaaaatgcattgagtggctatattttggcatgctaactaaggtagatattaaaatgaaaagtcaatcctcaaatgtttcatgtttttagaaatgttattatttccttagtaaaaatttcactagatcacattcaaaatataccattagaagctgctggccacattcaacttcaaaatgaaataatgtgcttgtagttttattcagtgttaggcaaccaactacagtttccccctagcttcaattaaaagcatataaaagatgaaacacttgttgagacatttcttccagatactggctaaattatcatatcatgcaagtggtatttcagttaagtgtatattatagcccaattggatactaaaagtcttgaaagcctttttaaaagtgaggttctctagagaagttattttaaagatgtgttctgtaaatcatgggcctttgattatccagcccatggcaggctaagcactccaaattcccatgtaaagccaccaagtcacaaattaagggattgcccaataaatcaaagcattcattcctaattaattttcttaagttgccaggttttcgtttgaagctcttgtgaaaggatttgatagcattgctgccctttctgtgaagaatagctgtctaatttcattaagtgcatcaattcaacatttgaagggcactgtgtatgtgcaaaatattatatgataataatgtcagttgctgttctaaactagcctgctagacagggatagtttcctactattgtgattaaaaattgagctttccttccatattacaaagataacaacaccaaatcatcattgatagggaatttagtaaaatatttagacatttattttggcaatgtaagatgaagagtagtatcaaaatcatttagacttaactaacaatatgtcttcaaaaattatgcaatgcacattgtttttaaaagcatcgttaattgcctaacagtacccgccaaactacaaatcaggggttaaaaacaggaagtagatcttatgatgccatttcattctaatcaagactttatttccagtatctttattgttatttttgaatatcaattcagttatatttagataaaatttattcagtgcaaaattccatttacgttatattggtagatgcaaagcaagatgcgaggtgcactgaactgctgcttcatctcatagtggattcagtaaagcagtgccaatcaatgaattgtttttaccatttcatttcagaaagtaggagtaagcattttaaaacgtgtagcatgtttatatgctatcgttatagcatgttatatgatatcaaaatgtatgattttgtacaaaagtatcagactgtgatagattggaaatattttaaataaaaaataaaaatttggttctttactgcaataagccaggaagccctagacaagactacatctttgcctttggggaggtagtaatctaatgaacaggacaaaacaaataatttggtgtctataatataaggcattgcttgggaattctaatctgctgaagaagataaaataaaaatgaacagacatctgtaacataagtcattccttgaagactcttgaaagagaggaaataaaaggctgcaggactagtggtacctaatggcacacaaagccaggtgggtttagtttctttttggagataggtagtagcaccatttttcttaaaagagacactggatgacgtgcctggaaaattaaacaatgactatatcaagggagactagaaagccctgaatatgttttaacttttcttcaacttccctctccctttctcacccctcccacctctgccttcttctcttactttctctctctcctccttgacacctctttattttcctctcactctccttcttttcttctctctttcctcttctcttcctttctcctcattctctccttgtcctacttcttccctctacttctttatctctctctattcctccttctttcagcttctctatattttttcttcatttaaaaaatgcatgccttctatcagaagagaatacctcaaaatattaagaggcatctgtgacaaacccactgccaacatcatattgaacagacaaaaactggaagcattccccctaacacctggaacaagacaagtatgcccactctgacactcccattcaacaaggtactagaaatgctagccagagcaatcagtcaagagaaaaaaatacaagtcatacatatgggaaaataaactatctctcttcacagatgacaagattttatacctagaatgccctaaagactccaccaaaaggctcctgcaactgatatgccacttcagtaaagtttcagcctacaaaatcagtgtacaaaaatcagtagcatttctatataccaataatgttcaatttgagaaccaaatcaagaatgtaatcccatttacaatagctgcaaaaaaaaaaataagtcagtaaacaaaggaatacatctaaccaagaaggtgagagatctctacaagaactacaaaacactgttcaaagaaatcatacatgacacaaacaaatggaaaaacattctatggctcatgaattggaaaaaatcaatatctttaaaatggccagactgcccaaagcaacctatagatccagcactattcctgtcaaactaccaacattatttttctcagaactagaaaaagctattttaaaattcaaaggaaaccaaaaaaagagcctgaatatccaaaacaatcctaagtaaaaagaacaaagccagaggcattacattacccaacttctaactacactataaggctacaataaccaaaacagcgtggtactggtacaaaaacagacaatagacccatggaacagaatggagaacctggaagtaaagccacacacctacagctatctgatctttgacaaagccaacaaaaataagcgatggggaatggacttcctattcaataaatggtgttgggatagctggctaaccatatgcagaagaatgaatctggacccctacctttcaccagatacaaaaattaactcaaattggattaaatatttaaatataagacctcaaactataagaatcttagaaaataccattctggacatcagccttcggaaagaattcatggctaagttctcaaaagcaatcacaatgaaaacaaaaattgagaagtggggcctaatgaaactcaagagcttctgcatgcaagagaaactatcaaggaagtaaacagacaacgtacagaatgggagcaaaatattcacaaactatatatctgacaaaatgctaatatccagaatctttaaggaacttaaatcatcaagcaaaaaaacaaccccattaaaaagaaggcaaaggacatgaacagacatttctcaaaagaagacatacaggctgccaacaaacatatgagtaaatggtcatcatcactaatcttcagagaaatgcagatcaaaaccacaatgaaataccatctcacagcagtcagaatggctattattaaaaaaaattaaaaaccacagatgttggcagggctgtggagaaaagggaacattcatacactgttggtgggaatgtaaattagttcaaccactgtggaaagcagtccggagatttttcaaagaacttaaaatataacgactattcaacccagcaatcccattacggggtatatatccaaaagtaaacaaaatgttctaccaaaaagacacatgcactcacatgtttatcacagcactatttacaatagcaaagacacaaccaggtgcagtggctcacacccataatcccagcaatttggaaggccgaggcaggcagatcacctgaggtcaggagttcaagcccagcctggctaacatggtgaaaccccatctctactaaaaatacaaaaattagctgggcatggtggtgcatgactgtaatcccagcttcttgggaggccgaggcaggagaaccgcttgaacccaggaagcagaggttgcagtgagtcaagattgtgccactgcactcagcctgggaaataaagcaagatccatctcaaaaaccaaaaatatagcaaagacatagcatcaacctaaatgtccatcaatagtgggctggaaaaagaaaacgtggtacacatacaccatggaatactacacagacatgaaaaataataaaattatgtcctttgcagcaacatggatgtagctggaggtcattatccaaagtgaattaatgcaggaacaaaaaaaatatattgaatgttcttactcataacaaggagctaaacattggctactcatgaacataaagatggcagcagcagaatctaggaactactagagggggaaagggagggagggcagaagtttgaaaaactgttgggtaccatgctcactaggtgatgggatcaatcatactccaaacctcatcatcatacaatgcacccaagtaacaaaactacacatgtatcccctgaatctgaaaaaaaaaaaaaaaaaaaaaaatgcatgccttcaacgaggagctttctttgctttgcaatagagctcactattggaaggaaaattaatgtatgtgaaatgtttgctgggtatcagaaataacataagttcctaatactccagcctgttctcctgctcttgctttgcagttgagaaaaaaattttaccagtagcttaatgaaaaatttaaaatactagggtataccaaaaatgtcatcattttttaatattaggccagtatgagactgctctctatttgggaattagcagtttatcatctctgaggaaattagtcatcccaaaagacaatcaaatgttgacatttgacatgcccagtaaactactaggacccttcatcatcacgctccaatgaggcccaccagtcgataagccctgcccacatgtacatctacacactcattcacacacccacccacacacatacgcccaaacacacccccacgcccccgccacacacactcacaaagctgacagccaggtttttgatgccttgccccgaaatataacctaatcaacaaggaaagaatcaccagacatttgaggaaatactctaacatggaagaaaatcccagagaaaatcagatttccacagaaataggggaaatatagagagtacaaaactaaacaaaaatactaaaaaactcataattaatgcccctagcaataggaaaatgtatctacatttaaaagtattacttaaaagaatatatgaagaacaagaaaaatcttcttagaaattaaaaaccttatagcagaaatgaaaaatttaataaaagtttgaaatatgaacttaaaagatcaaaaagataaacagatggaaaatagtaaagaaaaggtttttaaacaatcagacccttgctccaggggttcaatatcaagctaacagtgttttcacaaagagaaaacttagaggacaacattattcaatcagaatacaagaaaatatcctaaaactgaaagatacgagttttctaataaaatatgctcaccacaataaatgaaagatgacccaaactaaaacagtttactgtatataagaccttaaatgtctaaatagaggaataaaagccacatacaaagaatgagaataacatcaaatttttcaagattagaacgtgcagacaatagaagaatgcctttaaatgtcttttgatcacatgaatagacttattgtaacatggaatgctcaagattagtgccagtaaagtatctaattctgacttcaacttttaaaataattaaaatcaataaaatcaaaacaggatagttaccagaataacagtgccattataaccacattaaaaagaaaagcttccatcaaaattttatggtatgacaaatccagtacaatatattttattaaatatcgcattccactcaattttgtaatattccattttctgatgaaaatgttattcagaagagaggcttcagataaaaagaaaaattgaagtagaagtacatacgttgagatttcccaattttaccgttaaaaagtacgttagatgtcctgcaataatttgttcataagtatctttaacaaatgaataattattaatatatttcacagataagccacttggtaatttttactgacatagaactatataaacttttagtaaaacatttaaattgttttactttgaatctcctcacattttataagttagttttcatttattctgcttctttaaaaggcgtggccaggttgtttgtccataataggatcaacaaatattgaactgcactagatttgtataataactaatttatacaatttaatatgtgggaaattatacctctctgtgtatttagatatgtttatttgaaacaaaaataattaattttatgcatatgataagaaacagcctattaaatgtatatatttttaaaaataagcagcacagatagcagatacagaactctttactgtcagtactcttgactaccaagaaatgaagccacactctagaaaaatgcaatgcaagaaaagattcaagttatccctttgggtaaaaatcatccccttaataatattcttttgtaatctaaattcacagcatatcccatcagcccaaggtaatcttctaaaatgtcattatatttgcagtattataattttttttcaagccagtatttatggaggtcactgggctacggcaacaaaacattttaactccagggagagtatagctttgtaggattagctcctttgacaattgtctttctaaaaagatttttactttagaaacctctgacatatgtagttttcttcagatccaatgtatccaaatgttttgtaaaaaccaacattttgtggtagacattcaagagtaatcttataacagttcagtttcttgcttagcaaactacaagttgataacaatttgccaagctgtcttcctctgcattcactgctaacaacatctactctttctctcttagcacaggaaaggatgaatttatgtactattatcagagttgtcatggcaacactgtcaccgagtcacatcttccacaactgtaacataatgaaccacagatttctttgtatgctcaaaatgctttatacattatcaaggttgacaactccagtggcagttcgctgacccactaccttaaaaaaaaaaaaccctaggttagttatattagtccattttcatactgctatgaagaaacacccgagactgggtaatttataaagagaaagagttttaatggactcgcagttccatgtggctggggaggcctcacaatcatggcagaaggtgaaggaggaacaaggcacatcttatgtgatggcaggcaagagagcatgtgcaggagaactgtcctttataaagccatcagatctcctgggacttattcactatcatgggaatagtacaggaaaaacccactcccatgattcagttacctcccactggctccctaccatgacatgcagggattatgggagctacaactcaagatgagatttaggtggagacacagccaaaccatatcatcagtagacaaagaggccttaaaccaagccttctgggagatgtgttggtgaaataactggagcatatatagctgtattctgattccagtccacttctttaagtagacttgggtcaaacaggagtttcatgaggtttcatctttccagtaagtctgtttgataaacctgaggcaggcccactatgccccccaggacaccaggtcccactctcacttcccaacccccagcccctcctcagtgcctttaaaattttgaaggaagattatttccagccagaaggcccagaaaatcaatcaaaccaaacacactgtcaatcaagcacaaagacttttaaaagatacaggtgactcttgttatttgtggaagttatattctgtaaagtcacagcgaacactgagttagcaaatactgaaccattgctcctagcggaaatagagggctagatccctatgagcctctgatcacaacatttttgccaaccaatcaatacataaacttgctgtttgtttctgtttaaagactccatgtctttagtgtatgttatatcaatatatgatgttgattcattaacatcgaactcacagccagcagcacaactcatgcctgaaggaagctcatctaaagaagctcacatattttctctataagacacatcacagcatttcagcactatactgggggggggggggcattttaagctgcaaaatcaccaagaaaaagcacaaaagtatgaaaaatgaggcactaaatagatcataacatagatgcttatttgcagtatgaactgaaacaaagaggcagtgtcacctcattggacctcatctaggaacatgtaactcaaaatgtttaccctctatgcatgtttctgaatgatcataaaaaccctgcgagtattaattaggaggtcacaaacaaattttgcaaagttgcaaatatagaatccatgaataatgagaatcaactgtattttcagaaatataattattcacaagctatttctaagaaatctaaaggttgtttcaccaaaattatcgaactaacagaaaaaatggggggtgggggtctaacacaaaagggaaggaagtccccaaggtggctggtgaagagaagtaccaagatgacagctttgtaacagacccaaagagaaccagtctgggttgcagcaggacaatggaatgctccaggaagaatgaaaaaagtagaccattataagtgccaagtaaacaatgattgtacaagaaggaaatataatcattgcacagtatgttcctcagctgtaaataatatttatatggttatatcaatataaacattgaatattgacctaaccaaacaaaaaagaattaatgaggaaaaaaaatggaagttcacaaattcttcagtacaagtaaacagagcaatattttgagggctcaaagaggactcacttttgagtataaggtttttttctagaaactaaagaatattagataaaatgttttcttaataatattcagaaggaaagtacctctaagaaacatttatagattataataagaagagattaatatggaaaatatcagttaactctttaagacaccagatgcaatacaatgccccatttgaagcagtaaattaaagatttgatattgcagaggaaaagaaggtcaataaatgatattaaggaaaattaacaaatattccatgagaaaaatagaggaaaagtaaaatggcaaaaatgagaacaaaagaaaaaaatgggatgaaacaccattgagtttaatctgtaaataatagccattaccaaagatgacaattttatagaacatgagtcaataataaaaagtaaaatatataattcattgatttttctaaatgaggcatttagaatttgaaatgtaaagaaatctataggaatccataaatttaaaaagagactaactttaagacaaaaggtaaaatcgaactcagttttctctgtgatgtactactgtgaagataatcgtggagaatttttgtgggaaaggattgtaacacaagaactctgtgttcagctatgtcattttgtatgtgtgaagatgccggaaagacatcaacagaaaattatgatgtatcatgtaccaatcccagataaaattctagaagggtagtcactcacctggttttgtctatcctgaacaccagcatcttaaggatcaacctgttttacaaacgtatgtttaacaaatatttagtcatgttctttaactgggaactttatggaagggttaaagtgattcactgaaaatgactatgtagaaaaataatcagggaaggggaaaatttgacatttaaaaaattcagctggtaaaatagtgatgagattttttaaaaattttgaataatagtaataggagggagactatctcttctacaaattcatgatttagggataaaaattgacagtaatcagtggggaaaaaaatagaaaccataacaataagtcatgttcacacaaaaaggtcataattgacaaaaggtgcaaatcagttcttttttgcttctataatatttgtatgaaatactcattttagatagtatgtgtccagtgcagtatgagcttgtaacaaaaagacaatagaggacatgtataaatagctaggtattttgggaaaatgggcaatgcagaaaatcaagtgcatgtgcctagaggaatgacaatgtttagtataaaaagatttgctaaaatcttcaatattttaaaataataatggtgataaaaagctgtcctctcattttaatttgaatacgtttactgttttatgctgaattaatattccccacttgtttttgctacagtctattgtgtttaagtagttttcttattactattttactttgaatataagaaatgcctcttaaattttatcaaatgcctctttagtatttacagataaaatctgtaatctcttttaatttgtttttgttccagattacgttgatagatttccagacctgaaactgatactaatgacctctttctggtttactttggcttataggttgctctttttctaatgagattaggtctgagttcttttctttttcatcttttttctttaagaatgaaggcatctaaagctgtagatttttctgaggcaagtattcactgtgtctcacaggttttggaaaaagtattgtttttatttctttctagagaatatgtagtgcaatttttctttttttgacttcgcatcagtttggttggggagagtcaaagaaactgaactagtactaagggaaagtgagccagatttagggtatcagcttttgaaaatctgtaggtggatatctaaatgttacattttaacaatgtaacttaattttaatgaaattatgaaactttaacttgaaaaatatcccagaactatataatgctataatgcattaatcctcttctctaaaaagaatccccaacaaatagttttcagactcttgtggcatatgtatctgtgtgttatattacaacatacaatgttgtgtcatggtattttccattttacgattctattcttttttaaaacatactagaagctcaaggtattggtattcattatcttatttctttgttaaatttagcagtaacattcttccttataattactaccctttaatacttagtctgccttctggagccacaatgaagaaattcaattcctcttccacttgacaggctttcaaatatttaaagttaggcacccttcttctctagctgtcttctcaaaggctcttctctagcccaacatccttctctagcccaaacaaccttatttaattcaattattttttatatagggtcattgtcttgagactttttgccatcctaattttcttcatctatacggatcctagttggtcaaaattattctaaaagtgcactgacacatactaaactaaatatttccaatgatggctcaaagtgaaagtccaatggaattattaccctttttttatagacactaaaaatcatttaatgccaattaagatttcattatctggccgggtgcagtggctcatgcctgtaatcccagcactttgagaggccaaggcggctagatcatttgaggtcaggagtttgagaccagcctggccaacatgaagaaaccctgtctctactaaaaatacaaaaattagccaggtgtagtggcacacacctgtagtcccagctactcgggaggctgaggcaggagaattgcttgaacccaggaggcggaggttgcagtgagctgagattgcgccattgcactcactccagcctgggtgacagagcatgacttcgtctcaaaaaaaaaaaaaaaaagaaagaaagatttcattatctttgtggcttaatattgagattgcaattgacaaaaacactcaagtatttcttacagcaatatctgggaagccatagacaaggtagtctatgctatgaactttgattatattgatgccttggttctctcatatataaagtcaagataatattaatactaactcatagaattttgaagacaatgaaattatttgatatatgtaaagcatttagaatagtggctgataaatgctaagccttcagtaaatgataactgttaacattattataattattatcatctgttttgacatcattctccaacatttttaaaagctagtctccaccataaagagcttgtgtagttgatacattttcccttgaaggaaaactttgaaaaaatcattttaattcagtatgttaaatcataaaaatatcaactgcatgaactatgaaaaacatttacctgtaaatggacaagtgtactcttcgactacgtgtcacatatggttattctcaacaaacatggaatataaaaacacaaaacatgcaaaatacaacacagcctaaactgggttgtgtcagtcaggatctgcaaaagaatattggaatagaaagtgcttggaacagctactacctctgtggctgagggagagtactcaagggaaaaatgaagttgaagagagcctctctccccagggttgagatgcaaatctcactggaggagatgtgtttgcagctgacttgaggtcagagaagtctatgaggatgttagtggactggaggtgatgagtaggaaacctctgctgagatgcccatggttatcactgggcctctgataagctgctggtagctgtgccagagaataagaagaaaagcacctggaaaaagaagctccttcttcttctatgccttgcagttttcctccagcaccctgtactgccaaactttaacactgtgtcagcaggcaaaggaggaagtccagctccactattacaaagcaagctcaaaaaaagggtagatttagagctgaccagcaataaattgatagatggaagaaagatctaacccaatatcgcaattgtaatgctctaaacattctaatatcaatatacaggtgtttgaaaatttgaatgaaaacactttacttttctacagaaagtaaatactatagcagaaagttccacagatgtgtaacattcgatttaaaaaaatatctttgggtgactaaaacacctgccttttcagagcttatgatctagtgagatagactcataaacagccaaatacaatataatatatttagatagaagtgtgcttaagaagctgtaagaatgagacctgaacattaatgactacattgaacagttaaaacaaagagatggatcatagtctacaggattttgacatgagccatcctggaatattttaccctgaaaacttcagtgtcaagaaattctgataaattagattaagttcaaagaagagagacggtgataattaatggaagggaaagactggcttgtgaggggaaaggctaacaaaaataaatctatacaaattagctaagtgacaagagaagcagagagctgacaagcatgagttggatgtaaattcaaaaaagctataatcaaagaatagcacagaaagtggaatttagtctaattcaacaaactttataatgggggaagatgtggagcttgatttaggcctttaagaatgaacatattggctgggcacgggggctcacgcctgtaatgccagcactttggcaggccgaggtgagcggatcatctgagttcagcagttcgagaccagcctcaacatggagaaaccctgtctctactaaaaaaaaaaaaaaaaaaaaaaaatacaaaattagctgggcatggtggtgcatgcctgtaatcccagctactcgggaggctgagacaggagaattgcttgaacctgggaggcagaggttgcgatgagccaagatcgtgccattgcactccagcctgggcaacaaaagcaaaactccgtctcaaaaaaaaaaaaaaaaaaaaaatggacatacttccagcagaaagaatataccacatatgttgatggatggagagtataacaggaaaccttttgttgagccatcagttgagctaatgcaaaagattgtgtcaagatacaagaatgtctctgcctgagagcaaggagattttttttttttgcaccagagtagagccagacagagcgtaggtgctgagaaatgctgacggattaaaagagtaattgaatgaatagtgaaagaatgtcagagaaaggagctacattttggagagtgctgaatgttgaagagatctgtatgttaccttgtaagccatggggactaattgaagggttttatgctgttgctgttatttttatttaagtatgcttcctaacagacacagtagagagaaaagtaacaacataccccattcaaagtgataattccaaaatcagaaaccctgtgttactagccaaaagaaagaaaaataataggatttttcttcctccttttctcatttccaaaatttactcttcctacattctgtcactggtctatcaattaaagtaatcatcctttaaatgtgtgagacagtaaacttgactcacagcaagcaaagaatgagagctttcttaagttaggtggattattttaatctttagaacttcttagccattttctcttcctcaggtgacaggtcctgattcaccagtagcgaggaactctgtgaagatatcataattatttaggtcccattaggtttctcctcactttctcccccattacaaaggtccttgaaaataaattgaatatttcatcaatgaaacttagactaagtagcttatttcactgtttttgaattttgtatatatgtgtgcatacgtattggtgacatacaccaaagtaaaagtaaaaatttatatgtattccctaaagtgaaatgaacagatttttgttcacaatattagattggcaaagtttgtaaatttgtttaactttagatactctgacagctagaaacctacaccaacattttatgatgaattagaagaaggatcctgtagatacacctaaggatacctctgatttcaccttatccacggggaagtatgctctggaaattcagccagttagttgaattatatcctgcattatttttacattatatcttctgcattcataatttctagaactaaccatgggtattctgaagaatagctgtgccaaagagagagaataatctccataaaacatattgtccatacctgttccacatttttctaccaccagatttcttgatcatctagaaatacctaccctttgaacattcacttgtcaaatccctactctttgcaaggtccagttcaaatgccagctctttcatgaagccgtgtttgatccctgtgtctcactcaccacctcctatttcccctccttataagctctcatagaagttcttatttcagattcagttatcaaattctgcctcaacttacggtcaactgtgtatttgtctaatctcttatacttagattgaaattccttgaggttagaagtcatgttttactgataatgttattcacaactcctagtattgcacctgacttacaattaagaactcaataattgattattcaatttaatatagaaagccagttatcgcaattgagaaggctctagtagtagttattattggcaagatgtttgctaagaacacattaaaatgtttcctacttgtgctaggaaatttattagtattcttaagattatattttaatgaagttcggtgagggaaaataagaagaaatactttgggtattagcctactcatatgaaactggctttatgaattcaaagggattagataaaattgattacgtatattgtaaaacccaatgagttgtgattcttctataaatgaaaaagtttaaatgaaatttcaggaaagttacttggtcctcatttaatcttcagtaataaaagaaacagtgtggatatatggctctaagcaattactttagcaattctgattccccattacatcttgagagaatgtgaatgattaaggacacactgagaagtaggataaaattagtaaaggtgtactggatttttaaataaacaatatgaaatatttgtttgcactaaacattcaaaaccatcatttcatttttctagaaggtcaaatacctgccataagccaatggttatgcttccaagcaatagaaacctcagcatttccttggttgagtttcatcctagacagtgccctaaacttctattttattatcatttttgttttgagttacctaagaaccaaatagtcatactaaactattaaagtgagagcgacaaaagttcttctcttaaaagccaaaatagatcatcccataaggatcacagtaccactctcagtttatgagggagaaaaggggtgtggggcagggatttttcttaactgaaaaaccaactcttcttagcaatacagttctaggatatataaaattctttaaaaaactgaatatgactcctcacaatgccatcttttggtgggtgatttcaaatagaggttcactcagaaagaaaaaggggatttttatgaaagagatagaatctggaaagagagaaaaggatcccctcccccacaaaaaaggactgaggagggtggcaggaacattggggaaacaatagctagtgtgaatcagacttgccctggtgtgatctttggatctctttgaatctctttctctttcttggaaatccaccttgattttatagcttatgacctgagccaactactgccatgacatttctgctaaaagcccaaaccattaagacaaaagcagtcttgacatgattaccaagacaggtctgtttgtgcatttcattttatttttaactttgacagataaaattgagtttatgatggcaggcagtggaacctgagaatcaaacaattcagaatacttagctataactggttcttgtaaatacatcttagcagtcaggattgaacaaaaaaaagcaggttggacaagataatttaagcagcaactgagaaaaataaaaatgaattttcttttcctgtgtacttttaaattcccagaaggcttttaaattatcgaagtatttactgaaggtataagacacataagtggaaatcattactgtcatctatattaataatgcctttataattgatgagtgtgtcgtattttcttcttgcaattaaactctgctgtctgagattacagcataaaaaagagtctctgaaaaaaattataaaaacaatttgggggcggcaggtggggccaagatggccaaataggaacagctccagtctacagctcccagcatgagcaacgcagaacatgggtgatttctgcatttccaactgaggtaccaggttcatctcactggagagtgtcagaaagtgggtgcaggacagtgagtgcagcgcactgagtgtgagccaaagcagggcgaggcatcacctcccccgggaagtgcaagaggtcagggaattccctttcctagtcaaagaaaggggtgacagacggcacctggaaaatcgggtcactcccaccctaatactgcgcttttccaatggtcttagcaaacggcacatcaggagattatatcccgcacctggctcggaaggacctacgctcatggagcctcgctcattgctagcacagcagtctgagatcaaactgaaagggggcagcgaagctgggggagggatgcccgccattgcccaggcttcagtaggtaaacaaaatggccaggaagctcgaactgggtggagcccaccacagctcaaggaggcctgcctgcctctgtagactccacctctgagggcagggcacagccaaacaaaaggcagcagaatcctctgcagacttaaatgtccctgtctgacagctttgaagagagtagtggttctcccagcacgcagctggacatcggagaatggacagactgcctccttaagtgggtccctgacccccaagtagcctaactgggaggcactccccagtaggggcagactgacacctcacacggccaggtactcctctgagacaaaacttccagaggaacgatcaggcagcaacatttgctgctcaccaatatctgctgttctgcagccacgactgctgatgcccaggcaaacagggtctggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagtgcctctcctcctccaaaggaacgcagctcctcaccagcaacggaacaaagctggacagggaatgactttgacgagttgagagaataaggcttcagacgatcaaactactccgagctaaaggaggaagtttgaacccatggcaaagaagtaaaaaaccttgaaaaaaaaatgagacaaatggctaactagaataaccaatgcagagaagtccttaaaggacctgatggagctgaaaaccaaggcaccagaactacgtgatgaatggacaagcctcagtagccgatttgatcaactggaagaaagggtatcagtgatggaagatcaaatgaatgaaatgaagtgagaagagaagtttagagaaaaaagaaaaaagaaatgaacaaagcctccaagtaatatgggactatgtgaaaagaccaaatctacgcctgactggtgtacctgaaagtgactgggagaatggaaccaagttggaaaacactctgcaggatattatccaggagaacttccccaatctagcaaggcaggccaacattcaaattcaggaaatacagagaacgccacaaagatgctacttgagaagagcaactccaagacacataattgtcagattcaccaaatttgaaatgaaggaaaaaatgttaagggcagccagagaaaaaggtagggttacccacaaagggaagcccatcagactaacaactgatctctcggcagaaactctacaagccagaagagagtgggggccaatattcaacattcttaaagaaaagaattttcaactcagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaaccagtaccagccactgcaaaaacatgtcaaattgtaaagaccatcgagtctaggaagaaactgcatcaactaatgagcaaaataaccagctaacatcataatgacaggatcaaattcacacataacaatactaaccttaaatgtaaatgggctaaatgctccaattaaaagacacagactggcaaattggataaagagtcaagacccatcagtgtgctgtattcaggaaacccatctcacatgcagaggcacacataggctcaaaataaaagggtggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcatacagcaagtccttagagacctacaaagagacttagactccaacacaataataatgggagactttaacacaccactgtcaacattagacagatcaacgagacagaaagttaacaaggatatccaggacctgaactcagctctgcaccaagaggacctaatagacatctacagaactgtctaccccaaatcaacagaatatacattcttctcatcaccacaccacccttattccaaaattcaccacatagttggaagtaaagcactcctctgcaaatgtaaaagaacagaaattacaacaaactatctctcagaccacagtgcaatcaaactagaactcaggattaagaaactcactcaaaaccactcaactacatggaaactgaacaacctgctcctgaatgactactgggtacataatgaaatgaaagcagaaataaagacgttctttgaaaccaatgagaacaaagtcacaacataccagacctctgggacacattcaaagcagtgtgtagagggaaattcatagcactaaatgcccacaagagaaagcaggaaagatctaaaattgacaccctaacatcacaattaaaagaactagagaagcaagagcaaacacattcaaaagctagcaaaaggcaagaaataactaagatcagagcagaactgaaggaaatagagacacaaaaaacccttcaaaaaattaatgaatccaggagctggttttttgaaaagatcaacaaaattgatagactgctagcaagactaataaagaagaaaagagagaagaatcaaatagacgcaataaaaaatgataaaggggatatcaccagtgatcccacagaaatacaaactaccatcagggaatactataaacacctctacgcaaataaactagaaaatctagaagaaacggataaattcctcgacacatacaccctcccaagactaaaccaggaagaagttgaatctctgaatagaccaataacaggctctgaaattgaggcaataattaatagcttaccaaccaaaaaaagtccaggaccagacagattcacagccgaattctaccagaggtacaaggaggagctagtaccattccttctgaaactattccaatcaatagaaaaagaaggaatcctccctaactaattttatgaggcctgcatcatactgatatcaaagcctggcagagacacaacagaaaaagagaattttagaccaatatccttgatgaacatcaatgcaaaaatcctcagtaaaatactgacaaaccgaatccagcggcacatcaaaatgcttatccaccatgatcaagtgggcttcatccctgggatgcaaggctggttcaacataagcaaatcaataaacgttatccagcatataaacagaaccgatggcaaaaacctcatgattatctcaatagacacagaaaggcctttgacaaaattcaacaacccttcatgctaaaaattctcaataaattaggtattgataggatgtatctcaaaataataagagctatctataacaaacccacagccaatatcatactgaatgggcaaaaactggaagcattcccttgaaaactggcacaagacagggatgccctctctcaccactcctattcaacgtagtgttggaagttctggccagggcaatcaggcaagagaaggaaataaagggtattcaattaggaaaagaggaagtcatattgtccctgtttgcagatgacatgattgtatatctagaaaaccccactgtctcagcccaaaatctccttaagctgataggcaacttcagcaaagtctcaggatacaaaatcaatgtacaaaaatcacaagcactcttatacaccaataacagacaaacagagggccaaatcatgagtgaccgccgattcacaattgcttcaaggagaataaaatacctaggaatccaacttacaagggatatgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttacagattcaatgccatcctcatcaagctaccaatgactttcttcacagaattggaaaacactactttaaagttcatatggaaccaaaaaagagcccacattgccaagtcaatcctaagccaaaagaacaaagctggaggcatcacactacctgacttcaaactatactacaagactacagtaaccaaaacagcctggtactggtaccaaaacagtgatatagaccaatggaacagaacagagccctcagaaataatgccgcatagctacaaccatctgatctttcacaaacctgacaaaaacaagcaatggggaaaggattccctatttaataaatggtgctgggaaaactggctagccatatgtagaaagctgaaactgtatcccttctttacaccttatacaaaaattaattcaagatggattaaagacttaaatgttaaacctagaaccgtaaaaaccctaggagaaaacctaggcaataccattcaggacataggcatgggcaaggacttcatgtctaaaacaccaaaagcaatggcaacagaagccaaaattgacaaatgggatctaattaaactaaagagcttctgcacagcaaaagaaactaccatcagagtgaacaggcaacctacagaatgggagaaaatttttgcaacctactcatctgataaagggttaatatccagaatctacaatgaactcaaacaaatttacaagaaaaaaacaaacaacctcatcaaaaagtgggcaaaggacctgaacagacacttctcaaaagaagacatttatgcatccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgtcagtgggactgtaaactagttcgaccattgtggaagtcagtgtggcaattcctcagggatccagaactagaaataccatttgacccagccatcccattactgggtatatacccaaaggactataaatcatgctgctataaagacacatgcacatgtatgtttattgcagcactattcacaatggcaaagacttggaaccaacccaaatgtccaacaatgatagagtggattaagaaaatgtggcacatatacagcatggaatactatgcagccataaaaataatgagttcgtgtcctttgtagggacatggatgaagctggaaaccatcattcccagcaaactatggcaaggacaaaaaaccaaacgccacatgttctcactcataggtgggaattgaacgatgagaacacatggacacaggaaggggaacatcacacaccagggcctgttgtggggtgggggaaggggggagggataccattaggagatatacctaatgttaaatgacgagttaatgggtgcagcacacccacacggcacatgtatatgtatgtaactaacctgcacgttgtgcacaagtaccctaaaacttaaagcataataaaaaaattaaaaaaaataaaaaatttagtcacgtatttcctttgtgagcttatttggttacatctgaaaatactgagaacttttattccatgaaaatgattgtcccctcaatcaatagcaattgaatgcatcaaatatgtctagcaccatttctgctacacagtaaatactcaaatatatttattggaattagcaaccattcccttttctttgcatcctctacatctgttgtttttttattttttaacaaaagccattctgaggggtgtgagattgtggttttgatttgcatttatctaatgattagtgacgatgaccatttattcatatgtttgttgtcagcttgtcttcttttaagaagtgtctgttcatgtcttttgccttctttttaatagggtgggttttttgcttgaaaatttatttaagtttcttacagattctggatattagacctttgtcagatgcacagtttatgaatatttcccccattctgcaggctgtctgtttacttccttcatagttttgctgtgcagaagttcttgagtttaattatgtcctacttgtcaatttttgattttgttgcaatagcttttgaaaacgtagccaatatcaaaaaggggatttcctaggttttcttctaagattttcatattttgaggtcttacatttaaatattcaatctatcttgagtcagtttttgtatatggtgaaaggttgtggtctagctttattcttctgcatatcagccagctatgatggcactattgactagggagtcctttccttattgcttagttttgttgaatttttcagagattagatggctgtaggtgtatgtccttatttctaggttctctatcctgttccattggtctattgtctatttttgtaccaggaccatgctttttggttaccgtagccttgtagtatagtttgaagtaggataatgtgatgcctcttgctttgttctttttgcttaggattgctttggctattcaggctcttttgttgttgttgttccctatgaattttcaatagtttcttccagttctttaaaaaatgatgttggtagttttatagggatagcattgcatctgtaaattgcatgggatagtatggccattttaatgatgctgattcttccaatccatgaacaaggagtgtttttctatattttatgttgtgatttctttgagcagtgttttgtagttctccttgtagagatctttcacctccttggttaaatcaattcctgggtattttatttttgtttgtggctattgtgaatgggattgcattcttgatttggctctcactttaaatgttattggtatatagaaatgctacctatttttgtgtattatttttctttgccagattttggtgttaggatgatgctgacttcatagagtgagttagagagaagtctctcctccttgacttttttggaatagtttcagttggattggtaacaactcttttttatttgtctggtagaattcagctgtgaatacatctgatcatgagcttttattgattggtaggttttgtattatggatcccatttcagaacttgttactggtctgttcaggttttcagtttcttcctggttcaattatgagaggttgtgtttcaaggaatttatccattttctctagatgtcctattttgtgtacatagcagtgttcataatagtttctgaggatcttttgtatttctgtgggattgattgtaatgttatctgtgtcactgatcttgtttatttatttagagagccaacttttggttttattgatcttttgtgtagattttcacatcttggtttcattcagttctgctccacttttggctatttttttcttctgctaacttcggggttaatttgctcttgtttttctaattcccccatatactgtattagactgttaatttgggagttttctaatttcttcgtctaccagtttagtggaaagtcttgggagatgggcacctgtggccatgtcttgctgccgctgccccctacacaaaatcccttgggctctgcccagacaggagctccacctctgcctattttctgagcagattcccctgccaattcaaatgtctgtggggatcatggcatctcttatagctaggatcccagaggtctgtggcgaaagtggtttgccccacagtcacttcactcagccttccttaatagccattcagggctgggaattagtcctggcacttggcatccccatgcagggtccccagcttcctccatcttcagcctcagttactgtgtcacctctctgttgactctcagtgttttctctcaaaagatctgctttaagtatgtaggtttagtccacattttggtgtctcttggtgagacaggcactttctggctgcatctagttagccctcttgttctgatctcctgaggtgacatttacaccttagggtttgatggtagccaataggtgggctttagcatccctcaactcaatgtcacagttgtatctatactattagaataaactaaagcaaaaaccattattattttaataatccatgactgccagacaaaagtggctatttccttcttacactttaggcagtggtctcattgtccccttggtttgcatagatggatacagcattgctctagccatacaatgctcagtcttccattcagatgctcaaatggagtaagttcttactttatatttcagcacctgaacccaaacaccatgtgttccatttgacagaactggaggcagactttaccttcatggattaggtctgctcttagatcaggatttttcaccctctatgtaagagcatgaggagctataaataaatctatccttaaagccaaaataacaagcccatcttaataaggttatttcagttaacataagaatagttacaaagtaaaggtctgttaaatttatttggaaatataaaattattcctccattatatagtagtttctcaaaacgttaaacatagaattaccatatgaccgagcaattccacttctaggtatatacctaaaagagatgaaatcagggaatcagacacttttgcaccagtgctcatagaaacactattcataatggccaagatgtggaaacagccaagtgtctatcaacagatgaatgggtaaagaaaaagtgatatgtatgtcagtatacatatatatctataggggtgatatagataatatttacatatattttaataatattctattggagtaatacttttaaatattttgtgtgtgtgtgtgcatatatatatgtgtgtgtatatatatatgtgtgtgtgtgtatatatatatatatgtatatatctcatcccaatggaatattgttcatcctcaaaaaggaatgaaattctgatacatactacatggataaactttgaaaatattatgctaagtaaaataagccaaacacaaaagaacaaatattgtatgactatatgattgtatgatttgtatttgtattaatgacagaggctggagaggcaggaatgggaagttattgtttaatgagtataaagtttctgtttaggttgatgataaggttattgaaatgggtagtggcaatgtttgtacaattttgtgaatgtacttaacgccattgaatcataaactttaaaaagattagaatagtaaatatggagttatgtatgttttgccacaataaaaagaaaacgagtaagtaaacttttttttttaaattactcccctgtggtacagttactccattcatcatcacattaagacttcttccaggttggggagtgttgcgagatgttgtcaaaatgaccccacttgtgaaatcagaaaactttcccttaaatctcagctctgtcacctagtaggaatgcaaatttgagcaagtcacttaggtctgttgcaccttaatttcttcaggttatgctgtccaacagagttgttttgatgactgtaattgaaatgcatataaagtgcttcgtaaattcaaacaacaaggcaagtggatggaggtgactttttaaaatatattcttttagggagcttagtcgtaatactgttatctctgaaatgcatttactaattcatatttaaatatactaaaatattaaggtattgttggtaagacagccacagttatttttctaatttttctctatttaaagtattgaatccatagttttagaattaaaaaatcctgaatttccaaggaaccacatttctattcaccatttctataatgaatgggttattaaacctttccatttatcttatttcaataccttttgttcattatgtagcctcattgtacataccttaggaagaagggataattatattacctcagagagaagggacaactatatgattatcttgtctgagatgaaaaactatggtcttcattcatacctaattaaaagttttttgtttttgtttttttttttttgagacggagtctcgctctgtgtcgcccaggctggagtgcagtggcgcgatcttggctcactgcaagctccgcctcccgggttcatgccattctcctgcctcagcctcccgtgtagctgggactacaggcgcccgaaaagttttaacttatttattttgctacctgttctgattttcattccaaaccacaccattatcagtccctacattgtcaaacatgtaataataatttggcatgacattatatcaaattggacattatcttggaaggtcctttggatgcataattatattgaaaaataaatattttaaaagtaacaaattttatgctataacatcataagttaataataaaattaatgtcattgaaacaaatgccaactaatttttttgtttccctctttagcggttatgtctttgactatgattactacagagatgatttctacaatcggtatgtgaatttttcatccttgttttcctatgacttaaattatcttttaaccattttgtacattttattcatgggtgctcttaattatggtatttaaaacaatattattatagttaaaaataaaatactaaatcccaacaaaatatacagatttttatattttcattatacttacttgagtacagtggatcttggaattttaggactttggaggtgctcaaacctaagatttggtgtctaatatttagataaaatcctaaagatttaattaactaatattatctgccaagtcatttgttgatttagaatccttcaagatcaagagtttgaaaactcagaaaaataactccaaccttctgaagtccataataaaacattgaaaatgctatattgggtagagtctgtaaaatttacagatcgttcctgctttgcaggacagtaggaggccacaaaggtgatgatgcaagatgagaccatccaatgaggaaaaaacaggattgtctcatgatcttaaacatgtttgtcaaaacattaacaacttttattctcttctctataaactaatgggaaactatagtaaagctaattgttatttagtatactataatttaaaacaataaaatattaagaattaaggtgttttagttctttgtaaagaacacttatcaaaagtagttgaaacagtgcatgccttctcatttcctaactcaggacaggatacggagtaggcatctgttttatcccttgttggatactcctctctaaggttgaattagctttgacattctatcaatgttgtgaactatctctgagagttctttcaatgtgtgattctcttgccagggtcacttcccctccatagcgttatacgtttcatcacatcacatccactttcctcacttatgtcgataagtttgcctttactaagttcctctgactccatacctagagtctcttgagtagaggagtatcaatatccctataatgagctatttcttctgtaatttcatttacatttaatttgagtttcacatctagtattatcactcttcgattctttgctgcattttcatctttgatcaattctttcttttgattattcaattttgcaaaatgccacgttttgtcactgagagataaggaagcattacaattaatgatctgaaacaagtgagtgaagtgaataatcaatgaacagcaaaaaaaatcattgacagactttgaaagatggaatgtgattagtgatcattgttattatcatgcacatttattatttatgcatttatttgtggaaaagctagaagcaaagtttggactttattaaattacttaccgtttatatgttgtagtaactaaaatttgtgttgtcggagaactggtgttatttaactaatatcagtaactgaaatttatgcatatcagagatgaggatcaactatatatagatagattacgggattaaaaaatgaggtaaatatattttaagcctttaattatgagtattatgcaaacaacaaaaaaaaccttaggtactgtataaaaatgcaaacttagaaaaaatttttcaatagatgttttaaagaggaagtaactgtgatccttgaaagggtcttattctctctgctccagcctctagggccttttgtaagttccacaagaattccatgtttcttcctgcctcaggtcctttctctgtgttgttccatctcctcatacctccctacactacctggttcacttgactcctcatctttcagatctcagcacgaacatccctcacagattaaattaggttcctctgttcctctcgctcagcgcccagcactgttacttcacagcacctctcctaatttctattgctatatttctttctgcagtgtttgattcatgtctgtcttccttcccccacctgaacaatgttcagttttgcttatctttgtatccttggggactatcagtaaacctcacacatagtggatactctgtattattaattcatctccttagatttagagacacagtcattttccgaaggtcaccaagctaattagtgacagaactatgatcataatctaggcatccaatttagattcaataaccaactatgtgaatatgcacaatggggagggcaatatcagcctatggagctatgcgattcctacttgagaatcagacccacaactgtaacttcattgctgcaatggtcaaactactgaattaagcaacttatttcactagttatccttttctgacaaaaaaatataatctttaagaatgattttctcaaagcattttataatttctataaaatatattttaaatattaagaaacttatcataacttattctaaaagtgatgcaaacatctggcagcattaaaataatcccatttactattaaggaaggatatctagactgtttttatactatttgaaaatgttactttttgacaagtttaaagacattttctactatagctattttttcacttgctacgaataaagttttcaattaatatacattgtcttatactctgtctatataaaaccattttagcatcttttattttctatcatatgacttccttatacatttaaagaatttccacctaacatggagttttactctacaccgtaggagacccaagttctggttgttaccggaaaggggtcccaattcagaccccaagagagggttcttgggtcttgcaagaagtaagtcagggcaagtccacagcacaaaagcaagtttattaagaaagaaaggtggtgaaactatagctactccatagacagagcagagtattcccagtattcccaaaagtaagaggaaggacgtgcctgccctaggtacaatgcttgtttatacataggacaacaacaacaacaacaaaaaccatggggagttgtgctctactacaagggtttgtgataaaggatacatttttctaattactgcattttgcaagaatcaatatgactatctttaaagcaaaattaggaatgcttttgttctgaagatatggagatatcaagacattcctgggcctgagtctgtttagtaaacattattaatctgttctcttaaccataaacatctaggagctaggaataaatacctaacctcctgggaatgcagcccagcaagtcccagcctcattcttcctagccctcactcaagatggagtcgctctggtttgaatgcctctgacatggtaactagccttgtaactttaggcaagtcaggttttcagttttctcatctttaaaaggaagccaggatttgcattttactatttagaaatgttagctcaataaaatcattagattagataggtgatagatggatggatggagatagatcgacagatagatagatagataatcaatagatccatcttacttgccaaagaacaagagctttaaatagtcaaattattagagaggctgtagctttcaggtgactctctactatacaagaacttagctacagtatgaacaattttcaaaatcatttatttgttttgtgtacaatctgtttggcatggaagtatgaaatagatcagtatggttgtattgttaacagactgagcagtctgtgctctcgttagtttattttccatttttggcacttggctaagaaagacataagcatctgccactagtggatatactcaagagttccctataaacatagaataccatgaaataaaaacagaatggagaggctggacaagatacatagcttacagagtcactactaatccacagtcatttctcataagttacggtcttcttgcatttgtgttttctttttctctctctcttttagcagaggtgcaaacttgggcaagttagttaatatcacaaaatctgttatgtcctctgggaggtgagcatgaaattaattcctaactcatgaaatcattctaagaattaaatgaggtaacataatgatcagcattatgcctggtattttttagtgcttaatcaatattagctagtattaacagttaacagtaaccattaacaataatggggccaggcgcggtggctcacgcctgatcccagcactttgggaggccgaggcagacggatcacctgcagtggggagtttgagaccagcctggccaacatggtaaaaccccatctctactaaaaatacaaaaattagccaggtctggtggtgggcgcctgtaataccagctactcaggaggctgaggcaggagaattgcttgaacccaggaggcagaggttgcagtgagccgagatcgtgccactgcactccagcctggggacagagcgaaactccgtctaaaaaaaagaaaaagaaaaaggaagaaaaagaaaaaaaaataatggtagatgtatttctcatattgacattcatacagcagtgtccatataactgagaaacaaactggttggtcagtttttcttccattatagctgatttgggacatctctggattattctgttttcccagttttccctctcctactcccccaaagcattccggctgcagctgatcacacttgcctgcagagagcgctcagctgtttctgttaaccccatgctgcttgtttagatcatgaaaacagaaattacactacttacgtataacagggctaattgcatatagaaactcgttaagtcggtattaaagaactgaaaacgcaaaaagacaacactgtgatatactggagttagtgactgcaggaagctgctaccacttctagggctggagaaacaaaggaagatttggggtctcagaaattgctgtagaaaaagagcctaccagagctgaaactatgcataggagattctgttcagatggtgctgctgtgtctgagtccacaaggagaacctgtggtgctgacacccaaatctctgagatggggatatgggctgacaggtgctggggtctttgagggagcgtggagtggctgttctccaagtgttgcaaaattactcagactggattctgctgatgctactggaatgaattgttgttgccaggatgaagaaactagattggggtaatgctgaaaagagcaggaagccaaaacacaaataaaaagcaaaacaagaaggagcaggtcccttttccttgctccaaccttgcagtctctttcttaggtcctttattggctgagcccagcagggagctagctgcccaaccccaaccctaaccctcacctccggaagtgtggttttcagagttccaaacccatcatctgtggctaagggtaggtctgaaaccaagaaacaatagcttaataactaacatatgtccacattatattgtcatactctttctgccaggtttggagactctaatgtgattgagggtttccaacccttagatagttttagcttagaaaacttctttacacaatgttccaccttactgtgattcattgacctgtctattcgtggtttcagggatcatgaagagtatcattaaacagtagatgagtggttattctaaattcttatcttttctcttttacacaaagcattgcccaataatttacagcattgaatggcattttcttttaaaggtccatatatgactctaaatgtaggacattgtatgttaatacattaaacgtaagtatttatactctagcaaagtaaaaggagatgtatacctaaaattatatttaatctccctagggaaagtttttaacttctgcaatgttagctgtctaaatccaacctcttttttcaataatattaggaaaagcactgatcagtttataatttccagtgataaggagacttttattaacagagaaaaacaaatgccacaggtgttttacttctatgtaaaacacgtatacattttaaatgatccaaaataggcattgttcaattctggaaccattttgactttgtgttaattgatccaagaaactactagatttgcagttaacgcaagaacactaagttacagttgtttcagatagttgattagagagcacaatatatattcatgaatattggaaaacatattaacaagaaacaatgttttgttatgcaaatttgaactatcctctggtagtatggtattccatttgaaatgtttgaaaataacagcatggtacacttgacaaatggtattatttggagtcagaagacatgaatttcaggactagatgcacatgtgttgactggttaagcttggataagtcatctcttttttgtgccagtttccttcctgggcaaaatggcttcacactactgaccttacagaattacaagaattaaatgagaaaatcgttttagtggcttataaccccacaacaacatttgaatttattaactttttaattacacaaagctgtatacaaaatgtacagttagcaatgttagataaaatacagactgtattagaatcaaaatattgcaaaaaagatcattcaagattgcaatcaacttgcctttaaaagcatgttcaagaagtatttccgtgtgatccaaggagaaaacttcacagaaaaccttggaaaatttaataacaaaaaagatcaatggaatttactcatttactggtctcaggtagagtgtgccttttaaaattattttctgattcaactgtaaccaaagatttatttgaagtcagagtagaaattataggcagagtttatgagttttgagtagtttaaacagtacagggaacagatacactaccagcctataagaattatttgtgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaaaagaattatttgtgtagatttcaaatctatcccttcttagaaatgaataggcaccttactttggttttatatactgtacatctgtcaaagttaagcataatgaaaaggaaggctggaggttgaatcaagacatggagcaagatcttctctggtcctctggttattgatctttgtagagctactgaaaggtgctggtgagaatatggccctgaatttgttatcaggttttgcctctgggtagcccagaaattttagccccctagggaagaccaaatatttttgttagcatcaactacttagtaactataagttttgattcatgaacaaggaaaaagaagaattgttttcatgagggcaatttagaaagaaacaggtaaataccagaaaatgtttgaagttactactaatctaaaatgaaaatttaatattcagtaataaaatacaacacacatattacatttttcagtttcttttcttgtgttttaaaccacgtttgttgacagtaaaatataagcatcaagtcagaagtttagccatcaggtaatgatttattagaatgtggtgtatctacctgagaaaatgccccacagccattaaaataaacattacgaagaccatttaacaggcctgagaaatgtttgtttttaatataaaccaaagagaatgagctagaatacatgactgtacatatattatgttttcaattatgtgaaaaatatggatgcttataaaaacagattaaagaattatagtagttgttctggggtctgagacttagaattgtagtttttttatgtacttttttttcccaaaatgttactttattattgctaaagcttaataataacaagttcttttttaaaaaagacacttaaaataatgtttgctttgttaatatgcctttgtccaaaaggcacttagtttttaaattaaattacctttgtccaaaaacaattattgtttaagaacagtagatgaaatcaaatgtccttattcttcctagagaaaagttgtctattttatcaaataaactactattaaaattaatattaccagtttttagcttttgctagctaataaagttacatatgtcagatattatttaaagcattaaaaggcaaaataagaaaagggtacatagaaaatagaaatgtttattaaataaagaaattaaattctcaaattttctccatgagttggttttattaaaattggactgaattttttaaatttattacttgacagcaggtgttttagagttttcactgtaaaatggaccttgaggaaagaattattattatatgtttggcttcattataaaccattatctatttgatgagtaagtatttgggagaaaattatcctgaccaagaaatattagggaaaattaagggctattaaaggaaaggagtggaaatataaatccaaagggtaaggaacaagaaaaacaagaggaaggaaaaaaattaaagcttttcactagcctggagatttagattccatttaattctgctggattgccatttctgctgtcagtctacaatcttaaatgaactagttccttagtctcaatactatttgccaatctaatatttgataaaggtaaaatttctttgatttactgtaggccgaattctgatgagaaggccaatacctgtctttcttgggctgcctttcacctacttccctctatattttgaagaacccctatatcccatcttgcaatcgcagaaagccttccccgctttctatccttgtcttgttatgtttttgtacattaggacaacatccagtcttccctccttttatttctaattgactcaagagtgcccaatgaaaattaagaaagtcttcaggtccattaaaagttgtaaaattaaaaattatgccctcgtgttagcccatgttactggtggaggatgtccaggttcttgaacaaataattgggcaaaacgcacaaacaaaggaaggaaagaatgaagtaacaaaagcagaggtttgtggaaaatgaaagtatactccacagggtgggagccaaccgagcataagggctcaagagcctggtgacagaattttctggggtttaaatactctctacaggtttcccattggttgcttggcatacaccctatgtatattaagtagtggcccacaatcagtccgattggttgcgggaggggaccaatcagaggtactttcaatttttcatcggccatgcagaaaaaggtggcaggatgaggaggggcgcaaagggagtagcctctggtccttttgttacttgggcgtagaaaggtggggttttcctttttatttagttctaggaagtcagcatgaaacagccttaggttccctgcctccagaccctattctcctgcctcacgcattcccaattttgttttgtgaatgacctatcacattaaaatatttaagtcctgatgctgcccaacgtcccatcaaagtggaagaaagaattggtaaaacgttacccaataccttggtgaaagtcatccagccaggcttggtggctcatgcgtataatcccattattttaggagcccaagttgggcagatcacttcagtccaagagttcgagaccaggctgggcaatatggcaaaatgctatctctacaaaaaatacaaaaaaatttatccaggcacggtggcatgcagtagtcccagctacttgggaggctgaggtgggagaattgcttgagcccaggaggcagaggttgcagtgaggtcacaccactggtctccagcctgggtgacagagtgacactctgtctcaaaaaaacaagagagagagaaagaaaattagtcattttcctttgaagtaactcaccaaaatattcagagaacaggccactcaccataggaatttataccaaaggaaagttgtttagtaaagtactaagtatattactaaaatgtatgccccatactaaaagcatatcataaatacagtgagcaagtatggctctttctcagcataagatcaggccatgccactgttggaggtttggtaatccttggctgggggaagcaatagaaatattgataaacatttttgtttcctataaaagtagtattaaattacattgcaattaaagtagcagtgaatatagtgaactttacttggcctgtatttttactatagcactcttacatcattgtatattttgattgtgttttagagattttcttaacccaatttatagattggcttgtttagtgaacctgtaaaactacacattggtgtcctagggaaatggtcctgctaaaagagcttgcctttcatttcaagcagcaacttctactctagaagagatcagtcaattgccatattttcttttcactcaatagttttgggtgttatagctcatgcaaagtgcctttgtattttggttcactgacttaaggtgctctgtgaattcaacttataaataactaatgtagatcttgttttgtgattgaaatgaggggcaggtctagctgacccttttgattctcaagcccctagtggtatggatgatattcataacccttttcagcctcatcctgcctgtgctctttgaagtaaactattatgtgttgacatccatgacctgttctttgctagctgttcttcagctctaatggactttgcttagtcacagaagatggcacctctcttgaactctgtctcatttcatttcttttcctttccagatatctcttagttttttccccagcatgttctaaatcattttcgaataccctaagtctctaatgtaggagatattcttaatactaaggaattttgctttaaatttggtttaatagtgctttttgcgcttccctcacctcacagtataatagttttaaatgtctctaaatgaatatttggaaaccagtctatcttaacttttattatatttcatatattatttcctaaaaatagatgatcacattttcatctgtatgtataaacaagatgtaattttatgaattaacctattatagaacttgttttttttattttcttcccattctagtttctcatttctgactttcatattagattgtttttattgactgttttaaagtaattataagaatgtaatccaatattttattctgtcacaataaaatatgtaacaatcataattctaagtcaataatgctattttctttatagtgaataacgtaattacatgtctagttcactggaaaatagtcatgaaaatgaggaaatgtatcccagtattttttcattgaccttttaggttactcaaatgtgctgtcatataaaaatctgttgtatatgtggatgcagtacaaataatatgaagcttctgaatctatgaattatatatttttataaatgagttaacccttataccttgattcctttcattgtttaatggaaattaattgattgtggtgaatatcatttttcacttttccgcaaaggttttaagttttattgatttttttgttaaatatgcttgtaatatctaactataaaatatctctagtctcaatttgcaaatctaacaaatggtcagaataattaaaagatatcttgataaatatttcccaccgtaagtagtcaacagttttatcctcacgctagcttcatgtcattcaaactgtctccttttgtctgcaatcagaggagactttgttactgaaaagattcttaaagtgagctgaagcaccatattgatttgtctgtcatagctgttttcttgaagctggttttactttttatcttgctgggctgtttactgtttgaacagtaattttatttctttgttcctgttctgcaagatcttttcctcttttaaactaatgtgctaataagtgtttgatgtgtaagaggaatatttctgttcataagaagtgtaaatctgttttaccaagcaaagaaatatatttaggaatgaaggtcagcataatttcaacaaattgcatggtactgttggagcaaagctccttgtcctttcataccttacaaatgagttcctcttggaggtcacactctaaagtccagaaagcatagactatattagcatctattttcttagtgaaaattaaatctgccaataaatacctgcatctgaatattagagaacagcagcagaaagaaaacatttattgaaattttctaccaggacattctgttcaacatttcacatatttgatagaactctcgggcatcaaaccaactctcagtcccatttgtgttttgtaaaggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaatgtaagtaatgtccttcattttatttctctttaaagaagggagtgattaactatcattgcacgaatgcctatattcaataaattaaccagatagttatgaaggacctgctatgtataaagtgttagaaaatcataagatggataaaaaatggtctctgctttccaccatactgtgttgcagtaggggagacaaacacaaaaatgtctaacaaaaatccaggaccaatttgaaaagtattttatcagagcaaataacactgtgctcttggcttagcttgtgatatattaaagtactgaaatataatatgttgcttttaatgaagaaataattttacttccaaagggagtgcataaactgtcttttcagagaaacatacaaaattagttcatggtttgaatatttgagcaattaagagaggcaaactatagagatgttaaaagcataatttaccatacagtgataaattatgataagatatatgtatctgaagatatatttaatgtcataaaaagtaaaataatatttgcatagtttcacattaattagtaaaaagcagcgatacaaactttccaactaaacacattgctaaatttttatatggagtgatacagaaaaaaattttatttgttagaatattattcataaagaaaggataacaaaatttcccatattccttgagattgccttttatcagaaaacaaacagataataagctgacctataggtaaaagaataaacacatagagaaagttgagaacactatatttcattgactgaggtgacatttgagtggaaacctaaaggaagtgaggaaaagagaaagtgaccttgaaactgtcagagacagagcattctgtggagagaaaatggtcagtgcagagaccttaaattgaatagtcaaggaacaataaggaagccagtgtggctgcaacagagccgagccagagagagaaagtctggctggggatcaggtcagagagttagacacagggcaagttccaatgcagcttggtaagccgccgtagagacttggatttactctgcatcccaaccatttaagacaagtaaggcaaatactattatcccagttttattgatgagtaaacacagaaagtcatatagctaatagacatagtagagtctcttagttcttatgcctatgtgctatctgctgtagaacactgccttttatttcagcactatactgagatagaatcactattgaaacactttgtttttacaaaatgcagttcaaaatgcaggaaggtactgatgcttctgaaaaggctaaagtttgttgtactcaacaaactttgtggacctaactaagataacttcaatagcacactaaatagatttatggatttctatgtaattatgtattcatgtatctattctgtagatagataaatatgaattccattttgagtcttagtaataaaagaaaaggagtttctgcaactcgttggaggttaggtcaccccaatgtggagtatacacaagtttctatctctcaaaaagtctccaagtgttgaaaatttcaatgacttatttcttacattggaaaaaataaaccatgaagggacttttatagaaagacaaattaccaaagtcagctacttggagaaataatgtgaagagactttacagtttgtaaccattacaacatgtaacataagaatctatccttaagtccaatggtaaatcacacatgaggtttaatttcatcttttctttgtgtgtgtgtttgtgtgtgtgtgtgtgtgtaagatgcgacagtcttgaaaaaaggctaaatctgaaaattggactactaaatacaaactagagatattttgaaagaaatgtggtgtgttttattttttagcagcaatcattctttggaactgtgtatcctagagtatctctgttatgctggaaagatatagataagcaataggtagaaatataaattatgggataaaaagattttgtaaggacaatcaagacaaatgatcatttaaaatctattcagcatgttataattgtgttaattttacttacttttgtgaagtggtgtatctttattatattgaggttaaatcaaaaggaaatgtttcatataaagcactggggaaaatcactttaaaagatttatcctaaggattaaatctaagcttggaggtagaatagtcatgtggtttccagcatcaataagatagctccaagggattactgcagagagacaggcaagccataggctataggtgcaaccccagtaagatacttgagtcagggagcttggcaggcctggtttacatggtagaaaacaggggcccctgggcctgctccaagccagccctgcagcagagcttctgtgtagtagtcaatgtcatggtcagtcacatcccagagagtacccagaaacaaggggcagccagccatgatgtacttgagcatgatgccagccccctgttattatagaaagacaacagactgatctattctattcatttcatatagttctataaatttagagctcaagtcacaaaagctaactgttgattagtgttactttagtgaaacattaataaaaatttataattcactggcaagcataactagaatcatgatttaatattctttttaggagcatattggcagattacattatgtatacatatatgtaaataaaatatatatgtgcatgtataaatattcattaatttatagtactttttataattaggttggtttctggaaataacaaaagtttctaactcaaatcacaaatgaaaagtatcagtgaaatttaaaatatactatgttaatattgaaataatttgaataaagatttactaaggtatatagcttgctctttaattaatagctctttccagcatttaatggtttggcaagttcagaagaggaaattaatgttatagcttggataatttgtcatttcttatttcagaatttgtaatatgactgaattctgctaaggagaaaactatataaagaaaatatattaatgtcataatttaccaaaaatgaatactgataagcatttaaaatgaactgctttaaatagattgccactaggcatttctgtcccttttaaaatcaaattgaactaaaactataatcagcttgtcctttcctgacatcatagagtcataaaataaagaaaatgtgacattgcagattagcattttacaaaagagaaaacatgaatatcagtgagctttagctgtagtttcttagtggaaaaattgatgccctctggaaaaaaaaattcgatcaagtcaatttctttaaagaattaatttaaattctaatgtctaacaagaaagactctagtaagtttgaatgcctttggggacctgtcaatgcactttcagtgacagaataggtgacaaactaatataaatgccctgaagcatctaacaggaaattaaagacaattcaattaaagttaaaattgagaatttatccccaatgctaagaaggctttcttatgttgggttcctcccctcaaaagtatgattgaaatacagcgataaagcatcaaccagagaaataatattaatactcagcaacatatcattaaacattcccatccatccattatcctaggcaaagtatattctgctttagagatttttaaagagagaatgtactattggccggaaaggttagagaaggcttaacagaggattttgaactgagtttagatgagccagtagattctgaaagatagaatgagagatacttgctttctgggagacaagatctgggtggagaagaacagaggctttcctgtcagattgcctggagtggagtctgttccatagtatactaccatcgtggccttggggaaatcctttaacccctatatacctctaatttctacctggaaattgaaaataatatactgtgtatccaatagttattgtaagaattgaattacttatgtatataaaatgcttaggcacatagtaatgttcaatgaggttaattattgctactactataattattatagcagttaagagtattaaatatgaaattgctgaacctagaatccaatagtgcctcagccatttattatgtgtgttttgcagcaaggtacttgcttgctgtgccttagtttcctcatctataaaatgggaatgataatcttactgccttctctgtagagttctgaggattgaatgagccagcacatgtagagctcttagaacagtgtcggctaatataaaagccttaatagataatactgtgacagtaaaaataataactattattatctgaagtgaagatttactgctaggaatgtcagttaataaactgaggacattattattaaacaagatataaaaatgggtaaaaggataatgaaaaactgtgcagagtattgaagggttcagatttcatgcagggccaagataaaaaaattctcagcaaagtgctacctgctcaaaatgatattttaggacatctatatgatgggtggcattagttggcgagggctgccataacaaagtaccacagttcgggtggcttaaacaacagaaatttattttatcacaatgatggaggctgaaagttggagatcaaagtgtcagaaggcttggttccttctgatggctgtgaggtaaggatctgtgtcagtcctctctccttgactggtagatgaccatcttctccccatgtcttcacactgttttctctctttgtgtgtcttgtctaataaatttcctcttgttataaggacaagtttagacccctctatgttacaagggcatcacctgtcctctaacttcaggccagttgttcgtttttttattatgggacttacacttttctgcttcatgttatagttatttgtatgcacatctaatctttctattttcaattacaaattcattcaagttaattatgctttgcacagattatactcttaaacatttgtgaaatgtgacatcactactatttttgctttttgcattttactttttgtcatacattttatatttgactttgaaccaaatctttagaaatgctacagttcagagaaaattagttacagaatatgttgcatcagtcggtgaaacaaggggacaaattctggcctacactccagggtctaaaagaaatcagtatgacgtgtattttcaagctatgtgatttgagatctgctacttctgttacttagaagactgtttttgcttgctgaaatctaaagtatcttttcagtcataactcaaaaactcattcttttgtgactattttcacaatcagttatcatcaaaactaatttatcttttttctttgcccacatagctgatacaagttcaattaatcagcacctaacacagacaggtactaattttccattgacgaaatagacatgagccctgaggaactatttcatagacaaaatagacatgatctttcattttcaggcacttatatctggtcgggggcaggggggaccagaaaatttaaaaatgtgagataatttcaatatcaggtgacagaacatttttactatttctcttttttttgtattttatatgcataataataaattagttacatgtttcttgtctgtcactagttatagagtccatgagaccagggaggcagttcaccatgatgggcagtggggggtaggagggtgggacctatatacccatggctttggagtcaggcagcccactctaaacttgaattgttgcctattggctaaagcaatctttttaaagaacacttaaaaaatttttttagaaatagagtatcactctgtcacccaggctggaatgcagtggcatgtaacctcaaactcctgcactcaagctatcctcccacctcagcctcctgaagaaccaggaatacaggtgcataccaccatgcctggctaatttccttattttttgtggagttagggatctcagcatgttgcccaggctgatcgtaaactcctggctcaagcaactctcctgcctcagcctcctaaagcactgggattagaggctgaacaactatgcccagcctgctaagcaatcttaattaaacacattacttaacttctctaatattcactattcaaatccaaaagtaagtttaacaattctgatttgcatattgggaataaattaaatgatacacttgcagcttctaatgaaatgcaagatgaacagatgcatatagtaggcatttaatgaatacttactgaataaaatccactcattctccatttcattttctttctaaaaaatatagaaagaatgggtatagatgtatgtaggcataagtattatgaatacatatatatgcatatatatgtaattccctgttctaggaaatttcatctatggggtgggtgataaccagttgctgcaatttattttagcaaaatactttaaagtttgacttttgaaaactattttctagactagcaaattagccttttcatattaaattagcttcaaaaattgtattatgtattatgttacaagggtatcacctgtcctataacttcaggccagttgttcattttcttattataggatatttatatatatatataaagaaagggacagatgggagcagagcggaggcgttgaagtgatcatgataaagagttccaggaaccttccttttctttttctgaatattattgaattaagcacagtgattccttgatcatatttttcacatcaactgaagctgcatggcacaataaaaaatatagaattgaaagtaagaaaatctaggtttgagcctaaactcttacctgtgcatatcacatgactttgggaaaatcatgtacatcatcagattctcagattctttattgttgaaatactgtatttaaaactgatttataaattaagtgatatgcaaattttatttatttctttgttttggacattcaaataatgtataatggctggggaaaataaataacaaattaatgtgatttactgtcaaagtccacatgattataaacatttttcagttttctaaatagttgataggaagcatggtattggtaagggaggttatatctagagcagggtttcaatagtttggcatgatcggcatttggggtcagataattctgtgatgcggtgtgggctatcttgtgcactgtaggatgttgagcagactaaatcctcactagaagccagtaggaccaccccctccaagtcataacaaggaaaaatgtctccagacacagcagaatctctcctgcagagcaaaatcaccatgttaagaaccacggatctagacagttagctgaaacttctttatttaccctgaatagacttgacccaaagatgattaaaataaattgaaatatttttggccacataagtcagaaatgcacagatttttatatagacagatgatatcatcccgtgtgcctaatattctttttggattatatcttatgtcacagcagaaggcacaatcattttgtcaactgtatcagaatgtaataacatttatcaccaaatcaatgaactctatagagagagcagatctgaaatgacttaatgtgacttatttttaaaaacaaagatactacagtgatagtgatgcaacctgacttctatttctctagtgttcttcttgcctaaaaataagctaaagtaatttgtcctaggaactttgtaatttttttaatttatcattttgctgatttttgtttggtaattctaaattcaagccctataatcactcatagaaaaataagttgtcctcaacaagacaaccagagatttttattatgacagtatgtttgcttttgtgtataatttttttttttttttgagtcagagtctcactttgtcacccaggctggtgtgcagtggtgcgatcttggctcggtgcaatctctgtctcctgggttcaagcaattctctgcctcagcctcccaagtagctgggattacaggtgcgtgccaccatgcccagctaatttttgtatttttagtagagacggggttttaccatgtttgtgtataatttttgacaagttttttttgtggtaaaatttatctagagaaaaagagcaaaagatatttttcctgtgaagatagtattaccaatgtcttctaaaatatctgtaatgtatatatatatatatatatatatgctcaactactagagaatagtaagcaaaaatagggatttaatataattcactgtgcaggagagaagttgttaacaggaggggaaaaagtagaaaacaaaagcagaagagagctagaaagagcagtacatgagagatagaggaggttcatcccaggcattccatctagaaaccacatgtaatagcacaaaaccgtaccccatatatagatagtgactctgcatgaagaaaagtagaaagtggactaaggccaattggactaggtaaggggcaagccttttcccaaggacagcactgagatattgaagtgtgatgaggaaacgacttctacaactgctcaagaggcagccaagactatttgtagagcctgctttgcaggacctagatgagcatttgctgcccccccattctaagagggaactgagcagcctgcatagggttagaggctcactttaacatttcctggtagggtccaggaaagaactgacaggatttccgtgttacatttcaacattgtttcttgagtaacattaacttattagacccaaattccataataatccagctgagatctgaaagatgttctttcagtgctagacctgagtctagacttaaatgaaaccttggctccctggagacttctaagttccagccagatgagtctatattgttttctaatgtagtttcaataaagtggagtagtagtggtttattggcttgttttttaaggcaatacataaattaaaattagtcaactgcattcctgggctaaggagtagctctagttgctaagaaatatattctgttagttttcagctatagtcctatttatttctcctgcattgaaatctaatgttataagataaaatattttctattaaatttgatacgtttaagtaaaactacatatgccttcatcaaaggaatgagtaccactcttcaaagcaaaatcaatttgcaattgtgacagatgatgtttttcaaatttagctgcaattccacaatggtactttgatgtctttgaagtaattgacatgaggagtgattctctattttaccctgttctactttcagtttagtcattcctcagagggatactctagagggcccatgcttcttgcagtttttattttgcaaactactttgcattgtaaataaaagtctgctttaaaaaaaatctgatttgacaatgggaaaagttttctcatttttatacaaaaatctgttcttcccttaagatttagtgtttatgatccataacatatcatgtatattatatcatttatcttaatcgacaaatagttctattttaagcaaacataaattgcattttgtttttgtttttttattttttcaaaaaagtctgaagactaaagaatcaagttaaacactctaatttcctcagaaatttctggggaatatctagtctgagattattagaaaccagaaggaaaagagacagaagataaatagactggaaacaaataagtatccaagatcttgaaacttggctcttgaatgaggtgtgaatactgccagtccacctaataaaagctcggaggcagatatagctgttccattgtaatggctttaaaatctttcatctctgattgttgtggattcaaaatatttctaaattccattatccatttgcatacccttcagtcaaaagatttaggattaaatgctcgtgtcactgagaatccccatttgtaactggcataatcattcagtattccaggatcactagaagtaatgagaagttgataaaattgaaatggttttcagaaaaataaggacagtgcagtaaattttttacaaatataaacatatttcatttaaagaattgtcttcgaaatatgagattgttctttccttaagcctttttcccttataaaataattactgtagtcaatagtaggctatttattgttgtttttaacatccatacttggcaaaatgaaaaattgtcatcttatgttagtccccagttgttttctttgaaactgtactaaactctaaaaatctagaatgggaactactactattgaaattatcagtgagaacttctgtgattttcctttccatcaagcccagggcttagagggaggcatgtacaactcactgccttagttttatttaggaaaactgaagcttcatagcagctttgagtgagctggaaagagttttctcacatctaagacattttctttaaaggataaattgtatatcctggtttccatcaatcttcaaggagctggattaaaatatcattgactgctgaaatacatattacaacatagttcctcaaagtagtatctggcatgatttaattattgcttcatctgaatccctctcacattgaagatttactctattttgtaaaatttagcatcattgggttattttaaaaaatatttcttaattccgttatccatttccataaccttcagtcaaaagatttaggattaaacgctcatgtcactgagaatccgtatttgtaattggcaaaatcatccagtattccaggatcactagaagtaatgtgaagttgataaaattgaaaaatgtcctatgtgatttgacacagacttgagaaaatacggggtccctgtgagttcggtcctaggtgagttatggtgcatttgatgctctgttgttttcttccttctttctactttccagtgaaatcagatgagttacagaccatcaagaaagaattaacccagatcaaaactaaaattgactccttgctagggcgcctggagaagattgagaaacagcagaaggcggaggcaggtaagtgatctctgatcacagacaggtcagaattgaaccagtgaaacgttgtcaatcacagaagcagtacagggccaggaagacactggctgagtttaacagtgtttaatacagatgtgccaacaatgtctttaagcccagagttgcaataataaaatgtgattttttttcttttagagaacatgaactaatttttctaaggttcatactaaaaataaaaggcaaggacaagtgttttggtggaataatcagtagtagttgagtcacagttgaaactttatctcaatatcaagtaacctttcagaaaataaaatcaattaacagaataatgctatcaggctaacataatattcatatataattaaattaactgcagcaaaatttgacaggtttcaacaattattataatgcccaactcctgcctttgctgccaccctgaaagacttcagtacccaagttcaggaacatcaagactaagaccatgcacctggctacccacaggccaagttatttgatcatatattttacaatttaatagcctctgtcttttgaattatcagccctgacccagctcctttctagtaccagtctaatgctcttttcatatggctacagatattttttgagtcacaagtatatgagacctggtataaacttagaagtaggccacagtttgaaaagtgtgctctatgaggctttagacgcctcagaagcctccttggagttaagatggggattaggaagagacccggtaggtagacagacttatgcctcttcgaatcccagcccttcctctgaccagtgtaacttccctgtatctgttctagatactggcattcaacataagacttaatttgctggaagagttccatttcttataaaataaataaataaataaagtgtgaaagcccttgataaatccaacctcttcattttgcagatgagaaaacaaaggctcaggaaagtaaatcgattttcctagacctgtatatctaattagtgatagacctcggtctcaaactcagggcttgtaactgaatttagtgccctttcccatttacagccccaatctcaggttctcctcagagctttgtcccaggatttcactaaagtaaggctatctgggtgacacctaaatgatgagaactcatggggacctagggcccctgagctaccacacacaggagcctgtcagtttgttgactcatatcactggggtgagggttggagcgtacccttggcagtgagccatacagggctcaagaatgaaaagaagcacatgtgaggtggtagtgtagcataatggatgagagaaataaactctggttcaaatcgctgtataccacattcacagttttctcatttataaaatgatactgatggctgcctcacatggtgagtaatgaacaaagtggcatatgtaaactatatagcacagagttaaaaatataataattggagttatcaaggactagtagcaacacacccatgtacaggcaaatggacatttcctccgactttcatacggctcatttttaaaaaacataagccatgtacctagcacatggtcaactcacactaacccttgttaaggtagatgaggaatgatagactaaatggaatctttcttaattaaagatttctattacaaatgtattatttccaattcagaaaggcatacttgcctatactttttaataaaaaaaatagattttagaaagtttttaacatgctgtctatggcactgaaatgttactgtaactgaaatattctgtcatgttgcctaaatcaatatttccctttgaggaactctgtaaaattcattattatgtaaaacaacccttacagcaaaggactttgataaccaatttgcacttcagtttaaaggattatggagaactcatttaaatatggagaactcatttaaatataaatcacctcaaagagaaaaatgtggtccttattccatcataatatacctttcagtttgctgcaatgactaataccttccatatatctttttggaagatcatttagaaatgtaacactaaaattcaaagcttgcatctttttttcatgagatgtcacttacttttgaacatgtttaaacttttacagtcatgagacagttgcttttaaaataataagacttagtcctttgatatttatgtctctttaactttttatgaagaaaatgaatttgtaactccattcttttagtaattgtttcctgaatagtgtatttatagaaataaaagataaatgttttatatattttactatattttcttcacgaaaaaaatcaggtttgcttggaaagaattaacactaccttatggaaagtagagtgaaatgcactaaaactcattttaaaatgctcagtggctccttattcaaggggacagtcattacaatgcttaattagttgaaagctaattacttacttggtagctagcatttactcttcattattactctttcataaatttctcactcctaatttactattagttatttatttaatagtgaaattttccagcagagaaataatggcaggaaggagatggagaatctgaaagtgtggggaaggacacacaacatgggctgtgcctgaggtcaagttccatagtatcttttttttggaagcgaactcctaagctctcagtacattactttggattttctataccttaaattgctcaaatagatgtgtgtgtggtgtcctgtcatttgagattgttaagttcctcagaacaagatcatgtcttctcttccctaactctacccaacaccaggtattatgtactgggcacaacttagcaagtcatttaactctcttaggtctcaagtctttcaaatgtaaactagaggaatgggttatggcctcaaatgtatattctggcttctaaaactatgattactgtgaatccaccatgcatgtattattttttccattacatcacacaacttctttggggatatagtgactatgtagattatagaaaaccacaagtaacacttaaaatcagttcggccagcaattttgcctcattgttagatgattcttttaaaagagccgcatataagttgccacatatgcatagcacaaattacatgctttacgcaaagatgttaagtgaacaaaaacagtgaaaagcacaagaaggaaaagtaaaaagactggatagcatgcaatgggaacagttactccatgggtaactacattttttaaaaaattacatttcaagtgcagactttctgaagtgaaaaggcaattattagacattatttagttcaattttattctcactgttattcctgatacatgagcagccaagtctgactgggacaattccagtgataacattgggatgttagacttacgtcttagagaggttacaagcaggagtcccacaagataaattcatcctacccatatgtttggtataagagatgaagttttcaaaaataaattaatgtccaaaaattggagtattgtaaacaaatctcaaaatatgagctcttttgaaaatattgaacttttcaatactgctactcaatcactctacacatggcatgcacttttcagtttgctaatatctttatccagccagttcatgtatttatattatctatttggtccctgttcacattcatgtctgagactcccattgcaggttttccttacactgagctaaaatgtattttgctttcacttggttcagttatcactcttatgttctctgaaaagaaacttaatgtctaattctttgtgatacaacagtcaattaagaatttaaagggagtggccggccgcggtggctcacacctgtaatcctagcactttgggaggctgaggcaagtggatcacttgaggttaggagttcgagaccagcctggccaacatggtgaaaccctgtctctacgaaaaatacaaaaattagccggatgtggtggcacatgcctgtaatcccagctactcaggagtctgaggcaggagaattgcttgaacccaggaggtggaagttgcagtgaactgagatcacgccactgcacttcaacctgggcgacagcgagattccatctcaaaacaaataaatatatatatatatatatacacatatacgcacacacatatatatttaaagggagctatagtattctcacccctccaaaacctttgaacagagagttgatatcattggcctatgggtattcatcttaactgcattcaaattttgatcacagcatcgtagaggcctttttggtctagagaaatatcaacagttcctttagttgcttctcatttaacttggttttgcaccttaaactattgccatctctcttctctagtcattatgtagtttgtcaacacagattacgttgctcagaatggaaagtgttgctccagatatgatctgactgctgtagcctataacatgactaccatttctgttctgaataccttactgctctcattgacacttcagattgaattggtgatgcttccggttaaagatgatgaattaaacacatgaattgagcagtgttttctcttgaagctgcattaaaaacaaggaaagggtttagcagctggacaggaggtatacctaatttagcacatcctagaaatccaagtccaattttaatcacaaactcccaaaaagctcagaattcaaggcatcatattcccctggaaaataaatggttgaaagtctgtttaggaaacagattcctatgtcccagctatcccaactgcactttgaaagaaggctggagaagtttcctctagtgaaggtaaaacagtgggtctcagggctggtagacaataaggaaacttgagagcacttaaaagcagagagggagaaagtttccgtaattactgtagaaatgcccaccttctccctgactcagctaccacagcactggcaggacactagaagagtcttcagttgagaacatgagcagcccaagaggaaagacttaaagatgctgatagagggtcaactaaggaatcactcagccagaccacctacagagacagtatctctctatacttacaaagttgccagtcaatattttaatgccctactgttaatgtgaacaaacaagaatcaccagatcaaagaacatagttaataagcaaatgccaaaaaaaaaagaagtcagaggaaacaaacatatacaggaagaataaaacttcaaaaagaaaaaaaaaacactaataccctcagagaaatgagaagatactgtaataaaaacataaaattatagaactgagtattcaaagcgctgataaaagagcttttataaattaacatatgatagcacaaataaataactcaatacaatgattggaagacaaaattggaaaaactctcccagaaaatatggaaaaaaaaacagaaatggaaaataggggaaggatatgagaattacacgatgaatatctgaataagctttagtttcagttttcctaggtcatctgtattcattctgagttgggtttcagtttacctatgtgggaacccaaggcacgggaaccatctcagcctaatggccttccaattaactgttttaatatgccctttctctgaaaagtactaaaaagagtacttcaccaaaaacacagcgataaaccaagaaagaggaaaaacagagccttcctaaagcatggactctaaaagcaaaaaacaaaaggaattctcaagatagaggtaacagagatcctaggagatgagctgtgcaagagatctggaaagaaatgagtccagatcagaactgctcaaaagctctgggatagactttttaagacatcaaaattgatgaaatagctactgggtgggaaagaggattggttgagaaggaggggtaagtttgcataagtacgtaaagagaagcacatagagaacgaatttttaaaacttgaggcaatttttaattctagagaaaataaaatattcttcaggaaagaaaaagtattcatcctgtactaacaacttagctgcacaaagtactttcaccataaaaattgtgtaaaaactgaaaatttattaaatccaatttacaatatgattctctagagagatgggaagtgaatggggattataggaccaagaactgaatcctcagcttcctagggataatgtcaacagatagtgcataaaactgatcgagaagtagcaatataaacaatatttagagataggagtgcatgtatttaaaagattcagccaagtgagtggaaagcctttaaggagctggaaatggtgaacaggtaggaacaaaacgctgctgttttccatagcaagcttgtagaaatatttgagtacaaaaattaaatattttaaagaagttaaatataagggggtgaaaagacattgagttgtccttagcaactagatcaaacctttcaactgcttactggagtgcttcctgtagtgcttcctcagttaactgtaaaggcaagattgccctggacacttactaaaagcagcaaggaaggctttgttcaagactattgcaataggagataaaattgaactcaactctgcaaaaataaaaggcagaataattttttgaattctagaatgagctaaaggcaggcagattcttgaatgctggagcaagctaatggaaaagtattgggggatgttggaggaggatatttggccaccatctgtgtttgctaattagctcttattaaagttaggctgctactctcccaaggagactggaagacaatggctctatcttattcaatgataacatgtcaaagagatagctcctgaatcttaagaaaaatattcctgggttacagaaaatttgcctctcaaatgggcagagaaagaatttacaattgcaagtttgctaaagcaaacactctaaggaaaggatgctccagggcctatggtcaggaagaaacctacctgtagtttagtcaagccaaggggaatattgaagccatcttgtgaataactcaatcacagtctttcaaaattgaattctttctcctcactttcctacctagatatactcctctgtaccctatctctgtcatcactattacataaatcctgtccatcaaattgccagtctcaacattatcctctattcctaccatagcagtgttgccaaatcttaccttgggtatatttttcaccccttccctctattttcctaaagatacgccaatacccaaaccctcatcatctctcacatgttctgttgcattcatcttattttttacaccaatttattgaggtacagtttacatagaataaaatttactcatttcaagagtacaattcaatgacttagtgattttaccaagtgatacaaccatcaccacaaatcagttaggacattttcatccccctaaaaatcaccttttagttggtctccacttctggtttgcttcctcccgaattcaccttccttgtggaaaacagatttacattatctaaggtcccagacaggaataaaacaaaactaggttcacatcccactagagacctagtttaacttactagctgaatgaaatttggaaaagtccttataaaacctattaaatggttttataaggattatataatatctctactaaaaccattattagatttaaataaacacaattatataccagtaatttttaaatgatttatgttgcatttgtgtcatctcaacaatctagggtatttcatgtgaacaactttgaagccatttcctccaaaaatgtactcacataactaatatattcatctaaaacattctatgtaattttcctgatgttcatttatgtggctgatagtaataccatccaaaataagttgtatttttctaaatggaatttattggaaccattgagttaaattaatactatatacaggtgttgtaatataaaatttttcttaaaatacagtttatgcttgtatgcaaaaacaatgattcaaggatactaacttggctctagtgaataatgtgactgtttttgtatcaacattctttccaaccatctgctaagtacaattcagctagcaattatctagcaattaagccagcatgtcaaaaaacttaattgccaactcaaccaattttcatagttatattaatgataatagctatgcagcaaactcaatttaataaaaacactttgaacataaatcccaacaattctaacttgttttctgaatcgtagatagctttttgaagtagagatgagatgtgcagaaaaaatatttgaatatgaggattggaatttaatattaaattcttttctttcatggttttttaaagctttaggcattttcccttaaacagaaatacttacctgtaatttgtacttcttttcctttgatagtcattgtttagctaactagaacatgtgcccctaactaaacagacttcttcattcttgaacttaaaattggttattgaagagatttgaagtattcccttggtatgtcaaattaggccttctttttttagagatatattagaaaacagccaaggttataagatcagaaatttaaacttggaattccagctcttgcacttattactgtgtgaccatgagcacttatttgtgcctcagtttccccatgtgtaaaatgataaataagcctacattgcagtatatttcaaggactaaagttaatgaatcttacatggtcagcacttcataagcacacactaacttgtagccattataaaccgtttctttttgtaatccataatgtaggtgtcttagaggtgtctttttacataagctgttggctttttggcttctaatcgacctttaaaaaaaatctaatactcatttctcttttcacaaaagaaatgctatggtcatccatcactctgacttaaagaagccaacagacactccaaaagatgccagtgttcgaaggcagccctcctccaataagcactggaagacttcacatttcatttttctcttgaagacttgtcaatataaacacaaacaattttcttcccagaaaatttcagacctcacattttactttgactttgtggtttgggattgtcatgtagaatgtggcaacgaggtttttcagttttgtttctttttaagttatcttggatttatatttttgttaccatggtgtgcaaaattcaactgtcactttaactgaaaagaatttgacacatttgatatttattttaattagttgattccacaattcattaatatattcagcaaacacttaacttgtgattaagggtctgagttagccaccaggtaaacaaagatgaataataaaaatgtttctgacccaaagaagctttagcagcagagagagaaatgcacatacacacaaacacacatacacactcacacaatcacattgacagtaaaaagagtgatgactagaagaataactatgcaaataaagagaattgtataaagaacgaactaaacgttactcatctccaagaaaagtaaaattagataattattcataaaaaaagaacaagttgctttatctctacttcagcaatgtaattactgaatcaaaactgcctattaaactgtgaaccaacagtttaataaagaagatgtgctttcatgtgtgattttattcatggaacctatcattgtttagtgattataatatttcccattgagatgatgacaaaagctatgttgactacctattactaacacacaggctgattgtatttgttaaactcctgtgactcaataccattataattaaagcttttttttccctcaactcagataatgacttccaagcatttagctttcaagttaatgattggatgatgagaataatatataggattttttgcaatgaactgtattaatataccactgcctttgaaatacatcgtcagaatcacatgtatattgtatgttaatacaaaaaatagagtaactatgtctatgtactatatactgtattagtttgttctcatgctgctaataaagacatacccaagactgggtaacttaaaaagaaaaagaggtttaatgaactcacagttccatgtggctggggaggcctcacagtcatagcagaaagtgaaaggcacatcttatatggcagcaggcaagagagaatgagagccaggagaaacgggaaaccccttataaaaccatcagatcttgtgagacttatttactataatgggggaaaccacccccatcattcaattatctcccactgggttcttccaacaacacatgggtattatgggagctacaattcaagatgagatttgggtggggacacagacaaaccatatcagtactggactatgcctgtctaaacatagaactaaaaaggctgtgttgaaaccaaaacccaagataatctttataatgcctgattcttaatgatcagtaggggcgaataattttgacatgggaaatttgtctatagcaatcaagaaataaatatagattcaactcaagaactgttttgagcctgttataacatgtttgtgtggtctttgcagtttaaaaaacacagtcacatctttttcttcgttagagcacacagcaactctgaaatagatgttattttcatgcttaccttttagagaagaaaattacaattaataggactagtaattagcagaagtatggatctcaaaccctatatccttcctgataccttatctcttcatgtgcaaggcattcagtgaggggtacggagcacatcaaaatgttttgataactgacttgaattgtgcctttcagtttactaaagatcgacctctgtatcatcctttttgagtgtgacaacgatcttctgaggcaatagctcaactttccaggaagcttaaacactaatgagaagaagatgagaaaacagtagaactaactataagacagcatttgatcagggccttggttgatcaaagagggaaagattacattcagctgggaagatcaggaaagtcagctttcctgatacaagctgaaacaaattgatacatgaagccagatgaggactatgcatgtttaaagtgtggtcctacaggggtcctttgaaaatctgctatgcttccttggccagagatcttctagagaaaaaattatatatacatatacacacaaacacacacacacatatacacacacatatatgtatatatattacacacacacacatatgtatatgttactttcaacatcaaaaagtaagagttctcaaagagcaaatatttctggaatcattagagaagaaatggatatactaggccaattgaattcctaatatatgtcaatcttaagcaaaagtccatttatgtgttgtaacaaaaagataaacacaatgacctgacattgagaatgtttgggtttaaaaaatttataagattcaaagcatttttcactgtacagaattataagaatcccaaatttctatttctctctctttcttcaggtaccaacactaggtcttgaaagctagggcattttgaacaagcggcagggtgacatagagtggcaagaagtgagcggtttagatgatgtgtacaaaaacttcttttaggaggaagagtggggggccaaaaccagagtagccacctccattgtgcagtcaaaggatcagtgataggagaggcaacagaatagaacaagagatgtgattaatggtaaaggattcaaaactgtccaatgctcgagctagtcaacttatcacatcattttctcagtggagcctactaatagatgtgtatgtgggttaacctaggttacagatctagaactgtagagcacaatgaatgatatgtggaaggaaaatgagaataaaacctagaaatcttcagtaagagtaaaattgagagtgttttggtctttcttgccttatttaacttcctttgaattcaaacaactgagtcttctctagattaaacagatttttttctttaactcagttttaccttcttaaattggataataattttctatatttagaaaaaatcttggttacattttacaataaccactttatagtcttcataggactttctgtgctaaatgttatatagacattaggaaaaatgggaagaatttatgtactatacttccttccatcagtacatctgtatatgcatatcaagataaaaagtatagttttaaaagcagaattcacatccttactgcacaaataatgttgttaaatggagaaatttgaacctaataagttgattttaaaaacatcaaggcgtgtatagcttgtgtctatttatatgaagtaaatgtctttctcttaatgaaaaagagcctatgttttggtcatttatgatacccgtagtaattatttccagccttggtttgatctaccagctctttttctcctctgaaacacagcctcagccccatgagtgttgttctgtgatctcaacaggcctcttgatctaagtttactgttgttgttattcagtgaagagcataccgtctaccttttgtatataatagaacacatttatgtagtcctttataatttgcaaaacatttcccaaatataagctctgctaattctcacagtaaaacccagaggtaggtatagatgaggaaagaatgacttaatgtgcttaaaggacctgccccgaacaaatggccaaaacttagactcaaactcagtgtctataattctgtgggtaagtaacaaagctagagctagaatcttgtcaactagagctcagagtaactaaactctgacaacagaggcaaggcacggcaaccctttactactgtcttattttcaataaactttatcatttggagaattaaaatgcaagaaagtatagatacacatttatttataaaagtaattattattttaattataagcaatttcttggaaagaatatctgcttatttgcttatttgtacattatatttatatcagtttgttgatttatatattagttatgtttggaaagtttggtgctgagacaaaatgtttatatcaatgctcattttccttttatctcacgttatgaaaaagaccagaaatgaataccctaaagttatttagctctataaactacctttattgtcataaattatcaataaataagataaaaaattaggctatttaaaaactcagatcaaaggatagattaatcatctgataaaaaataacccagcaaaattagtgaaaacaaccaacttttgaatagtcatgaacacatgggaataagttagagaaggaggaacatacaatgatctaatttatcggatacccaacatttctttgtattatcataggggatgaataccacccactagaggaaataattacgatgctgtcagcacaatttccatttgagcaggtttctgtatatggaatgcacagatcctgacaactagaggaaattctagtaatgtggagtgtagcttcatttgttgagcacttattatttgcaagtctctatactaacactttgattcactataccaaaccctgaaagtttaggaaatagttgtccttattgcatggatgagaaaactgagacacatggagggttaatcatttccactttgcacagcatcacaaagctattaggtgatgaagctcaactttgaacccaggttgtctgaccccagaatttatgttcttaaccattgaagttaaccacatctgtcaacataatttagactttaaaatttccggcaattattcacacagacatgttgtctgaaaaacaacatatttgcttttgtacttttttcctcagtgagtttttgtctttttcacttaggtttgaacttgtcaatgaattttctcaatcctgcttccttgagtgaaaaagttctatgttgtatctgatttttgccatttgtttttgctctatttttcctctcagaaagaccatccttattagaaagcactatatataaaataaagtagccagaaagatcaatctgtttatgtaaatcttactaatttatgtactactaccatctggattccctaatttttgctaattctgttaaataaatatgcttacatgtaagtgcacatagaaatctgtacatgatttacatgattgaaaaaattcaacttaaagcataatattaccttaccttctgtacacctttaatagcatatagcgtttaccctttcatggactgttttttcatggtttatccaaatggctcatgagcaacccaaggtagtagtcatttgctttctcccccccccagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctggtaggaaagaaacatttggtattcacaccctttgggtaacaacactagcatgttagcaactcattcattctaaaataaggattaaatcatttggggcttatttctcttatatgcatatatttaagggaacatgagtatagtgctttgcacataataagtgctcaatactttattgctaacttaaaataggaaagtctaaatgaaggagcaaaataaatatcatgtaagagattaggtatatttaaagtccaaagtgaaagattctctccaaaatgctccattgcaaaaggaaccttgcatttatgcaattacaagtgaactatatgtggatataatatcctggtaacaaactacaatatactggaagatacctggtttactaactgatgataattatttatactatttgtatggccaacagtcttgtctacagtgtgctccctaagatgacactttggtagatggccagttcatcattttcaatgcctgtactgcctgataatcagttattatgagttgggaatttggctaagacctgcttctttacaagttgtattttcctaatattgtaatcattatactgctcatttccagatgtcctttcctgcataaccacatcacggacttggtaaatgtatgctgatgaggatgttatttctcatattttatcaagcatgaaattaaatatactatctcaaaggacttaactaataaaaatgatatgcgggcaaatgtgggtatatatgtcgccaacttccaaatatctatggactgatcatgttaaatttggcttatcccaggtaaaaatcaggttccagtttaatactgtacctttagttacttaactcattttgtcatggtgcttgttttatcaatagtttccaagacagctgaattgcatagattctatattaacttttaacatgccagctctgttaaaatttatggcacctttattattttttgtttatttattgaattaattatttttgagacagagtctcactctgtcccccaggctggagtgcagtagcatgatctcagctcactgcaacctccgcccccctggttcaagcgattctcctgcctcagcctcccgagtagctgggattgcaggcacctgccaccacatccagctaatttttgtaattttaatatagatgcggtttcaccatgttggccaggctggtctcaaactcctgacctcaagtgatctgcccacctcggcctcccaaagagctgggattacatgtgtgaaccactgtgcccagccagcaccttcatttaaacttttcaaatatgaacttttaacaaccacccctatttccatgaaagtctgtatcagtttgcagaacacaagcacctgttcttagactgacattgatttcaggaatctattgattaaggattaaagaacaaacaaatgtcccagcttctccttaggcaggactacatgattcagcaggactaattcgacaacatgatttcttcaactcattctaatcagatctctgctgtcaggattccattgtgactacactccttgagctctctggaggcctccatgctgccatttacaatggttacttctctgttcttattttaatttacttctcagcagaatttttcataagctgaccacttccttcttctgagaaattctcctaatttaccacttgctcattatcagtttcctgtactagaaattttccctccatgctcccactttaaatattgggtagctcagggttttgtcttaggccatcttctctttctacaccctgtcccaagatgtcttcatcaaatactagagcgttaaatattatctataggccaagattcctaaattcacatttctatccctgatctcttcatgggactctagagtcaaatgtttagttgcctatcaccacatagctctccaataaacaattgaaacttaacatggccagaaacagtcttgatttttttctagtcattttgcactttcccaggcttcctcattctggtaaacagcatcgccattcacatagttattaaaaccaaagactaagatcatccttggcccccacctttatccttgttaatgctacttccaactcacacccccaaagttagttacaactccacaacaagtaccatgacccaagccacgatccctgctcttcagattttccataatatctaaactggttttcttgcttcaactcttgcctcatgcaacccattctccacagaagaagggtaaatatctttataaactatctgtcagataatgccatttccttgcttaaaaccctacaatgtttttcatcacacacagagtcaaaatcccaaagagtgtgaatgttaagttgtgatgagattaggtgaaggatgccagtagagagagagaacttggtgaagagaaagagaaaagatccccaatgctgaaaggaaagggatctagaccacaagtatacatacctgaagactcatccactgcaagtgactgtgattagtctaaggatgttgtggcaggagtttgagggagttcaagcacaaactaagataagtcagagagtgataacctctggggaatgaggagagatgggcactatcacagatttgaggggaatgaaaaagatttgaaaaggctcctatggaaaacactaaagattactaatttaaaaaacatataaagattggcagtgttagtagccagttaaggttaaagatcaagaattaatagagtagtattttgcaaactttaagatgtatcagaactacttagagaactttgtaaaaacgcagattcttgtgtcccattctgagagattctgattcagtatgctgaagggggctctaggaatttgtatttgtaacatgttcctaaattatactgatgctgctggtctgggatcacactttgagaactactgttatcacgttatcaatctgccttttctccattggcttttatcagcccttatggaagcatgaagaaagcaaacatgttcaaagttgcatttttgtcagatagtgcaaaaaaaaaacaataaataaaaggagttaggatattagtaaaaaaataaataaataagagtggctgactagatgggtcatggaatctaaccaacagggaaggaaaggaacacggttgtggggggcagtttaaaaatgagaaaataaaggcacaaagggaacaaaaagcccctacatataccattaaggactagagaaagaggaactaaatgaataaaagaaaaacaaagtctgtacttagggaccgagatatttcagaggtggacagtttaagagatgatgagatgttctatgggagggagtgatagaagtgggatcagtgcgaaagtcacagcagatgaagaatctaaggaatgaggggctcagatgcaagatgagtcatctacatgggcatgaagtcactccaaatattggatgagagggtgaaagagtaagacagttatggaaaggctgacaagaaagggagggcatggccaatttcagtcccagatctgtcattatcagtccaattgaactacctaaccaaataacttctctgagtctctcttgactttctttttttacaaaataggcaagatcagaaatttcaaaaaccattctgtttcagttttactctggatgcatgtttcctaggagcaatatgtctgaaagagcaaggcttaaccatacagtcatggcaataaatccaaaccatggtatctggactatactctaaacacacagaaaatagctgattagaactgagcacctgcctggaggtactcatcaggttttctccctcaaccctggtattatcattggaggcttagggaactagagataaatcctatctctattatatcattttgtttctaagacttggaaaataataaatgaggaagggtttaacactcagtccttgcaatccggattgaaactaaggagtctctcctagtgattggccaagagaaaattccctagtctggtgttcactgttatctcctttccaggctactgaaccaaaccatccttggttcccaaaaagtgaaataaaagcacaaatattttctttttaggtaataaagggcatcatagatttgaacagcaaagatacaatataattagagtttttctcacaaagaagagctggtatccacatgcccatttggctgctcaaggcaaatccagaatgctcttgaaaaagaatgaacaggaaataagaattggatctgaagtgaaggaaattcaacaaaatgagctagtagggtagctgtaggtggtggtgccccttgtgaggtggtgagaagccaaagatatgagcacagactatctacataatgtctagttctaaatatacacttagtgaaaatgatttccatgaagcaattctttcaactaacatttgggaatctatcatgtgtgcaccaggtgctaccaaaaatgcagggataactaaagtccttgctttatgtatgaaaggaaatgtttaagagtatggctccttgtctcaagtagcttagtgtcttgtagagagaggactgatttcctggctgggcatggtggctcacgcctgtaatcctagcactttgggaggctgaggtgggtgaattacctgagatcaagaatttgaaaccagcctggccaacatggtgaaacttcatctctactaaaaatacaaaaattagccgggcatggtagcaggtacctgtaattacagctactcagaaggctgaggcaggagaatcgcttgaacccaagagacgggggttgttgtgagttgagattgagccattgcactccagcctgggcaacagagcaaaaactctgtcttaaaaaaaaaaaaaaaaaccaacatggcacatgtatacatatgtaacaaacctgcacgttgtgcacatgtaccctaaaacttaaagtataataaaaaaaaaaccagacagatgactgatttcctcatgcacaaaaacagaaaaactaaacaaaaaacaagctcggactttataatttataagcagccagccaagactaaaaatctgtgattctacaataatctatacctatatatttcagtagtgcatagaagtcaaaatttggatttatctacagttaaattctgtattgatgcactatacatacactatgaaaccactactatagtcgtgtttctgaataaatccactagcaagtattcactgattgactgctggggataaagaaggaaaataagaaagatatgaactaactgaggataaaggccacagacaaaaaatacaatgcagcatgtcatggtaagaaccatacaaaaaacatagtttatagttggggaaccagacatagccactatggtcaataaagactcctggcagaaatggggttggaactttaccttgaaggatgacaaattagagaaacgacatgtgctaaaattgaataaacaatattcaaatcatccttcattgtccccagatcattttatggaaaatatatttaaaatcccaaaagcattagataattcacattatacataggtaggtaaaggtgaattttaaaaaataaaaactactggaaacttcacaaatacaacatttcaatctcttttattctctatatttatatccaccaaatctgtattcccctttatataaaataacatcatccaaaattaaagtggcctttgccataatggaaatactataggaaagctagtgcttaacacagtgctaattcaaaaaagcaaatgagctctcctcaggtgtatgagaaaaggcttctgtgaacactctaggacattataaagctttcagatgtgttatggagccttaggctaatccagtgttttccaaaggagagtttttggtcaacttacactcaatacctggggtgctaaaatgccaacatagattatctcaagaagcagccctggaatctgtgctttatcaaaccaaggtttgaaactacagagctaaaccatcaattcccaaaggaaactatagacaagcaaaacatttaaatggattaaggagaatttgagttcttttgaattctacttataattacttttccttttgctgactacacacaatcaaatcaggcaaatctagcaagaatccacagtagatttacctagctgaactgtgtaatacttagacatgaaagctgagtactacgttgtaatacatctttcaggatttaacaaaacattcaactaagcagtaagtcacctgggcttaccaggtattgaatttctgtgcacactggggaaggtctggacctcaaatccaatcctgcagttgaagacaactgaaagtaaacattctggtacaccattgaaaaactggaatgcataaagcattctgatcagtattcttggtctttctttataagaaaggctgaaaatgtctccttctttttgagactttttgtttctttcctaatgaagtccttcacctggatgatcccccttatcaactgcgcttctctttctttttcttatcattttgaatgaatgctggctagaggacaaacaagaactgtgagacatgttccacaaaggtagtgccaactgaattagttggaattgtaaattacaaggaagaaagtagtactcaatctgttggattttggcatgtatcttagcacagcattcaaagaccttcatcttgaactctgtcaatccatcatatgctatcttccctgtcctactgagaatagatattgagggcataaagacagcagtacccttatttggatggagttagggataggatgaacagccatggtgaatgtgtcctgcaactgacctggcctaggtgacctgcatgggtcatgcatgtccactggccatctgttctcaacagaaatgggatatgactcagcctttgatgtgagagaaagtgtaataagcaggtatctctgcttccagctttccacctggaatccctcctcttcaagagttctgatccctttgtaataagtgtcccctcttatttcagacttgctactcttgccatctcacttgatttcaatcatttttattgtagttaacgaactctgccattaaggcaaaatctctcctggaggttggatggcttaactgttagaaacaagagctctgcctgcagtctgacagaagcatattcaaagtcccatgactttgagcaagccacttacctgtgccttcactggctttagtttttccatctataaaagagggttgacaataatatgtgtctggctcacaattgccatgaggagtgaatgaactaatgtctaaaaggcacatgcttggcacagagtaggcattttgtgctactctgtagttacttaatctgtttgattttgaattttgtttgattttcgtattttagcacagcattcaaagaccttcgtcttgaactctatcaatccatcataagctatcttccctgtcctactgagaacagatattgaaggcataaagaaatcagtaccattatttggatggagttagggataagataaacaaccatggtgcatgtgtcctgcaattgacctagtctaggtgacctactgcactatgacaaaaaaaaaaaaaagacttagaaagtcagaaagactttgttaagtcttttatgatgtagagcatttgtatcctcttatatatttttttccaaagtcagaaaaactttgccaagtctttccgtttttattgtagggcatttttatccttgtgtatattttctggtttgtgtgtttgtttgtttctttgttttgagacagagtctctctctgttgcccaagctggagtgcagtggcgtgatcttggctcaccacaacctccatctcccaagttcaagcaattctcctgcctcagcctcccgagtagctgggattacaggcacccaccaccacgcctggctaatttttgtattttagtagagatgaggtttcaccatgttggccagagtggtctctaactcctgacatcaggtgatccgcccacctcggcctcccaaagtgctgggattacaggtgtgagccactgtgccaggcctgtattttctgttttattgtcctacttaacttcatgcatttaattttggtgacccaaatgtttccatgcatttccagacatgggataaattaagtcacagttatattaataataaaagtctactggctttatatcagcctctgcatagctgcaataccttgccactccctcacaatctctcccagctgcttctgggagtcccaaaaagtatctcacctgtgctcaggagcatatctgatgatgtgcttcttctacctgcccactacctgccctcccccttgaggatgcagccttgccacagactttgctgctgccttttgtgagaaccagtatgactctctcacactcagaggtgcaggacccacaaggtgcacttggtgtaagatcccttcaggtctcattgtgccagagaagccacatcaggttccacattaaagttgcaaggacaatgccctgtccccagctctaaactgcaagttgtcaccaagaccccaagtaacacagcctaaagcctgaaccatgagttctactatagagcaaagcagctacatgagctaatgactgaatattttgcaataactccctgcttctggccttagtcttctgcagattgttctccaaagagctgccaatttggctgtgttaaagctttagccaggctatttcattgtacttaaaactctctaataactgcctaccttgcttggaatagataccgaagtccttacgttgatctacaaagtcttgcgtgatctggcccctgctacctctctgatctggctcctagttctctcccattcacaccacatcagctctgtagtttccaggcacacactgctcagctcctgtttcaaggccttggcatttgctgcacccctgaatgtggggacaaggagaacagagggcaaattataaaagaccttgatgctttactaaatgtttgaagtttattccacaaatttcatataagtaaacctgtacttacctgtacataagagagaattggaatgcaatacaacctagtggtctgatgcaaattttttggagtcagatagagatagggtctccagatttagcaaataaaatacaggacactcagttaaagttgcatttcagataaatagtaaatgattttctaatataatcatgtcccaaatactacatgaaatgtaccaaaaagtgttatttaatttgaaattcaaattcaactgggtttcctgtattttatctggcacccctacatagaaatggaattgaatactggccttgaacaaactatttaacttctttcagccttggtatgaaaatagagtaataatacccacctcatggggcttttgtaacgattaaaaaatataatgcatggactgcacttagcaaagtcactggcacaaagtaaacaagtaaattgccgctgttatcattattgctattgttatgatcatctcattttgccagtgaagctttcaataaaacattacattcctagcaacataatcttcatatgaaactttgtatttttaaaaaccctggattatccaaatttgttaaaaaagcacttcttatttgataagaaagacttcaggaaacaaatgtaatattctgagaagaattatgatttgatttcagtttgttaaatttttatttgattgtatagctctcagcacattcaattcaaaacaatttatttttaaattccattcttatggctttcttttttttaataaagataacactaacagtatcctgtgatgatatagggcttttgcttcagtttttgctatagatttgttctctgactcatgtgatctggccatgaatttagtaacagatggtaacttgtggttttatgaaaaccgagtatgtgagaagccttacatatcacattttctttagtcacccagacacttattcattaaaataacaaccgaaagaatttttaattaaataatggaaactcagtaatgtgccagatattgttggttgcttaagattcaaagaataagacctactggtttctggtttcacagagctctcactgggtagaagagaagatgttgcaaccagaacaaataagtaaaacagtatgataggtaaaaatgtcacataagtcatacaatcgggtgtaggaagtgagatgatagagcagacttcacaaagtctgtgtaacattgtagttggttcttgaagaatgaaaaaatgtatgcaaagtaaaaaagaattagatggcattccgcatggaaagaacagtatatacaaggaagaaaggtatgaaagaattggggaagttgccagtttagtttggctaaagcagtggaactcagaggatggcccagaaccagcagcatcatatcatgtggagtatttgttagaaatgcagattctcaggctctaacccaggcttactggatcagaaactctggggcggaccccagtcctctatgttttaacacgcattctaggtgattgtggtgcctactgaagttcgagaaccctgaagtacaacagtagagttttcaaaactgagtgcacatgacatcactgagggtgcatctttcataaacaccaatgacaggggccacaagccataaaaattaaatcagagtttcagaaggtggagcccagaccaaaagtctaaagatgttttactgtgcagccaaggctgagaaccactgggatagagcacatggtacatgaagaagaaagggcaaatagacacttcacaaaagaggtaaacacatgaaaactcactcaaaatcatcagtcttcaagaaagtacaaattaaaaccacaataaggtaacactgcacaccctcactcagactgaccaaaattggctgctataactaaatgctggcaaggaagtggagcactagtgtatcattgcaattaaacagacagaggttgcctgaagggtaagggtgagggtcagggattgactttcctgaaatgtcattccgtacctgatcctggtgaacacccacttttatttcactactcggttttatctggaaaccttcctgaaatttcaagttactcaggcacatcctccacaactcctgcaaacctctgttaggacacttccttcagtgctgctaccactttttaaaatgcctttctcttcaactagatttaaaaccgtttgagccagggtgttcttttttctttgtggatccctcacgcatagcacagtatctagcatttgtatggggatggatgagtgagtagactgagggatgttgggttacctgatgattttgacacaccgtgtcatgactccatgcatttacatatgctgttccctctgcctggaataacccattctaccttttattttgtctgtctggcaaaaacatctcctctcttaaagatcatcattctgtgtcacccattccataaatctgtcccccaacaaggacacatccatttggatttgcttctttctttaggccatgctttgtacatagctcctcacacttaacttactatattgtaattaatgattttccttctttctggatcactgatttgtacatttctcgggggttatttcactttgtatttttcctcagtgtagtgcttagcatatgttaatgttcataaatatctgttaaagaaagagagaggaaaatgtcctcagactacctcaaacatattatgagcattttaagtgcatttttattgtctgtcataatcagattgtgttctaagtattacttttgtgtgcatcccctctgtgattttgaggattattatacaaagaatggaagcaaacagttttcattatagcttaatcactaggtcattcaggcagcagcctgagtcttgaaggcactgaggaggaacaacagaaggaggcttaaaaccaacacatcaaagtcaacacagcagtattgactctatcgtgttggttttcagtggttctgaaatattgtctcccacgagtgatagaaatgcaaatttgaagtaacctgaatttagttagcaaagctagaatgctgacttataaaacaaaccagaaaataagacttcctctcactcctgatctacaatttttaaagccaaaagaaaagagtcacaagttcataagaaagtaaatttcagaggattccaaactaaagtatgcccagataagtaagatagatgctgtgatttcaactgcagctatcagtgcagctatcaaacaacgtgatcattaaaaaacaagctttagttctaaggatttttgagatgttaagagtattgtggtagatacacaattttcaaacagcctctcatgatgttaaaagccaaataacaaatctagagtataaatattttcaccatttctgagtttctatacagaggataacacagggggaagagaacagaaagattctggagtcctttggaaatgagaagcagcttaaaaataagctttaaatatacaaaaataggaaaaaatagttacttttctaaaaatgctataatgtgttagaggaaaatggagaaatctaaagtcttaattctgtgagatttcaaaaagctaattatgaaagtagttagaaaaacaaaacaattctgccaacaaaaagacctctcccggctgggtgcggtggctcacgtctgtaattccaacactttggaaggccgaggcaggcagatcacctgaggttgggagttcaagaccagcctgaccaacatggagaaaccctgtctctatgaaaaatagaaaaaaattagccaatcatggtggcacatgcctgtaattccagctacctgggaggttgaggcaggagaatggcttgaacccgggaggcagaggttgtggtgagccaagattgcaccactgtactccagcctgggcaacaagagcgaaagtttgtcttaaaaaaaaaaaaattctccctatcaatatagtaggaaaacaaaattttttaattgcataagcagtaacaaatttacaagcatgtaaggtagcaccaaagtgaccacaatgttagtgtcatagcaaaaatagcaatggatgaagttaaaaaagcaaggaagatttaagactgtttcaacagaaatcaagactattgtagtaagagagagattgaactcagctctgctgaaacaggcaggagagattttaagcactggggtaactagtggaaaagtactggaggatggtagaggaaggtgggtcagtgtaattaggccatctgtgtttgctaattgctgcttatctaagttaggtttacacctcccacagagactgagagatagaggttgcttcttacttaatgattacagttcaaaggaatgattccaggtccttaagaaatatattcctgggtttatacaactggcaagaagctgggggaagatttatatctccaaggggcagaggaaaaatttacaaatacaatttttctaaagtaaatgctctaagaaaagggaggtcaggagcctatagtcaggaaaaactccgtctaaagttttgtcaagccctcttggtcatcaggacaaaatctcacacattttatttggccaaacagaagaaaggacaattatttcctcaaaagacaaaaaatcgtacctcatgacagttttctgaacaactcttaagagatctcagaggtaattccagagctacatttttacatttgtcaagtaaaaaacaaatcaagacttagtaatgagagacttatttgaaagggctattgcaaggcgggagagggactactgcaatagggagaatgctttggccatgagatccgcaagcatctcaagtactaggcaagaagggtttttcttttatgagaggagtaaacaagattagaaagaacccagggtggagaagtgggatgaaagactggcatactaagtaaatatatcagaggatgttttaccctgaagccagcatattttccaggagggcccttaaagaggggatggatcctggctcaggctgaggatggactgaagtttggggtcctgggagaaggagagactcttatttgattaataagcattttgttctcattgaccaatggagacaaaatagttcagttagtcatgaatgagggcaagagtgggaatttggaggatctatgtctggccttagcataggtaaataagcaggtgtgagtcttatctaaatcaactggagaagggtggttctttgcaataagccatttcccagaacaaagggtttcttaactatcttaatgaggctcacataaaattcaacatcatcacatatccagaggttatttgactcacaatcttggagatgtgttaggccatcctcacattgctataaagaaatacctaagactcggtaacttacaaagaaaagaggtgtaactggctcacagttctgcaggctgtacagggagcatgatgctggcatctcctcagcttccgaggaggccccggaagtataatcatggcagaagatgcagcaggagtaggcaggtcacatgaccagagcaggagcaagagagaaagctaggtgccacacactttcaaacagacagatctcacaagaagtcactcaccattgtgagaacagcaccaagaggatggtgctaaaccattcatgagaaatcctccctcatgatccaatcatctcccaccagatcccacctccattactggggattacaattcaacatgagatttggacggggaacacatattcaagctatatcatatgtctacactgtaatcattggagaatgggcttaatccctaataaaatttattttgatgtcaaaggtaggaggaaggacacagattcaccaggcctccaaatagacactctaaaaatggggaaacgggaagtcagtgtctttgccttttataatggagaaaatcgtttccatttgcccttacaaagtgcagatatacatttatcgattcagttatttgggtttcaggttcagatggacaagccaaatcactgagtctctgaggctcacttccatatctgttaaaggaagtttttttgggttattgaaaagattaaataggatcatgtttatgaaaatccctgctatgggattttgtatgtcaaacttaatattttcctcaagtaacaaaatttagtggacatgccaattataggaagttttagtaacattgaaagaaaaaaattaaaatgatttggtggctcatgcctgtaatccaatactttgggagtccaaagtaggaggatcacttgggcctaggagtttgagaccagcctgggcaacacagtgagactcttattttttttaacgacttggttatggtgtttatgcataccccttgtaacttttatgtcttaaaagtctagaatattttattagtaatcttgtatctcacatcaagacactcttttgaggaattctctgttgagctggggtatagtgtaacaccaaatcatttgaaattgctgagaaaagttgcagtgatctcaaatttgaaagaagttattttcatttatatgggaatactaagaagaaaggaactaatcaagataaaacagttgatacataattatcttatttaaagagaagggtttgtcattatttagccatacaaaatctgaccacaaattctagatctttgtattttggtcttttgaatcccaccccatccccaaccctaaccttcaccctttggtaccttagtctcctcacattgccctaaacacagagagacagactagaccactcacaggcaggtgactgaacacacacacatatgagggagttctatgggggagaagtggcatcttctgcctgcccaggaggtaactcccattgttctataaggatgagtaagatgctacatactaatatcagtaacatagggttcttaaatagccttgcacgtagtttgcccagaatgcctatttttgtgtagggtgggccaaacccgtattatagttctatgatgccaagccaaatttattaaatcaataaactcttctaagattctgagaggcaaacaagtctttcccgtcttgtaaattattcccaaattccaaagggcaaaagctattggaaaaatcatcttagtgacattaagagttttatgcaacagaataataattagtctagatatgtgttttgcccttaatgccatttttattcactcagccagcaaatacttattaaatgattactgtactcaggcaccattgtaagggctgagtaaaaggaagtgaataagaaagaaaaaaacctcttttggggagaaagggttgcaggcaggccgcttcattctcaaatcgcagattatattctaaaacatatccaagattcacattctaaaatatactattcaacctgaacacattctataaaactaatacagtggagtatgactggagtattaaattcatttttacttcagtgcccattgttacgcctcattgttatttaaattcagacttgtccattaaaaggtctatttgtaattcactgaaaaaaatagatgatatgatagatattgtaaatagaggacttatcaagataaggtagaaatatgagcacaaggtaaattttgttaaccatcgctaattgacctgtgctttctaaatttctaggtttaaggaaactagtattaaaacaatgtgatttttaatgccaatatttacacaatttttgtaagaggtaaaatgtaatttgagcaaataatgtaaatataagagaaccaaaagaattttatttctataagaaaataatttcaaaatatgtgaacacatgcttatgagtatgcttaaccaaacctattacatatattcaaaactatttccattttctgttagccactcatgagaaagaaatagttcacgggttgtctagtgattgtagagttgcttcatttgacttttaaagtatcattttaactagaattacctccagtttatgggaaaatgtaaagactctacaaattgcattggttaaaagtaatcctaaaaaatggcactgtaaccatggaaatatcatttagactcataaaattttaaccacactttttttttattccctttctggtttctatgttgcctctgttcactgtggcatgttaggtgcatattccacccaattttcttatgacttaactgtttagtttttaaatgggagaattgtctgccagtgaagagagactgaatggaagaacacttaacatgagatctaccatctttaaaacattttaagggtacgatacagtattgttgactatgcaatgttgtacagcagatctctagaatttattcatcttgcttaactgaaactttatgcccacttattagcaacaccttcatttctctctgccccctggtaactaccatttcactctttgattctacaaatttgactattttagatacctcatataagtgaaatcacacagtatttgtcttactgtcactcagcataatctcctcaaggttcatccatgttgttacacattacagattttccttcttttttaaggctaaataatatttccttgaatgtatataccacactttacaaaatccatccgtcagtggacatttaggttatttccacatcttggtgattttgaatagtgctgtaatgagtgtaagagtacacataactctttgagatcctaatttcaatttctttggataaacacacagtagtgggattgctgggtcatctgatagttccctttttatttggggagagggggacctccatactgttttccagagtggctgcattatattgcattcccaccaacagtgtgcaagcattccaatttctccacttatctttgtattctaagaatacacataaaagtaattctctttatcctattaaacaatgaatttttggattcctgacacaacaatgttctattccttgaattttctggcactaccattatatgaatactattttttttttttttgagacagagtcttgctctgtcgcccaggatggagtgcaatggtgcaatctcagctcactgcaacctctgcctcccgggttcaagcaattatgcatactattttttttaattatcctcatttctttcttccagagctacatgatagtaatactcctgtttcctacaatctataagaacactggaacctttagttgtgtgtttttttacattccaaacctaaaatgttttgaatacgtaaaatattctacacagaaataccagaagctatttatttcttagaaacatccagcaattcattgaagtaaagtgttaaagtgtatacatattacacaagccaattcccctacattgtatttattgaatagattaatagacttttctgggaaaaggtaattaactgtaaatgctgacctctcactgccttttccagaggttgttgaacttctgtggcctaagtattttatctgccaaatagctagaaattcttttcaagtttattttttaatgctccaaatacaaatataattgattcatttcccagtgtttcacaggcacaggactttaatgatttttttctagctattttttaaaatattgagtatgatgagctgtaaaaactctaaaaacagaataaaaataaatgaatagacaaaagacaatgttcatttgataaataccagggcaagaaatttgtacttgaacaagctaagaaagtcattaacagcagtatttctggaaactaatggtatacctgctcaagctacactgaatctaataatctgtgacaaaagaaatggcaacaggtatgaacacatttcatttaatctgaaattgaaagaaaagaaagtggggcacttttcttccccaacttttttcatacctcaacagacaaaatcacaatggaaaagagatttattgccaaaatgttgctgaccttttacaattcttgccccatattctggaagttaattgattaaaaaaaaaaaaagtacattttcatggactggcacaaagattttatccagatagcattcaagttgcaaagaggcatcctctagctcagtcccttgcatggtgcacctttgtcacccaccagccaggactgtgcccagctggttctcccctcattaagtctctcaccggcacaaccatgctgcactatcagccttgccctgcctaaggatcttcccttctaaaccttcgctgtctttagaatgtctctgaatatggaaaatcacaagctccggggttgcctgctccaggatagcctgagatgaaatgaaagttcaggcctttggaaagctggtaagaattcttttcacctggaatctgataagtatcccggaaaccttatgcatatttgatattttctgccttgccacagttttaggaatacattttaataatattaagtaacatttcctaaaagtaaaccttcctagcctgtagtctactggaaataatacctacccctgctatttaaagctgtgtgaattgaacaagttctggaatcactttgggccttagttgtttcaaaaatgtggaaaacagcttatctttaaaaaggcagaaatctgagaaaataagatatagcgtcacacacacacacacacacacacacacacacacacacacacagtgaaaaactgagaggatttttattttattccaagtcaggaagaaacggaaagaaaacaatactgtttccattttcactaccttccaggaacaatgctgagttttttatatatgtcttgtcattactgcctaaaataacttcgaggagtagctatttcacaaataactgattttagaaagattaagtaacttccccaagctcacactgctcataagaggcagaatcaacctgcagtcagggtccgtaagattctaacacccttagatattttcattgtattagggtttccacaaattttattaattttgatatgtatagtacccttttggtttgtgccaaatctatgcatcagtggtactattttttacttacttattaaattacctcattatttaaaataaatgtatcttttacactaaactttagttcactctaataaatgaaaaaccaagcatctcttttcataagttggagaaatatttaaaataaatataatgaaaggacaaaatttaaaaaaaaaccttgatatttgtgaccaaaaaaccctgtgttcctgctgtcctctcctgtttctctctcaatctctctttctcccattaaaaagaatagacagtactagagaaatgttaagactgacacaaacataaactttctcattaatgcaatccaaagaactggaagagcagtgttctcactacatgagtcaatgtttatattttattgtatattgataaattataattgcatatatttaaggggtacaaagtgatgttatagtgtatgtacacatatgtagaatgattaaataaagctaattaacatattcatcaccccaaatacttatcaatttttgtgatgagaacatttgaaatttactatcttagcaatttcgaaatatacattgcactgttattaactatagtcaccatactgtgcaatagatctcaaaaaacttactcctcctctctaactgaaatcttgtactctttgacagacatctccacatttccctcacctccctgtttctcgtaaccaccattctactctctgcttcctacctctgttttagattccacatagaagtgagaacatgcagtatttgtctttctgtgcctggcttatttcatttaacgtaatgtcctccaggcttatccatggtgttataaaagccagtccttccttcttttcttaaggctgaatagtattccattgtgtatatatgccacattttctttatccattcacccattgttagaaactcaggtagatgctacagcttgactattgtgaataatgccacaataaatatgagaatgcagatatcctttcactatgagtcaatatttttaatgaatcttcccatataacaatatattgggcagccctagcagtttgtgcatctccccaaaacccccgggaaatgcagagctcaatcctgctgatctgcatttcgtgcttgacaagttgatgtcactgaatgatattctgactggatgtcaccctccagcacttttttttttttttgcgcaactttctacttgaagttggaagaaactctgcatgcagatcgacttgttatatcacattggaaaagtaccccacattttacagagtttgatacctcacaattgttaaaagtgagacagcatttccatgccatgtattccaaatccctgaggatctcagcaggcagatggccctctaggtcactagccactgctgacaacatggatgccctcacctgggctctgtctgtgacatgtctaatgatttccatcaaaataggatattgccttctcaaatgtcctcatttttaacaaggaaagcttatgacacacacaatgaaaagaacacttaaagtcataaatactgtatacacatttgtttctatagagcaagttgattgtagagaagctgccaggctagtgcccaaatgttcctgagatagttcaataaatatctctttacaagcctgttattgcctttcaaaggatgtaaggtctcaacattcctaattaataccataggttttgtccaaagggaataggaagaaattaacacaaaaatactgaaatagatacaaataattttgaataaaccttctatttatataacacagaactggttgagcattagctgctaaatataatagtattactatttgggtaacaatgatgttgagagcttaggcatgatctaaattgctgtaaataggagagagtgtatgacacacaatggtaagaaataaaggctgtatgaacaaagcactgggttagttacagccaaatatgaagacttacgtgacttgagcaaatgacttacctctctgtgcctcagttttttaatctataatatgagtataaggatggcacttccctcatggtgctggtgtgaatattaaatggaaaaaaatatttaaagtacttaaaagggggcttgacatatagtaagccctcagtgcatgtaagtttttaactaaataagttaagcctcaaagtcttactgccaaggaaaaagcagtgacaaaactatttaaagaacccaggtatattaaggagaaaatttcagtttggtgttctctaacaattaactaacaggtcctcatctcccactttaacctaaagaatcagacactcatactttgtttcaaacaatagctaattagattttaataacaaatgaggttcagaaaaggatggacagaggaagaggctgtgtcacagtagagaggcatccagggtatgccagttataacatgcccccttagcacacctacacaatgctttggatcaagagaaaaacatttttcatgacacttgcaattacaatcaaacatgaagcaggatggtgtatgaatttccatatgtacattctaaacatggcatggttctatttgtactgccaccatggaaaaattagatatttttttcaaatgaaaactggaaatgaagaaaaagatgtcagagaaagatctacttcttctactctgttagtcatactatcaaagtcttgggctataagatgttaaatgcttaaaatacatgatctaatatcaacaggggtacctaaaatacagacagtcacataaacatttcataattaattacgctgataggtgtcatatgttattatgtctaaatgagacagctttcaaatctcaaaacaaaaaatctgttaccatcaatgatgatgttaagggctaaaaagtttataaagtaaaaatatatataagagataagtatgaattctacataaaaatcaattacatctaaaaagcacttgaaaatgctctttatataatcatgtgcatagcttctcacctcagtactgattgcacttcagtcctctgaaacttacctgtgtgccagagaatcaatctttgttcctgtaaaatataaaatatcatctgtttttttaaatcatttacctttgctataggaaaaataatattaataatataaatttaaatcacctgaaattgtatatttatatgaaaactaataactttgagataaggcccaattattctaaaactttacccagaattttaaatgatttcaaaatttaagatatatttcattttctgatattcatgggcatgtttgatctccattatttactgatactaagcaacaaatagatttttctttgagttgtttctatcaacttaaagagagtaactatatctggaagtattgatatattagattgaaaaatttagccaaaaagaatgacgtgagcaagatggcagaataggaaatctgaggcttaatttccttttctccccaccagaaagttcaactagcaactatccattgcagaataggaaatctgaggcttaatttccttctctccccacaagaaagttcaactagcaactatccattgactagaatatgcttttgaaagattcagccatatcactaattttttattcctatgcaagatatggtattttctatataagtaataaaactggttatatcttttcataacccaaacagatccaatccatgagtcaattacattgaaatattcaatggctatttgctattattaatactttataagtatgcagctattgatagagcatagagataagaagatttggtgaaaaatatactgatatcttctattgtattctcacaacacagaacacttctatgaccaaatgtggtggtagaggggtttccccacaaagcaagctattctccagtggataccaactgggtgtcctatagttgattcagttcacagtatctatctggagatagcatccgaacccacaggttaaggactcagtcccacaagaccacccttcccactcccccatttcatgtaccagtgcaagtcccagctttttacctgtgctctgccctactggctataaatcaaggttcccatgtaccccctccttgtgttcaatatttttctaggatggctcacagaactcagggaaacacttcacttatatttactggtttattatgtaacaaaattataaacaatacagatgaacagccagataaagagatacataaggtaaggtctggaagggttttgagcacaggagcttctgtcccagtcagttggtatgcaccctcctcctggcgtgtggctattttcaccaagtgagaacctcattaaatttcatgttcaagagttttatagcacttaagctccagcacctctcactttccttgaggtcagtgggtggggctgaaagttcaaaccctctagtcattcagtctttctggagaccaacactatcttgagactatctaggggccttgccctaagtcacctcatcatcataaactcaagtgagagcaaagggcttgttatgaataacaaaagacactgctatcacttaagaaattacaagaactccagaagctctgtacaaaaaccaaatattataatgaaagatgctcctatcacccttatcatttaggaaattaaaagggttttaggagctctgtgctaggaaccagagactaagaccaaaaatatatattccttattatgtagaagaaaaaaatacagaaatccagtttcaaaaaagcattgttcatcacccccttaaaaaggtcaataatgtttatttaaagtttattaaagttatgtgcacatatgcaagtaaatattcacaattcttctttgtgacccagaagctaattccctgtgctctttcacttgctgatattgttagcagaagaggatctccaaaacagtgcaaaagatgcttgccgccattggcttcctaacgctcatttgccaaaactctgctaatcaaaatagttcccagtgcccaaagtaaatctaaaagtaactcccaccaaggacccacgtttttagaggaaggtttgttgggaacatgtcattgccaaccttcacacaaggggaatcaatattctgtcatgttgatttcaaatcaagtatttatttaatgtgaccctcaggtaagtgcagaaatatgtgattgtgtgctggatttatttgatcaccttcagtaagaccctggtcaagtgactttctttctttgtgtctcaggattctcttcattaaaatgagcatttgtgaaatacagtataaatgatttagttttggatgtacagtgcagacccaggatggatggatggatggatggatggatggatggatggatggatggatggataggtaggtagatagatagatagatagatagatagatagatagatagatagatagatacacatatacactaagtaacaccacaccttgtttgctcagcaagtaatgccaggtgtagatgatacaacagaaagaaagccaggcaaacacagtgcccttcctctttatcaaagttcagtctagtcatcatgagtcttgtggattaccccagtcaaatcccaatgaacagatgatgttagaaccttttgttcaggtctataacatgtggcttattagaggaatctgattataaaggaaaaagcccttccaattaagtttgttttcttatttgggaacagatttgttcacaaaaatctaggagagaattcaacttttactgaattatttcaataatttattgaataaaaatgctctaatgttttatttatcttgatctataccaggataatcatataactgacgatttttctaaattctatattctcatataatgaataaaggaaaacataggtaagtgagttggtatctgaaatctatttcaaaaagtaacctgcagaggatatggcatgatcattcataaaacagattaaacccaatttccaattccttctacatctgttataattctggaaattcttttataaacatgaaatagaaggtactacaagactctgaaattctgagttatccagtattctattatatccagcataatttgagtgttaaaagtgttttggtaatattacaaagctttaagtggttttttttaaattacctatgtttcccaaatatactgatttaaaaaaaaggagggttatgtataggataatagtgtatttttttcaccatactatttcacttactgtcagattaattttatgcaattttaaaaatgaagtcattttattatattgtaatctttgaatgtgtatacagtaaatttaattaaatgaaaattgttaaacaaccgtgacaacctttcccccagctattcagaataattatgagttaactatatgttttcaaagggcttttaaaattattcctgtaaagcaattaattccaaataacatttttgttggctataaaatgatttttaaaatatttctacttgtagtacttgtagtgctaaaattaatcccataaggaactgtggaaagcagtcaaatgtgtaaaatttcaaagttcataatcttagcattagtcagcacttggcttttcgcactagcattaacttaggcaatttagagtactatcctaaaattatcattatcatttctagcattgggagtaaataacgatttttagacactacataattagtatgaaaaatcaaaaatcgatgcatgatcaaacataaattatgtgccaaataaaactactataatctatcaatgcaactagttaaatatgattgtcagtgatcccaaaacactcaaaatacaatcatcattatcttcagaaagtatcagagtacaattggaataaaataagagaaatgttaatgtatgtgtaagagaacatccaagcaatgtgactaaattttttgaataattaaatttttacacattttaaataaaattatgtaactcacgataattttactataaagttaattgttctttttacctaatcaaagtagttttacaacataaaaggtctttttcagagaaatgccaaaagcacgttcttaattaaaatgatttttaattagttcaaaacagaacttaaaaaaaatttagacagaactactacaaatcagggaaaagcaggtagaagtttatggaaaaatcctagtatgtttccactaattccatcccttatctcctactaattatgagggtatgtattttcacataaagattatctgtgctataattagtggtgttcccaggctgcctcactacaacgcttcttcccgcaattggtcagaacagaatatcagagaaagctctagtctgggcagacaggcaaatcattcattctctgatataagaactaataatcaatctgaggatgattcttgcccaagaacctacctcactgatttataatagaaaccaaatgaaaatatacatataaactgtttttataaacttccacccactataagaataagtgtcattatgatgattgtcacccatgcccacaagcttagcccagttccagatcctaaacacccatttccatactctaatgatagagactgcatagtctatctggagggaattaagggagccttagctaggtaactcagctgtctttaatgttgtttctaaaaccaacccacctcccactggagttgctttctgccttactctctcttgccatcttagaagatctcacctgaatttatagctcaaaaccccctgacacttcaatacctctcacattctgcctggctatcttactgatcgtcatactctctagatttttggcttaatattaataaatagttcagtcatttagctgatttagactcaatgtaacaaattcttttctaaccacgattatctacaaatagagcaagctgccttaagagttctgtatcatttgagatagacaagacacagctacatattcattggccatgattactgtaaaagacactgctgctctgtttgcaagattagacaagatcactgtacgatactaatcaccagcttcaccactgaaccactctgattctctgatgcttctggagttacagttctgaagacatcattatggttcctgacatcattacatcttatcaaactaaaaaaattattcctgtagaatccaaaataaatagaatcttattagaaaattatttgtgatttcagttaaatgaaatgtactccagaaacacaaatgatctgtgtgtctagatgttaaaactattactgcactaacatcttcattaaagacagtaggttttgttatttcatacagaaatggaaagataaaaaggctaggaaaatcagccattttctatagtatcatagaatttaagttactgtatatggtatgctaagatgttttattttctttcctaaaactgaagctaaacataaaacaatactatgaaacaatcataaaaggaaaaggaaaaaggaggaacttaatgttaaaataaatttaactttatttaccaaatccacagaaacttttcctataagtattataaagtgactgtcaaacttttgcatcatgttttactttagtttataagattgatttatcttatatcacatatcttgtatcttataaagtacatcttcataattagacatagaaaatgatatcattaactctgaaaaagagggttctttttttttaaatcacatatggtaagtcatatggtttggctgtgtccccacccaaatctcatcttgaatgcccaagtattgtagaagggttctggtgggaggtaattgcgtaatgggggcacatctttcccgtgctgttcttgtgatggtacataagtctcataagatctgatggtgctataggggggagtttccctgcacaggctctctctttttgcctgctgccatccatgtaagatgtgacttcctcctccttgccttctgccatgattgtgaggcttccccagccacgtggaactgtaaatccactaaaccctttttccttataaattacccagtctcaggtatgtctttattagtagcatgaaaacagactaatacagtaagccatgtcccaaaacaaatatccataaagaatatggtagttctaattataatttatgttagtatattgttttcaatttgaaatcaaaagctctttatactgtgtctataaatcaatcttataaactaaagtaaaacatgatgcaaaagtttgacagtcactttataatacttataggaaaagtttctgtggatttggtaaacaaagttaaatttattttaacattaagttcctcctttttccttttccttttatgattgtttcatagtattgttttatgtttagcttcagttttaggaaagaaaataaaacatcttagcataccatatacagtaacttaaattctatgatactatagaaaatggctgattttcctagcctttttatctttccatttctgtatgaaataacaaaacccactgatttgggcatttgtgatccactatgctaaaaagccctgttgtttcttggtcttttttatttcatgactattgtgagtcagatggaaaataggataaagacatgagaattactgagcagaacaatgggtttgagttataaaactgaacagttaggaggggcagggaaataaggacagagaaggtggaatggagacagggaaaaaagcagtgagcatgttcagaagacagtttgccagtgtagtcacaatttaccaagaatcactatagacaatgtcaagggttagcccaatttacattcaagcatttatcctttgtgttacaaacaatttaattattctcttttagttatattaaaatgtgcaggtaaattattattggctgtagtcaccctgttgggaaattacatactagatgtcactcatctaagccttgtttttaaagttaaaatctcagatgattctcccctgtgttttctgattcactgtcctatactctaaatggccatcaactcaggaatagagattattcagcctccaagaactacctaatggagcagtttcctccattggtagttattccaataagttactactcattttggttttcattccattacagttttttgatatgattatttgagcctaaaaatgtaacgtaatttggttcctaagagtttattaacagaagacaagttttaacttatgatgaacagtaggtgctgagaattagtctgtgttacttaaaaatttgaattgaattgtatctcatttagaatgagggatttgtgaaagccaaatatattcacattgtctataaaaagtgtgagtggctgaatgattactcaagaaacatgatccatagtggcaacaagtataattgctgttcataagactttgcttttctataaagtgttatgtgacctgtcttacctacagtttctttcaccttatttgcatttatatatgctccctaaaaatacagatgatgtaaatttctctaagttcttattagttataaatctgaattagaacaaaaataacaagcattcctgctactgaagaagtcataagacttatttaaaagtatgattttctgggcagagtgtaaataaggtggatttattctatatattgctgtactcttttatttcaaatatagtaatgcataaagtttaaaattaaatgtgccttccatgtagattaatactatccatttcatctttgtcaagtagaagtaattgcttggttcaatacaatccagtcccatccgagtagatctctttgttctttttcagaaatgggagagattgagagtttaaaaagcattcatcatcaggagaatttgttttaaaagcttccaagctcccaaacagccagtagataaattacccactattcagagaaagagagcacaattagttttacattatactaaaacaatcagctccataagtgactatgtttcttaagaaaaaagcaatatgaatgtcatagtttgtcctctttctcccaggctttacagccaacagcaagccttttctcatactagaagttttatggaaagctttgtgaatatgttttgacattgtttttagataaggagaaatatattcatgacttgtaaccatgtggttaataatacctacttcacaatgcaaagttaatgagtcttttgttttattcaaatgctttgaagctttatggtaagaaggaagacttcaataaattattttcaaatctacctttctttccccaataattatttttatgtaattatttacaactaagaagcaaaggaaggtgtaagaaaaaattatactgggggtaatgaattatgcacaaaaaatctacaggttgtttttttcatcttaacaaaatacatagttgctaaacagtcattacctcttttgacacatgcaggatggtgtaagaatgtactaaattcatgtcaactgccatgacttaacctggagaaacaccatgactagtaagctttacatacacagctgctacagtatttttagcattttccatttataataagaaagtgatcaatggaggccttagaggaaagagtgcaattgcaatcatataaatagccttatttccttttttgcacacaagtggtatctatcaaaattcaaacattgtaatacctattttcatatatcagtgttcatctatgggttacttttattttattttttaagttattcattctcataatgataattgatcattgttgatatgtgcatgcaggtcatatacaaaacttcctttacaccacacaaaaagtagtctacttatgttgtataataagttcgaacctttgtgccttaagtacaaaactgactcttctcatgcacataaacacaacctggaactgcatgacaaacacatttgaataaagctttcatttttcaaaattcatatatatgtgatcagtgtacagtatgaattgggtaaggagaaagagagggaagagaaaaggaaaaaggcagtgaaggagagaaatagagagaaagagaatatatcaaaatacagtgtcaaaatgtcttattcatgaaagcttctttcctagggatataagtttttaaatgtgtctgactatagaaaagactattaagtgggtatgttttgttttagatcagtttattaaattttttttcatgttagacaggtaatgtgccaatatcataacaagatttgagggaggcacatctcacacatgagtgtgaaaattcaatcatcacattcactgagtctctttcaaccagtagtcttagccaggcatgaaatctggggggctgcaaacctccaaagaaattctcaccacccatttgccacactcagtctttttcataatctttgtatcatggacttcaaagctttaataaataaagtcaagttacctaattctctggctacttataaaaggtcaacatgtcccatcccatctgataccttgatttgcatgtctttgactcttaagacatacacagattttctatctaacccctaagacctttgaagttgatgggataacagtaggtctaatattttttatctaaatataaagacctggaacttgataggattctaagataaatacataattttccccactgattgagtcttgcattattttgtcttcatattcaatttcaatcagttgttcaaccaattgaatttgggctcttacataatgcttcagactcatggttgcaccatgaagtctttcaatgtttctgattttcttcttttgcaaccaagattgtgaaatgcagatcaaagacctgtattggctttttctcctatcccagatgcataaggcttaggacagcactgttcaaagcctcgtagtaggggtatcctatggtcattcttgttaggggcacaacaaagattcacgagtaattgaaatctctttccctagtctagaactttaagtggttcctcctttgacttggacaagagctcaggttgaaaagtaattgctgacctcaggcaataaattagctggattaaaaaaaatcgtaacattccataaatgaaaataattatagatttgcctacaacaaaggacctaagaacctaccatcaaaattatttgtcctaaatatctaattcttcctttattcttcccctgatctaaccttaaaatctaacttacatatcagtatacgcatgctatcaacaataaaacacaaatctctgtattttaaaatttttttttattttctcagtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaacaa

SEQ ID NO: 592 - DNA, 738627 bp, Homo sapiens
cgtgtgcgtgtgcgtgtgctcagcctcagcgtgaggggcacctgctcgtctgggctcacagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggtgagtaccttctcagtggcattcttgtcctattcttttttttgtccttttttttggttttttgttttttttgtttttgttttttttctttttttccacttctttgattattgtttatatttgggaaagctggaggagcatggttttgagccttttcctgaatccaagtttttctagcatgcgatcgttctgtagacaaggcgctgtgtctcggagtccgcggcgaccgtgcccgctgggagcgtctcccaagtccagcaaaatgtgcaactggttttatggaaaaagcgatgtgaagtatggtgcctatttttttcctttgtaaaaataaaaagcatgtttctaactctttttttgcatactctttttctgataacatttttgtataggtgggattttacggcagtgtttacaagtttgtggtcttgcaatactggtgcaaaccactgagcaaagacattaattttatattttttgtgccctttttggaagccggtgaaaacaaattcgttttttttccctcctgtttttgatacccattgataacatgaaacttttcttacagctggtgattgggatcatttttaagcaaaatacttttttcctcctttaaattaactatgacttttgcacatttgacttttttaaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcaggtacttggtccccttggaggcgtttcccgggtgtgcagtggcaacactggtcctagcaaagaaatgtgtgagtgtgagtgtgtgtgtgtgtctgtgtttgcgcgcgcgcatctccgggcagtgtccgagcccgaggtggggagagcggcgcagggagccagggaaaaccaaagtccgttccctgcttcaggatcgttttctagatgtgcgcaaaatacagtcccctccccccacccctcccacggtgagctgcgcccaggtcgtctcccggcggggcgggtggcgtctgcgctgcgggccgcgccggccgggcactaggcggccggcgggccctgtaagttctccgagggccacttgcacagcaggaggggcgagggccgtgtacgtggcgctggccgtcgggcgggctagaggggaccctcagagcacccgggagatgggggtagaagcggcagagaccgcatattccggaggggctggctccaggccacgcgagccggagctggagacatttccagagccttgaggatggcaccggccctcgcacgctcaactcctgctcctcctcttcgcaatgagtaaacgacgcagtaggtcctacccagcctattttgctttaccaaagggctttgctttcttagggatgctgtctttggatcttttttttccctgttgtgttgcgttggttttaagtgcctgctggtgtcgtcttccaggggatggggaaatagtttcttataagatgatcacttgggtttaatgttgaggacgacgctgttagtttgcagtaatgaccctacacctctaaggtattaaaaaaatgccttttatttaaattttgttaaaggggcagagttttccctctttttaaccacctgatactggctctaaaggttttcccctgagaactgtgtacagggcaggagtgaggggttggtgatagaggtgatgatttcgtgtgttggtagcactgacgtattcaatgttgaatgtattctatgatattttatgattatcctgttacatgttttcagtataatttagcattacttttcagagacgtaccagttggcaataaaaagccttttctgtatttaacactgtgaccgaatctgctggaaatttttctgtccaaataaatttcctgaaggcatacatcttaaaatctggagagtcaccattatttaaatactttgattttgaagctttgattttcttaccttttccccccttaaatgaaaagcttagctttaaattaccatgtgtatatactttgaattctgtaaaataaacataaagcaaatgaaacaacaactttttacctctcagatgaagttttcttctaggtaactacagaaataaaaactgactgcaacatacagaggggcccatgacaaaggggtttataacatacactggctttttcaagcaaatatttcactgtctgtaacctcagtttgtggaatgaaaggttttacgccttagtttttactctttgtggtcaaaaagtaaggcgtgcaatgggccatttaactgtagaagattaaaagttagtgtaatatctggaaagttgtatatattttttattcacaactcatgcaagtatctcaaaagtctttggacatttcattgtatttcctggcggggaaatacaatgtatgtgagttattttgttctccgagtagcttttctctgtgaaggaaatcctgttgcatttatataaagaagatagtttatgtcactgtctgtggacaccatatttgatatcttgaggtgtatagttctaagatttgaagccaatatgatggcactaagcctgaaattaggattttcttattttgtatagtgagctaattactaaaatacagtctttcatatgcctcaaacagctaacataaaacattaaaaaagccacttgcaacattctgtgattttaaaaatcatttcaattataacaatgtatgtacatagaaatgctcatttattaaaatgcaagacaatttatgtgtataatatatttttgtatgttttatgtattgtaagtcgtttagttcttttaagagagagagagacagagcaagcaagcaagaacttgaatgatcgaacctgcattttcattaagagaatcagttgctgccctaaggttgaggtagtatgtggtttaagattgggcaaagcactagctgtactgtgtgatatttcccaatgagattgaaacaattaatgggaccaaagacgattttaatgtgaggacagagaggtagttgtgctttaatttctgtaacttaagatcattctaagaacctttagttatctatgttttcatttatttaagattcatttttaattatattgtagacttgtattacatttctatctattacattcaaatttttcagatttcttcctgtgtgaatcattctgggaattctacaactcttaaactggccacctgtttagtttttgatttaaaattgttgaaggtagtatcctagatttagcaccgcctactggcttctcatggaaaaaatgtattttttcattcgccaagcgacccacagggatttagatcaatttaattgtgcagatcttttcaactgcttactaagcgagaaggagggaaaaaaaagtttctattttgtaatgagagagggtttccaaggtaaaggtggggactgagggaaataagacccacaaattaaattggcattggatcactatctgacctcaaacattgtactatctaaactgtgacaaagaaataatcacaaaatgaaaacctgttaaattttcaagaactttttatgggataataaaatgtgggtattgtttaaaatcttggattactaaattaatttttcaatgtctatctcagtcttgatataaagaaagaaagttctagttggaattctgtcttgagtgtgtggtctgttgaagaatatttaaatgaataacttttcatcattgaagattaacagttaattatttttcatatttattttttatggtcataatcaagtaacaccctgatttttttcttaacatgcatcaaatagccacaccgtggtggtgtatatacaagggggaaaagttccaaacataaaattataaagacacatccttagccataatagatgtgttacctttcttaaaaatgataattggtttattttctctaatttatatgaaagtctagtggttaaaagagctactataataatacaaataaatgatgccttaagaatatacaaattgttaattagaaaaataatttgatatgctaaaattttcttcctaattaaaagaaatgtgaaatatttggatagctgttccttaaatgcaatattgacttattttaagagccagtagtaagtatatagaaattccagtgagaagtataggtctgttgcgtttttgcaactctaccccagtaaaagtgtggtcatgttttgtttactgtttactgatagtgtaagcaactaattaagcagggcattcattgatataactctacatttcaagtcttcaaaaagctccattatggaagtagaagagaagtgaagtgggtatgtaagattgtttgaatagtaaggacgaatttgagaaaaatatttcaattacaattgatttttctctctgacttttgaaacttttatttttattttagttgtttatttttattttttctttccaacttttagtttcaaggggtacatgtacagttttgttacatggctaaattacatgtcacaggggtttgctgtacagatagttttatcggccatgaaatctttatttttaaatgatgattagctgagactttaaaaatagttatttctttacttcttttatcatactgtcattatgaaaactctgtgttttgctatgaaaacctgaagtaatgattaattttattcttcaaatttttatggacttccagaaagtaaataataacatgtttaaaaaggtccttattgatctgcagttattgttattattctcttattactgttactatctactacttccagtgacctgtacgaatgcttgtaaagatgccatttccataattcagtttgattctttgatttaataaatttctcttcagtaattggcaggcaacataaactttcattttattggcaataacaacagtttgttttgctaaatcatgattttgaaaacaatattcaataacatgtaagtaatatctgatttctgaatgtatcaatagcaagttacactgttaacaagtttacataattatacttgtcatcacccttccttttattattaaattttgatgtgcagactgcatagatataacacagctattgccaactttagtagttttgcttatcctcattgcttttagattttcaataatacattgggaattttgttttcttttgttagacttatgttaaatatcaaacttaccttgtggaaaattaactttgtgtttttctaaattcttccttacgtttaaaaagatttttgtttgctagttttgaattatcctgctatttttctgggactgagtcctggaaaatagaggcattggtttaatgtctttttctatccatttgtagccacagagatggcagttggaggacttgagttagtatttaggatttacattttctgggctgtccttgcagactcctcagctgggggtcaagactctaagagttatttatttgaccatgtaaaaatctaaatagagaggaaaattatggagtagaacgtggaagtcttgcactggtcttctgaaagatacaatagcatgcatcactaagtgctcttatattacaaaatactagagattttctgtgcataaatatgtttggcaaaattccatttaactcactaatatgctttttgcttgaattctttcccaaacttcagagtgggaattgattgcattcatacataatccatgtgtttagagaaaatgtttatacacattttgatagccatatgctaaataataagaggagcaacacatttctgagtcatttcggaaattattaacaggtgggagtaaggaacggctattttttcattaaatcaagatgagagggaaagaaattgatgtgtcaaatgaatgcaattccatttgtacttcccttccgtgattagataatagtattattttatatgttggaggaaactgagacttggagctcagagctccataggtggtaaagggaaatttgacatgtaggaagtcttaactgacgactcatgttttttttttttttcctacacagatatgcttcatttgtggagatgatttttttgtttcttttgtttttcctaatataaaacaactgttatgtatttattcttgatacattacttaagatgtctgtagtttggcaagttttcaacagggagtgctttccactagtgagtgctttgagcagaaacaaaagaatattgccccacacagatactcttaactggtcctgaaaggacctttctgtgaccatgtcatcacacatctcttcaagacgggttttctgaagagagccaatgcatggcatcacatttgtgagttaccactgttgctctgtggttgggtcagaagagacggttctctgtccttagttgctttgcagagagcctgggaaacacattcagcatttacttactgagtacaaaatgtaatctctactcttggagcttttgcagtgtgatgtggaaaattagtcttttgtgcaaggaaagctgaacagctaattctttcataacacagagctctgtaaatataggtgtcttgtctgtctaccaacatctcaccatcaacatcataacacctcacaattttactgttacacatatttgtatgtgacatttatcaagctcattttatgttagtaacataaaacacatataagtgtaacatattatttgaggattctgtgtttaattgcctcttcagatgtgcaagaatgtcttccatcattagtttccttggaacttgaaaaagtgaatactttcaatgcagaatgggaaacataaactatagtggaaacagtgtgaatgcacatgatgagatggatttttaaagacttggtcataagtcctcacgttcataaaatcagtggatttagaggtcaaagtatagggagggttaaatgctgcctttgaattttggaatctggatatcttgaaaacaggtggtataaaacaaaacaagagaaagtagtatctgtaggagagccttatttggttggaggtgggaaaatgattcaattttgaacatagtaatttgaagttctgacattaacttctggattaaatgaccaatgtgcaatggaaattcaggtctagagctgggaagcacacttaaggctagaaggagatatgacagtatcatctacattaaaactctttaagtgggaataagtcctgcacaggtagaaatttgggaacatctgcttttttttttgagtgaatgtaaaaggggctgataaagggcagaaaaatagagttaggatgatagccactgaagctcagaaaaagtatgtggggtgtgtgtgtgtgtatgtaagtattgttcaacagagctaatgctgcataggctcaaaagaagataagacctgagataaaagctttgtaatctgtcattaaaatccatgaatttttgaaataaactaaatgaatgtgattgatgatcctcaatatgatgtggcagcgtcataaagagggctgttgttcccaggattgtatgtgtcgtgtgtgtgtgtgattgtgtgtgtgtgtgtgtgtgtgtgtgtgtgtacagtgataacatgatctaaataggaagaccagtaggaagtttttcctgaaactagctaaattgatttgaaatttatatttatatgcaaaaatagcagagaatattctgagaaagaagagagggctaacctgttacataataaaatacactataaagctttaaaaataaatatatttactagctatgtctactgaaaaatcttcaaagcaatgtctttcaggaagcaatgagcccttctagtgcacaaagcatggcttcttaatatcattccccattcaagaggacaagagccctttagtcttccttaacctagaattggctgattctaagtctgggcagaaaaaacacaagatgagcctgggacaactcactgcagaaagtaaggaaatggtcaaagacaaataaggctgtatcattgtaaacaagtgctagcttgaagggccttccagttgtgcaatttaaatcagtttgaatttcaagagtgaatataacaaattgtaaacgttgagtaaagtaaaatccatgagtgcataatgatactctaaataaatatataaaaaagaaaaatgacaattaataattaaattgagataattaaatgattagcctgcctttcttagttgatgagggacagctttttacaaaataatgtgaattaagtgtaagaaatgtaagaattagaaaattactatttgtaactctcagtgaagtaagtgattcagtcaaagatgatcaacaagtgataaaataatcaattaaaattattttgatgaataacatattctcatagtgctcaagtattaattgcatctgcaagtcatcgttttaagtgactgaatgatttaacccaacatcaccaatagacaacctgacactatgagcctcctgacgagatgccatataaaggctatagtgccatttgtgaaatattgttgctagaatgtctaacctgaatctaataaaacctggttagatttaacttccagtttatagaaaaattcagagaaaggaccagttaaactaaaccatgaggaaataatgagacaaatgcataaggtgaggtattccacattgaagatacataccagccctgtggcctagacttgtaaaatgtcagtgccactgtgggaggacttttccagattaaaaaggactaaagacaaacaaatgcagtgcttgaagatttattttatttcactttttaaaaatgtggtctataaaaagtcaaattttggtagaattgggaaatttttcatatgggctagaaaacagatgatattagcagatgagtgctgaattatttgggataaatgcagtgatacatgaaactgaattttctttttttttttctttctttttttgagacaaagtcttgctctgttgcctaggctagagtgcagtgacacgatttcggctcactgcaacctccgcttaccatgttcaagcaattccccttcctcagcctcctgaatagctaagattacaggcgtgtgccaacatgcccagttattttttgtatatttagtagagacagagtttcaccatgttgaccaggctggtcttgagctcctgacctcgtgatctgcctgccttggcctcccaaactgctggaatcaccgtgcccagcccgcaactgaatttcttatgagtcatcaaaggagtgagggagggagtgtgtgtgtgtgtgtgtgtgggggggggggttgtgtacgtgtatatgtaaaataatcatttgttaaccaactttaaatcagggagtgcttatgctggttttattgtgttattctttctagtattccatctatttgaattttttttcgtaaggaaagttgaatagtctattagttgccattgagaaaaaaatatgtttattgaggctaaatagaagcagaagtccaattgcccatgtttaaggtcatctgggatcttgaagatatggagacaaaaaaaatgaagtttaatgttaaattgtgggaatgaaatattactcatcgaagtaatattattgaaggaaggatatttttaaagccacagtaaggaaaatatgaatgcatctttatgtttttcaggatggaatccccttgcaggaagaggtggaggtataatagaaaggaaaataatttttcagggtcaatttcagaatgttctaagaaggttggtgtgattagtagtagcgcaaggagatgctggttacgtctcagaagaggaagagaattgaatcagttcattagttaaactaagtaactcattatttatttaacagatatttcttgagcattttctttgtaagtactgtgctggaggatgaggattctgtggtaaataaaactgataacaatgctgactgcaaagagtttgccatttaatggtgacttcagtcttctcagataattgtaaatgaggtcctaggttgaaattaactggtatggagataggagctaggggagtgtagtagggaataagcatgaaatatagaaagattctagagctgtaatgaggaacttggcaaaattagcatttgttgtcactttagtcaacacagttacatcacttctctaggaacacttagcctgtaatctgaatgggttaaggaaacagttgaggattacttggttagagactagaaaggcatccactttgtgtaaaacaaagtgaggagctttccagaggtagtggatatgaagatataaataaatctgggctgagaaagagagcaagggcagctctacgagatgaacagaataagaactggtaagatttgaaagcctgaagagcaggatgaaaatgaatagcagactcactaattttaatagaatgagagtagtgcaaggatggataggtttggtcagaaaagactattgtatttctagcgtttgacagtggaacatcgtcaaatggtgaataaattttagagtatggtaaagcatgtggctaagaaaggaagacactgctgattttgagaagttaagatattgtgaggtgaagctgagtattaaaagtgtaattttgaaaacgtgatttaaaaaacctgtaacaggatgacaagtgaggaggtggaaaggaaaactataaatgtatcaaaagtatcagtgatatttttagagctttacaatcaactaagaccaaaacagatttttttttttcatttgtgacttctaggactttagtcctttctttggaacattttgaaggaagctatagatatgtaatgtgtttgtgtatcttgcttacatttgaaaagaattttcagttactacagaaataaattctgcagtggatacagcaatgcaaccctttgtaaggaagtctcttttcaaaaccaaggaaatgaatataggatcctataattaagtataacagtgaatgattcagattgaaaagaaagctatggagtatttgttaatacatttttattaacatcagaagtccagatagcaggtatatagctatatttactgctagttctgttgctgctgctctgttgagatctcattctatttatgaatcaacattctggaccagactgactgagaaatgcttagtcagatagagcctcatctttgcaacactaggagagtatattaccatagataataatatttaggagaaaagagaggatcagacagttgacttgttaaatgtcttcttgctattaaatggctgagtaaagatctgaacccaggagtttttggcttcacaacttgaatgtggactactgtattttgttcaacagatggaaaaaaggagatactttgattggtacagcaataggtcagcaacatttgtccaataaaatagacacgctcacataattaatgccctcacaatagctccctctgcacagcatgttaaaaacacacaatgcttacatttagaactgtagtgcaattgattctgattctagcccctcttttcagagtcttccataatgtctcttctgtgggcataatgggtgagaatttcaacaattgtttgtatatttagacaatatttgtcggggatctattatatgtaagtcactgtatttgggtcaacatggtgtgaaaccccatccatctctactaaaaatacaaaaattagctgggtgtggtggcatgcgcctgtagtcccagctactcaggaggctaaggaaggagaattgtttgaacctgggaggcagaggttgcagtgagccaagatcgcaccattgcactccagcccagcgacagagcgagactccatctcaaaaaaataaaaacataagtttttaaaaatcagaaaacattggtcttaccctcctgaatagacagttttcaggaaaaggaaatgctttatgtgaaaagtgacaatgcataaagttatgactattaagaaaagtaaagatgattgcttgtagttctttgggttattaaggcacttgaacaaactagcatgcaatttctttctcccctttctagtgacttggtgagtcctcaggttgggagattatgtattactctcgttccattgtattccaaagccaggaatgtatgacagtgtagagaagaggtgtgtagacaaaaaagtaaagggggccaagtgagaggaacaacagcaacaaaaagatttagagcaaattgtctggaaaaaaaactggaagatgaaagtaaatggtgaaattttgaggaaaataggagagagtcagggtagaggtacaattaacatgagtttgcacctttgtatttatccttattttatgctttaatatgaagtctattgttcaggagagtgaagtttatcctggaatatattgagattactcaaaacttcaaataaacttattagaaactgttaagtactataaaatatataaaatgaatttagaaaatatctatgcttttagattttttacaatggctctaatgatatagctttattgataatttaaagtagattagtgaaccaatagtatgaaaatattttgttttattctgaacccatttcatcatgtatgcaatctttttatttcataattgctggatctttttccctgttctagtcctcccactggacagtggtacaacttaaaagaaaaagggaagcgtggaagaggggagaaaggaaatggaagagaaagaaggaggtcaacaatagccatgaacaagctttctctagatcactgttcaaaagaaacgatgcaagtcatgcaagccagccacatatgtaactgtaaattttctaaaagacatattaaaaaagttaaaaagtgaaacagctgaaattaattttcataaagattttatgtagctcagtgtatcaaaaattattttaacatgtaaccaatataaaattacttttaaaatattctgttttttgtgctaagtctttgatatctagtttgtattgtatacttaacagcacagaacagccacatttcaggagctcacaggccagtggctatcacatagaacagtgcaaatatagagtgttcatagaggcttcagggctatgtcatgttttcaaactccttttggcatttgttccttatcggagattatccaagatagattttttaaatactctctgatcatttcaatttcagctttcactttttattaaatcctaaatagaaatccattgaagttcatatttgccaaaaagttatcccaaaatatggtcccattgactaagaaatattaaatttatcttgatacttattgttcttcaggagcaagatggccacttttactaaatttgctctttcagtctactcatttgttatttggccctggaggtaaggaaataatgcaattgtcagaaattggtaacatcttcataggataggcttctatattagtggtatttgcctaacacctaatttaatgagaactatccatggccttgcagagaatcactcattattttaaaaacagaatgatatacttaacatgtaaatttgctaacagatttaacaccaattgaataccaacttagtttcagaagttatttgaaaacataatagaaaatcctgtatctagttatctgtttcctgcattttcgaagtccataaatgtggaaaatcaagaggcttatatactgtgaaaccccgcaatctacacagcctcattttcttccccacattcttttcttcttatcagaccagtttcttctgagtctcacatgttttctaatatggagttaaagacatgtttacccatttttaggtcctgactttcatacaaagaagataatcctacaacttctaaccttccatttttacatcctatttacatttttgagatgaatggtgataataaagatattaacaaccaccaaaacaaccaacacttatttagtatttagcatgtatcaggtgttgtcctccaaaccattgctttatttttctacttccccttgatctccatccattgagctccagaagatgagactatctaagtatgaaacttattttggggccgggcgcggtggctcacgcctgtaatccgagctctcagggaggcaagaggcgggaggatagcttgagcccaggagttcgagactgcctgggcaatatagcgagaccccattctccagaaaaaggaaaaaaaaaaaaagacaaaaaaaataagcgaaacttattttggattatttatcaatacctgaaattttatttcactcttttttgtttgtttgttttcttgtttgatgccttcttctcccattaggcgatagctttatgacaatacagtttatcttaatgatgatttccagtacctagacagtacctggcacacaggaagcactcaataaacctttttgaattaattaattagtgaagtagttcctcactgatgttttactgcacttgaactcttttctagatattttcaatatctatgtacacactctttagtaggatgtaggtagaaactgaaaagaaaagatttttgaggaactttcactacaattcatgacaattatctctaaaaatgtgaaaaggaaaacataatttctccagcatgaaggagaaaggacgtaactgctaagagcatatgtgtactgaaatgataatttgtcttaacagttattctacatttgtagagggctttatcattcaaacatattcatatacattttaattttattctcactgcttcatttctgaatgttgaaatttatttgtatttatttattaattttttattttgtgggtacatgataggtgtatctatttatgaggtccatgagatgttttgatacaggccggcaatgcataacaatcacatcatggaaaatgtgatatccatcccctcaagcatttaccctttgtgttacaaacaatccaatgataccctttggcattatttaaacatgtgcaattaaattattattgattatagtcaccttgttgtgctatcaaatactaggtcttattcagtcattccattttttgtacctattaatcatccccacctccctgccacccttcccagcctttagtaatcatgcttccactccctatctccatgagtttggggacgtttggatccccagaataagtaagaatatgcaacattgatctttctgtgcctatcttacttcgtttaacataatggcctccagttccatccatgttgttgcaaatgacaggaactcattcttttctgtgtctgaatagtactccattgtgaagtagatagtatgttttctttatccatttatctgttgatggacactttggttgcttccaaatcttggctgttgtgaacagtgctgcaacataggagtgcagctatctctttgatatactaatcttctttcttttgggtatatactccagagtgggatttcgggattatgtggtagctttgtttttagtttttttgaggaacctccaaaccgttttccatagtggttgtactaatttacattcccaccaacagtatacaagggttcccttttctccatatcctcgccaacatttgttattgcctggcttttggatgtaagtcattttacctgggatgagatgatatctcattgtcttttcgatgtgcatttctctgtgcattactctgatgatcggtgatgatcggtgaccttttcatatgcctgttttcttcttttgagaaatgtctattcaaatattttgtccattttaaaaatcagattattagattccttcctatagagttgtttgagctccttataaattctggttattaatcttttgtcagatgggcaatttgcaattttcttccaatctatgagttgtctcctcactttgttgattgtttcctttgctatgcagaagctttttaacttgatgtgatcccatttgtccatttttgctttaatttgttatgctcgtaggatattactcaataattttttgcccagaccaatgtcctggagagtttccccaatactttgttgtagtagtttcatagtttgaggtcttagatttaagcctgtaatccatattcatttgatttttgtatatggcatgagatggttgtctagtttcattcttctgcatatgggtatccagttttcccagcaccatttattaaagaaactgtcttttccccaatgcatgttcttggcacctttgtcgaaaatgcgttcactctaggtgtgtgaatttatttctgagttctctatgctgttccaaatgttgaaatttaatctcagaggtgaagtgactcagtctgcttacctagtaaatgtcatggaaagaacttatctctgccaattgcattggaaggtaatagtgtagcctgggagttctgtagatcctctaatttaattttagtcagctatttggaatagtttgaaaatcccagtacttattatgtaattttgggtgcttcttattacatttatgataagcaattcaaaatattatatattcttatgattcaacctgaaaccaaagttttctgcttttactcgtttgagcttctgtaacagtattagtgtagcatgagattctaatggttatcatgaacagttaaactgttaccatttacaaatacttaattatattgataagaattttcgaaatacagtacactaaacaaaataaatacattggatgctgagactgatataggatagcagtgatgatcagtggactccagatacaaagctttgtgttcatcaaagcaaacgtcatttcaggtattgattaactttaaaatagagtttcacaaatgtaaattaaaaagtaattttaagatagaagttactacttatatctaatttaggatattttatatagattttcattaaaaggaagtgtcctaagactaaatacattttaaaatcatttccttcatgcagtttttgctaagaattttaactatttgcaaataagagtatcttaaaataattttaactgttaactaaaccacaacagttttgacatttgttgcttgaaaagtgtagatacttttctatctatattaattaaagcttgaacaaataggattaatatttatttaaaagatgatcttggtgatgtattttaacagtttcttgggctattttgcaaatagtttgtgagtgtaaaattaaaaggcttgaaaatgcattcctacttttaatggggggatgggatgacaattgtgtttttaaggttgaataatcactggtttatggcacttaactcttttactagttcacaaactatgagtatattgtttacattaatttaagcaatgcattatgttcacattatttcatgaatgttttagtgtagttatccaacaaatatttcatgaaaattcatttttttatccttctgtgtgtcacaaggcattatataatgtataagaatggagcttacagtgcagaaggagctgatggtgataaatttcacaagtaaaaataaagttcagggttaagatagtatcttattctctattaaatcagaggattaaccttcctatgcatttccagctacaaaatgtgacccatgatgaggtgagtgaagtcaaatcagcttttcaagactatatgtaaaataacatgaatagaaagaaatacttcaaatttatagaatgttaatctgtatagtctttgaggttaaattgatttagtatctttgactaaaacttatgaatcagtgagaatttgatggggaaatatgagcatgtaatttcgatccatcatctatctttatttgttggtttagagctaagcatatgtcagtattcccagtataggtctttcaaggtatgtctctgtatgtaagggtaatataaccttgtgagtatgagtatgagtgtgagtgtgtgtggagaaatcaattgcttattaatagctttaggaaatggtattagttatttagttgcctaattgggggagtagttttcattcattttgcttttcttttttttttttcaagacagagtctcactgtcatccagtctggagtgcagtgtggcatgatcatggctcattgtaatcttgaactcctgagcataagggatcctcttgctttagcctctctagtagctggggctgcaggtgtgtgccaccatgaccagctgattttttatcttattttttgtagagacagagtttcactatgttgctcaggttagtctcgaactcctgacctcaagcgattctcccacctcagcctcccaaagcactggtataaaaagtgtgaaccactgttcgcagctagcatatttatttgatactatgtctctttgtccctaaaagataaatgatatgtattacatttaagtaaattatattatgtcatagatttcctttttttatatccaaccctcacaacaggtgttaggattttaatggttatacagcattccattgtaataatgtactttgtcatgccccattgtgaatattttagttggttcttttttcactttcttttcattgctattttgaataatgagtatttccatacactttttgtggttattttactgtaatattgcagttttgtatgcacttttattttatatgaatttatagacttaatttatatttttggtttaaaaaaaaaaaataaagcctagctcttcacctagtcttcatctaaaggactttaccttcttacctaacactggtagagaaactggctgggttagatttacttaaagatgatataaaacatataaaatcatgtataagtattatatgatctattgaagggattttttttttttttttttttttttgagacaagtcttgctctgtcgcctaggctggagtgtagcggtgcaatcttggctcactgcaacctccgcctcccgggttcaagcaattctctgcctcagcctcccgagtggctgggattacaggtgcccaccaccacgcccagctaatttttttgtatttttagtagagacggggtttcactatcttggccaggctggtcttgaattcctgactttgtgatccacccaccttggcctcccaaagtgctgggattacaggcgtgagccaccgtgcccagccctgaagggatttttagaagtaatttttatgtatctttcatggtgactttagactctaaccactaggaattatgctacaaaattgcattttgtacagtattttcctggtgtaggcatgacattttgaacatttactttaaaaacttgctaaatgtattttttcattaaatttaaaatactataatgatttcttaatattttcagtacgtacatgtatattagcttttgagtacaaatagtaacacatttttagtaatttatcattcataggtgaaaattgcttgaaacccataacataaaaacagaattacacaggaacggagtagagagatcagtccctcatgtagttgtaaattatttctagccacacaacaaaagaatgttagttattcgcaaaggaaaaagaatggaaatgagaactgtgcttatgacattatcactcaagtggtttgggtttcttacttaccataaggagagtgtttgataatgtggagcctttctagggaaaaggagatgtaaagtacattctccttttgagtcctgcagagttgccaggatgactagtttgttgaaaagaaccatttggtgtccttccttcttttctttctttcttttttttttttcttctcacttgagtgaatcactatagaattctggaaagtacaggaagaaaatgataaattttcccagcagatttttctaaactaatcttaatggaacttttcaagtgcttttatttaatttacccatgtgttaagtggggtgttctcccatcatgttgttcatagtgatagtaaaaagtggtgctgcttaaaatatattctgtagcctgttggtttctgttctgaaacaagaattgagatttccacaacaattttacagaataatttcatgtttcattatatgtctttgtgttttctccctcacttttctagtaatatattttcattgtattctgtaaaatactggtttgtggttgattggaaatggaaaatgagcttctcaagtgcaatatagatagcttgagaagttcaggtacagaacacacactgcatttacacagttttagtttttcctagattatatgcttcttaaagataggtattgtgaaattcagtcatttatttattctcatattctggcattcattcaataatgctattgacatagtgttagtcactgatgccctggatgaaaaaaacatcatcccattctcaatggactcaaaatatccagagagtatctcactatgatactctcttatagtgcttatagattaagtaaacattcctggaattgaatgtacttctttaaatgtatgtgtgtgtgtgtatgtgtaatgtatatcatatatactcagtgtataagtttttttgttttttaagcccgtggcattctgtgtaaattgcctaaatttcaaagttaatcatcacatataaataatactgaattattcctatagtttaagaattctgaataagaacacagaaatatcatgtagagattgatagtctcagtagtttacccaaaagatctgaataaatattggaatgatcttttaacaggttgactctagctcagaaaaaaaaaatgagaggaagagcaccacaaaaatatatctttttatcattggattaaaatatctagaaaaacactgataaataaaatctataaataatattctgccgttgtcttaaaatttaaaaaatggggaataaggtattttttctttcttacaaagactacacatattttgacccaatctgtttcatgttgaatggaaacaaacttgcatcataactgtgcatgtcattactgcctgctggttctaccagtatgcttttgcatattcttgatgaacaacaatattacctaaatcaagtcaccctgctttgtgttcatctgtttggtttttcttgttgttgtttctacaaaaatgttgtctcaccatactatgttccccaaagtactgctgtgatactttgctcctttctaatatttggtgaattcctaaatgtatctactttgtgcatgccatatgttcaactgctgtctccaatttcattataaagcttatgtatttatataatcattccaaaaataattcactctgaagacataatttcagtaagcagagagtgttcagcattactaagttaaataatatataacacttatttgaattcttactgtgggctaggcatacaaagtatgtgtattttttctcaaacagtcctcagagctttattgtttttattcctattttatagatgataaactggaggctcactgggcctatgcttcttgcccaggatgacagggctagtaactagcagagctaaaacttaagcccaggtctgattctgaaatcttctaactctgacccactagattattctcatctcattttatatgctaggttaactaggatttgattatttacaaatatggccctttcgttttatatacattgttatattttctgcctaataaaacatatgttgttacttccaaatatcttcaaaacccatggccacaggtactgttctcgatatgcaattactgaatatttacaaatgtggctccagtcagctaaagagaaaaatgtaatgatttccagggtccacccctctaatagctgttgtctttagtttttcaaggtcaaataaatgaatcgtgatgaggaaggccacgtgtctagaaaccaactgcatgaaacccttttctgttcaggatttaagcagtgatctatttaagtttgaattagacaggattccaaaaggtattataacctgaaaatattacacagcccccctctaacacatataccacatatgcaaagggaaagccactgtagctattttactcggaagttttatcttttcaatattctttgacttctaatgcaagtatgttacttgaaggaataaatatagtgtatatttgggtctgaatattagcactagttatcaataaagagcacaagtgggaaatccatgatgtcaagtaatctatctttgtaaatctaccttaacaacctagtctgagaaggtgataaaagtagcatcataaattcccatcagtttagcaaataaatgctgaacattgtgttagtttactagggcttccataacaaagtagcagagactgggtggtttaaacagcagaaccttaactttctcatagttctggaggctggatggccaagatcaaggtgttgccaggtttgattcttctgaggcctgtctccttggcttgcagatggccacatttttgttgtgtcctcacttggcctttcctgtgggtgcatgcctccctgttttctcaatctcctcttcttaacatatgtgtacaccagtcttattggattaaggcccacccataagacctcattttacttttattacctctttaaaggccctttctccaaatgcagacatattctggagtactgagggttaggacttcaacacatgacctttgtaggggatacaattcagttcataacatgtatgaattattcttctaagcactgtgggaaatactaagagtatagatcacagttctggttttcaagtagtttaccattctatgtgggaccaagtaaaatagccacagcttgagtgcatgggtgatctggaggtaacttcagccttcctcgtggtacctaaagtcaggtgacctcatttgagtagctgggaaagtgttctttgctcagtcactcaaaagctccttattttaagagggaacttttcttattagaaaatgtaattatttcatcaaggctatatacacgagacactgaaaaaacagtttagtgagagcatatgattaaggactgaattagtgctaaaagtaaattcaattagaggacaatatgaattccgtttttcaagtgagaggtatgaggtgtctctagaaacagtaattgatgatgcactttgaggaatagttaggaatgaagagaaagattttagaactatctgagtggaggtgatatgtgatagttgaaatgaaaatggatttctctgggaataaggaattgtgggcagcaaagagattgtggcgcgacatttaatcatgaggcatgctgaacatgagtgagtcaaaggaaggcacaccagtgaggaagttgaaagttgtgtagctttatgaaaactgaggcagagattatcatgcaccaaagccccatccttgaatagacatttctcaaaagaagaaatgcaaatggccaaaggtatatgaaaaatgctcaatgttacataatcatcaggaaatgcagatcaaaaccacaatgagatatcacctcacctattaagataactatagcaaaaagaccaaaaagataagtgctggccagagtgtggagaaaagggaactcttgtgtgcttttagtgagaatgtagattagtacagccattatagaaaacagtatggagattacccaaaaaattaaaaatagaactttcatatgatccaacaatcccactttgggaattcaaaggaaattaaaccagtatctcaaagagatatctgtacttccacattcattgcagcattatttacaatagccaaaatatggaaacaacctaagtgtccatcaatggatgaataaagaaaatgttatatatataacattatatatatgaagtatgttatatattatgctgtatataatatacattgttatatatcaatgaaatattattcagccttagaaaaagaaggaaatcttggcatgtgagacaccatggatgaacctggagggcattatgctgtgtgaaagtaaccaagcacagagacacaaatactacattatattacttatatgtataatctaaaaaagtcaaagctggaagcagagagtagaatcatggttgcttgggaatgggaatggacaaaatggggagatgttggtcaaaggtacagtgtttcagttatgatgggtgaataagtttggaagatctaatatactcagcacagtgattatagttaataatactgtatcagatacttgaaatttgctaagacagcaggtcttaaatatattcaccaacccccaccccccaggaaactgtgtgaggtaatgggtattttaattaccttgactgtgataatcatttcataatgtgtgtgtgtgtgtgtgtgtgtatatatatatatatatatagaaacattgcattgtacactatacatgtatacaatttttatgtgtcatacctcgattagggaaaaaaagtttcatcaaagggaaattagggaaaaaagtttcatcaaagtagaaattgcagttcgctctttgaagaagttagaaatgcatttaacttgttagggggttattaggagggaagatctttagctgcagagttctattagcaatagtaaagaacggatcaaagccaccgtttttctgtcaaaaatttgagttttcttcatgggctgtttggtacacatatcggattatgatactctataagtaacacaagattgatcggctatatgaagctcttttctgtagagtattaaattgtgaaatcagtaataaaagtctgtgtgttaaaaatcgttagcacagaaacaaaaattttagtgtttgaaattttttaatttcattgacaaactaccatttttctctttaaatccgatttttctttgtgtctaagtatatcggatgtactggcagattagaaacattatcatgagtaatccttctcccctcaaaatatgattggtaccttttttagacctactctcagcttcactgtgtctggtaatttttttttaactaatcagtaaatagccctactgttaggtctgtgatggttcttaatgccctcggaaggagcgtaagctttctgggagggttttaagcttctcaagaatagagaaacttggaagggcctgggagctggcaggcaggtgacctgcctataattcctgccctgccttttgagctcatcccacacttttcttgcttgagcctcagtttcctcatctatatatcatctatagaaatgatgccaaattttttaccctaattaataaaatgattgacagaaccacttaggctagtgttactcaaatgcattattataattacttcctatttaaaatgtttaagtttaaaaatttgggaagttttaaatcaggggtcacaaacaaagcggaaactttccttttgtgatataagagacttctttaactcaggtacctgggagtagcagctctgtctaggaagccagggtaaaatagatgaataaggaaggagacattttagctggaagactgtattggctgcatgaggctctcatccctttgggagttaggcgaaggctgtactttagttttaaattggagaggctttgtatatgtacacatgcatacacacatttaataataataaaaacatttaaaaagatttaacaaatattgcataaacatcccactcctccaccaaaaaaaaaaaaaaaaaaagaaaagaaaagaaaaactatgcatgcgagatattacaagaagcctatttttaggaggtattgtcttgctgatattccctgatgtccaacagatgcatgtgcaattttcaaagcattgctgccggttgaacaaaacataagtgctggttttttgtaacctccctttctgtggccactttgtggccccggttatgaaagctttttagttttactttgatgtgccgtaaaaaacacaaatttagaatcagacatatctagactcagatactagctttgcatcctacactctaaaagcttccttttgttggaaagaaaatggggatgggaacatctaactctaattgttattgtgagtgtcaccttttataaactgagccactacagggcaatattttcaataaatgatggcttcttttttgtaactcagtggcccttatgccaaatttagaattacctgggagttttaaaaaattttagtactctgattgaagaccctagacttaggttcacctgagcctaggatggagctggaaatctatgtgttagaagtccctcagtttgttttacagtgctatcaggtgggaaccagtgctgtaataccatcagataaatgaaaaacatgacaaagtagatttggcattcaagtatagtgttctaacacctcttcatccccaactacatgtgtatgtgtacatgtgtgggtgtgttccaatacaatgactatttctgaataggtagctatcattatttgctcaggatactgcttctatgtatttttcatttcgtatttactcctctttggctgacaacctatgtagtgtgattatgaattaatgtagctacttttctcatatggaaaactcacacaaaggcaaaagtagttattaaagaggactagtgacagcatcactggaattaaatgtgtgcctctgaagctgattgctttggattgacagtacacagctcaaggtagatattctgatgtttttgaaatgcaccctacttctttatatgctgtctagtcttgtggcttcagaattacacaagcttaataataaatatgcatatatatatgtgtgtatgtgtatatatatatgtatattcttaattacttttcaaattatttaaattaattttaccgagcctctgtattgacagctgataaatctttaaatcctgtatttaatattttaataaataatgtttaatacattatagatttctcaaattggattttttttttctaagcaactccttatatcaccacaggaccagtagtgctagtaccagcacgagttgcttctcacttaattagtgggtcattcataaaaacaatacttcattggcttaaaaaaaaagctattgtgatgtaataaatatgtacaggcgcttattcaagagtcaaaatagaaataaagtataaatcgcctgctcttctggatcattccctctaccagtgcggaaaattcaggaatgttcataatatacagtgttttattttatacattggcacaatccatgctgtaaggtcacgagccacggaaagcttattgtatagtttgctgaacattttttattatattttattttcaccaacttaatttttcagcaaggctctatgccattcatgcttgtacaagaggcaaatacacatggattattcatttcactctgtttccataaattgcatcatttagcatcagtgtcatgtcatagctagctctgtgtacctagtgtgtgctctcggcattgatgtatgaatgactagcataatctccctattgcttatataattatagtgaataataatgcagttttctataatgtttaaatattggctagtttcttaatacttttttattattttatgatcaccaataaaaaacatcgccaattcctgaataccaactgtgtgcagatattgtgtggtcactgtctttatataatccctgaaagatcagtgtgatccccattttacagatggaactgaaaaattaggtcacttgctcatatctgtcatcaagtggcagagcagagatttgaaaatatatatctctgactgtacctgacctctttcttgcatacctttctcgtacatcatcataactcctaccacaagattgctgttacttaaagatcataagaattagagttcctgaagccccttagttaatactttaacaactggtcttcatttgaaatgcacaactactagctttccactcgcagcttggactggggcctagaatggtctattgaatgtttggttgtttaaatgactgcagcaacttgcccatcttctccatcaagctactgaatagtaatgtaattagatccagcacttagattttgcttcctcccataatattttttatcatttggtgattagattacaatgtcaatgattagcatgtagtttccccaatctaagcagtaagaagctctctgttctatgtttgaaaatggctgtaaggttaatccactaactgcatgtaccttgatccaaaattatatactgatgaatggtgatgaattccatgaaattcaggaaactgccttgttggctgacagcaagatgtgttatgattttatatagctgtgtataaatgtttgcagtcaatcagaaccatgggaaaacagatttagaattatagaaaatacatgaacctggaaaattaaccctagggaaaaatctgtggagacataataataatagtaataataataaaacattatcaaaaatttatttggtacttgtatactgccaagcaatattataagcacattgcacgaattgtatcgcctttaatagttacaataaccaaggaagaaattgaggcataaggaaggtaagtccaaggtcacagaacagaaaattcactattgcaactcaggcagttttagttcaaattttgtgttcttaacaattgtgaattctgcctcttagctcttctgagtataaaatggatgaaaatgcagttgagtataagatgcagatttaatttacataaagtttcatagcagaggttaataattctgaatatacattttgtgtaaaacatattttctatgaattacatcactgtagtgttttttgacaaataaatggaaattccatttattttacactgtatatttttaacataaaagtggtattctagctttctcccttaccataaattatattatcatttatttacctacgtttgtattttcaaaatcatgcttaatagttgataccgtcctcatgacgccttcattttttttctggggagatatgattttctcagtgtttattttaaaaaattattcatagagacatgtaataagtaacatgaaatcaccagcaagtgtatcccaggcttaaaatgagaacacacattgatctctgaagacacaaagcacaaaggttattgcttcatctaaattttgatgaaataatttcagaattcaggaaacaagacttgataggaatatctggagctgtaggtgaagtacaggcagtataagtgaggtaaagcaaatgtgagcaatgtataaatagaaatctttccattgaaaaacaagactgataatttcaatatttccctaaaaatatgctctatgagtttatgaatatatacttgaaaaagatcagtattctcttaggcatgcttttcttcaattacctttgcatgtctgaaacaagctgttttattggcagtttttatcttaaaaaaatttttaagaagatttagataaataacagaaatgacagttcagtcataaataagtaatacaataaaaagttatctccttacataaatgtaccaaacaaatgagattttttgaatcattagaaattattctttataacatgcctaatgaattatcattgttctctttttttacattctggaaaattctcagagtatatagatacaatagataactgtcttacttactgtatgaaaatagaaattttcagctgggcatggtggctcatgcctgtaatcccagcactttgggaggccgaggcgggcgggtcacctgaggtcaggagttcgagaccagcctgaccaacgtggtgaaaccccatctgtactaaaagtacaaaaattagctaggcatggtggcaactgcctgtagtcccagctactcgggaggctgaggcaggagaattgcttgaacccgggagacagaggttgcagtgagccgagatccctcaacgccattgcactccagcctgggcaacagagcaagactccatctcaacaacaacaaataaatgaataaatttttaaaaagcaaaaaagaaagtagagaatagaaattttctgcaaatagtaaaagtttgttttatgtttaattattttgaaaacatgcatcacattttatttttaaaattcttatcttttaaaatatattgtatttggaatagattagcttttcttctcaaaaggaaattgtgtgtgtgtatatatgtgtctctttttggttcaagatgaaagtaatcacaacactaacacaaaatacatgctacagaatatgtgttacataaatcccactttgaaaacaaatccctgaaatgaatttcatgtatttccattaattacagagaagtattacaatgacatatttatatttcggttctgtcctaagaatatatgttcgaatgctcaattgacatacatacatattggaagttatgtatgcaataacgatcaatctatgtattgtgaattccctcaatgtgccttattactataagagtgacatttcaatgatacattttattgaactttttcattgatattattggaatttgaatgaagaaaatgtgaacagagtttaaggattattaaagttcctctaattttatttctaaagtattagcacattatttggttttatctttagctaattttctctgctatggctgtggttcattattgttatcaattgccacaacctgtatctagtactttaggccaattatttatagaatatacttaattaggtcaaattaccttaggttgttaggttgttaccttgggtggaaaagataagacaaggtaattaggcagcttgtaagtgaactctgagtaatgaaaattgataagttgcatataaggaattggtatcatttcatatacatataataagaaatagaattgtggattttcttatggtcaaactatttctgataattagatggatttatatagcctgggatggaatgagtctgtgatttatcaaatgagtctttatgctttatcaaatttaaataaactaagtagagaatatataatatttgcatatatattcatatttggcataaataaaattacatatttactaaaaattctatttacctaaatacttctaaaatgtgcaataatgacttattttgcccttttagttatatgttaaatttttcaaatactgtgagaggcaatttaatatcatttactgtaatatccttgataacattaatatacctaactggcaagagttagttgagacatttttactgaattgtatattaaccctcttcagtgctactcgaagtgtagtctattcactatatcactgtcatgttaccagtgtctgttacagatttgttgggagacagaaaataggaattagcatttaagaccatttatgccaaacaacagagtaatttttacctattgcgtttaataaatattttggatttttttgtgtgttacattttgtatcatttttctagtaattaacttttattttttttttaatttttatatatttatttaatttttgagacggagtctcactctgtcacccaggctggagttcagtggcatgatctccgctcactgcaagctccacctcctgggttcatgccattctcctgcctcagcctcccgagtacctgggactacaggcacccgccactgtgcccggctaattttttgtatttttagtagagatggggttttgaggggaaaggagaagcctggtccttcctcagagttttacaagaaaaaacactgatttatctgattcatgattcaaaaagttcaatactacaaccaaaatatagtacacattttaatatcatcattgtaacaggaaaaaactgtcatatttgagtaaatgtcatagccataatgatttttgacatataaaatgcaaaaattggcattatgattcaaatatggaaacattttattgaaatggccatcagcactaaaatgtgttctttctgtttataaagaaaatattttataccttaccatttattgattctgaataatgtaaaaattcttatatttaaaagtttattcatttaaaagcaatgtattatgcattatatttatatatggatataaatgcatatctattcataaatatacatttatttatgcataaggtttttttttttaatcccaggccatattttttaaattgacctcctctgcaatttacatcttcatttttctatctgtagctgcttctctctttcctgccaatttacttccttgtcatattaacagtagcttgttaatcttaaattcataagccagtcaatactttattttctaattcggaggtttggttggctttagtgatttctgggtcacactgcctatactaattgatctgtctgtaaagtgcacaaagaagaacacagaaagaggatctttaaagaacattaaataaatgatactttttgataagtaatgcgtacgcatggcaaacaacaacgaatgctacaaaaagggataaaataaaatgtgtgtctcccttctcatcactgtacatactccctggaagaaactatggccagctacttttatgagaaaatataatattctcaaaatttatagtcccagagtaacatttgacaataaatgataacttcagtaaacaatgccacattttgcacttatcatatattaaggcacatgacctcttttcagtatgctgtgacccagggctgtaattatctctgttgtacagataagaaaacagctttatagattgaagattttgcagggatttcagatcctaattttgagacttgacatatacagatatttctgctatgatgtatacatttcaaatgttttgcaaaattatacactaaaattttgaaggttaacagaaaaaaatggacattcagttataccaccataagcctatgtagcaagatcatgaagaaatataatattattttaataaaagtctcagcagagttaagagatgtaacatttttaatagggaagttataagagacaacctttaaaaattttttagaaatacattttattgtgtatacttaaggtatgcaacaagatgttatgggctatgtatagttagtaaaatatttactacagtgagcaaattaacatattcatcatctcacatagtttctctgttttgtgtgcgtgtggcaagaatagctaaaactcagtcatttagcagaggtccctgatgcagactcttcacttcttgggaaatattaagtaagtgtccaccaatgctatccaacagaattttcttcactgagggaaatgttctgtatctgctatttagtacagtagtcacatgtggctaatgatcacttgaaatgtgactactgtgactaaaaaatggaattttaaattttatttaattttaatctatttacatttaaacagctacatatggccagtggctaccaaattggaaatagcaggtgtaaaccaattgatttccactttgtgctgacatcatttccctatttgctcatccatatgagctaattcacgtgctagatagaggtggtgtataaccagtatgctctgttcctttcctgagataaaattggaactagcttacatctatatgctgctagcatagatcaactttgtaatgacaacacaaagggttataataggttataacccttttaaatagaagcctgctcatccctgaacacagcttagcctctgagcttgtgcaaactttctgtatcattaatatgtaaatcttaccctcagtaggtaagctctttcaaaactgtgatccacttagtatgtccttatttccctgtgaataatcttaccagacaagcacattttgcattttaatttgctgtgtgagtttagtttctagaaactactaagccatttaatgtcaatatgttttattagtcaaaaagaatgattatgatttccaaaataaaaattgtctagcaaatacatattaaaatgaattttgtaaacatatattaaaatattttaaatacactcaatattaaatatatttgaactatattatttttcattttgtatgtgcacctagactatcttaaataaaatagccgtcagaagaggatgacaagttgtgcaatgttaaaaagctggagtgtatttaacactacaaggttagacactatagtgttacacagaaaggaaaataattatgaattaaagttggaaacgtaaggtttttataccactcatatatacgattttttaaaggcttgtgggacatggtccatatgtagtgggaattctcaaatccacctgaaaagcagaatgcatgaagatttacaatagatcatccttggaattactttgtctcactacctgttttctcattaaaatggttgcctttaatatgatctgcataactaggctgtaaaatgatgattgaagataaaactaggagcctaatagaatttcccacaaactagttctcctcattgacccaatagttttaagtattgttttaagatgttttcttttttaaaaacatacatgtgaaatggctattatcaagctcattaacatatcctctacctcacatacttacatttttgtggtgagaacatttaagattttttttcttagcattttcaagtgatttgaaactatttttacaatatgttttaacatattttctgaaaaaatataaagtctttagaagagatattctagaacattttacttcaccatttgtggaaactatggatgagtggcagccattgttggcaagtagagagactagtcatagaaaatttatttaagccaatttccaagttaatataggtgaaattatgataggatttaagtctttgtagagagtaagtggaagaagtaaccttatataattgcagagaaactatcagggccagttacactatcccagcagaaatattgcccaagtgatgtcttgcagaatgatgacttcctatatatcatcaagctgaagatgccattgacaataagatacaccattattttcttaaaaggaaaaatgctgtcagttcaactgtgacatgccttcaattgcaaaatatggcctgtgttcagagctgttaaaatgtgataaatatgtccttaaaattacatgaaatagggtaatttttttcacacagattactctggtgcaatattttttgtaaataatgcagactgatatcaggaaaatccttcattctgtacaggtcagaactccagtgaggtttcactccctctgaagagtgtttctaactccaacactgattggaattaggtgcctgtcctgtgagctcctacaacacctgtacacagctccactgaagcttacctcaacagtcagtttattgattttctgtacctaccacaggatttccaaagccctgagggcatatgataaccctttaaaaaattgtacgatagtgcccagcgtgtggttggtgctgaatgactcccatgaaggaacaaatggatggataatacacagaaggggtgctgatgtagtgatgtagtagccacaatgccaaattaagtttttccttttaaactcttccaaagactaacttcccacatctgaatcatgtttcagagacattttcaagttatcctaaaagctataaaatttagtgccctcttggataatgtgatgcagaactaaaacctgaaggtagttacagtgaactaaaataaaaaaatacgtacaagaaaagttgtgattgtgtactgatatggttatgctttgtgtccccacccaaatttcatcttgaattataatccccataatccccacgtgtcaaggaagagacctggtggaggtaaatggattatgaggcggttttctccaggctgttcttgtgatagtgagttctcacaagaactgatggttttataaatgttcggtagttcctcttgcattcattctccttcctccctccttgtgaaggtgccttgcttccccttcttcttctgccatgattgtaagtttcctgaggcctccctagccatgctgaactgtgagtcaattaaatcttttccatttataagttacccagtcttgagcagttcattatagcagtgtgaaaattgactaatatatgtattaataatttatacattttgtttttgtgtgcgtgtgtaatgatccacttgcctttttcactcacacttcgtattaagtgtaacttaaaaataaataagacatgtctgtgtgtgtgtgtgagtgtgtctttaacaaaatgaaaaggaaatcatatttctttccagagaaatggatgagaatgcagggtgcaacatagcataactgagtaaaaggaaattaaaaaagaaattataatattaaaaattattgggtaataataattttgactgggtctaacaggatagtaggacctataaggtaaggaaatgaagatattggaagcagaaaattactgcttttcccctcttaaaaggtaatgataacagaagacgtatagatagatagatagatagttagaaatgaatcaataataaaagattggacaaacattcttctgatgccttgtgatgtaaaactgaagaaaattgagtcctttatattttgtccatcacaacactaacagtttgattttttagatgcctgatgtccctaatttagtcatgtcaatgaatgttctactagggtactcagcaaagttttgccatcctgagttgcgtaatttggatatggtcaaccagtgcttcataccaagatagctaattgtgtgtggtaatatagtgctcactcctctctttaaaattttgtattactaagttatgagattaatgctgctacagttgtaaacaattatgggatcttaagttctttaagactacataaaggtatttgtactatttttatatattcaataacttgctttgtcatatatgtaagcatatatttttgaataattttgcttgacataacatgcatgaatttgctgtgaattaaaggccagtccttatatacatggtgaaatatggtatatttttgtctctggtaaacccacaactgggaagcagataatattcttgtccagtaacactaacttttgggaaacatagtttgtcctagaaatgattgacatagggctcatggttttaaatacttttattgaagattatggtaaatgataataaatcaagaaaaaacataaccaatttccaaatgtcttcctgatttttacatcagaacataatttttatgtacatataataaccatttgaaacaacttttgaattagccaatattttatttcccccaggtgatgaaagtagacacttttatgagtttcttttgcagtgagtttcatgcaattaagtcaaacaagaacaatttttgtaaaccacagactggaaaaattaaatggaagtagtacataaatgattaagagtgcattattaccataagtaaaattgttcatttcctttacttcgttaaaatttttatcatatatatttactttattaatataaactatactatcttagtaaacctcaccaaactataaatcattaaaaaatttttaccaatatatttatatcatgtagtattagaatgtgtcttgctgaacactttataggaacactattttcaacacattcaggtgaggtaagatataattttcttgtatttcctcctaatgatatggttgactgtaaaagaacaataatcactattgtctcaaagtaaataggctttgagactcattaaccaccttagttttgcttcagctattaatctgagaaggcatttattactttgcatattacagtccgatagagaatatcagttaattaattccagtgggagattttggtatcatcataaacaacattttaaaaaataagctaatcttataagaaaatggaaagcgggtgtgtgtgtgtgtgtgcatgtgcgtgcaaagagaaagaactgcaagtaatactgttttcacattcatggaagagacaagtagttatagctcagaaattcacagaactggaggtgacaggatacactttgatacgaagtcagcatatcagcatagtatgacagttaactgtgtaagctctggggaaatcttgggttcagatacatgctttattgatcattagctgttagaccttatgcaaattacttctcttttctaaatctggggtttgtcaacataaactggaataaaaatagtaccccaaaaagagtgtttaaaaaattaaggtactgtatgtcaaatattcacagtaatgctaaataaatcttggctgttattattagatactaggagtccacgtgatataaatgtcttcttcccaatcatatcatgacacatagggaaatctaaaattaaagtgagaaaaacttaatatctcttatgtttcagtatccctatacttggatgtaggttcactggaataaaaatggaatggaaatatctattctgtattcttggaattctggtgtggtctgtctttctagagtctgctagtctaattttttaacacaaagcagacagttgctgtgttttatgcataatcttaagtatttatttttgtgtaattataatttattttaaatatctatctttgtgtttaggcttagtatgactgttttaaatattctgaggtagatggatactgtgcctatgatattgggcaagtaaaattagcattgcttaatcacctatatcatggctgcattaatatcggctccttcatgagctgatattaatttccaaaatagtgcattgtgaaagatgagtggtatgcagaggtaaattactattatgcttgcaataattaaagaaaataaattaaaaattgattgcaagtgtaagttgaaattaatccatatagactaatagtttatccatataaaccaatttattgaaccaattatttattgaacacctgtcacattcaattttctatgttacatctatgctgtgttaacacactaattttatttatgtagaaatacatatttagcaactggagataccgacacaaaccagatatagttttgagcctgaattagatttcaaaatggtggatgccataacagaagtacaacagtgagtcatggaagcccagaaatggatctacctgatcacagacttctaggagggttttcttaaggctctgatgattaaattagagtggagaatatgcagaatactttatcccaccttgggagatgaggaaaagacggcacatgactgcctgtaccattgaaatttataagtaacactattctatgggattaggaaaacctcactgaaagggtgtattaagtcactttggccaatagtaatctggttcttgctgcatgcaaagaccttaaggatttgtgtaccattgagaactaacctcagcttcttatgtaacaagcagaggtgaaggagtgggggaaaaatgctataagaagatcgagtctttggttatgagatgagagtggtgtgattggtcttgacaaatatactctgttcaaataaattctgaaaaggtagccttgtaggaatccaagtaccagaggagctgttattgtagtgctactgcctgccacatctatcttggataatttctccatttagagaatatggtgtcttcagaatttaagtgggaatttgggggccaggtagaggaaatgagtcttcttatcttgcttccctttctctctccctttgccctgcctttcctttcctttcctttcctttcctttcctttcctttcctttcctttcctttcctttcctttcctttcctttctttccttcctcccttcccttcccttcccttcccttcccttcccttccattcctcccttcccttcccttcccttcccttcccttcccttccttctttccttcatgtctcttttaaatgtctagaatttaatattgaatgctatttgggtgaatgggttatattgggagggtcttaataggctcttttgtctccacctcatctgactagttcagactgatcacctggcatgatatgtaagtcaaataaaagcatttgcctttttggtggcacttagggatgacagggaacgatgggcaaggaccatggtagaagtttggaatattcactataagaaaagggagatggaggtgagcaatgatatgcagaaagaatgccaaatagcagggtgttgcaccatgaaccctgattgacccatgagttggttattgccttaatctacacaatgcagcattttctctagtagctctcagaacagagtatttggttggaaggaagtttgagattccaggttgtaatcatgggattctgaggttctaaagttgaatgattttaagctgcacagatgctgcaacatcttgtcctgtacaactttttaagttttgtgggaagtggcacatagtaagtgatcagtaaatatttctgaatgagtaaatgaatgtgtgaagatcattaaagtcaacatgatcaagaaaatgtgagaccagagtgttatgaattaaattattccaatatgtcaatagaagttgagatgaaaaggaatcagatacccaacactcaggcattacttagatatcccaaatccttatggccagtagcttactggatatcttcacttgagtatgtgtaggtatcttaagtttaccctaacttagttagaaattctgattctcatcttttccaatccttctgtttctctaataccacccttatacatagataaaaatggtccctaccgttggcactgtgcttactgtgacttctttcagctatggctcactttttggggcaaaatggtcatatgctcactgcaaggcaatattttcgtccacatcagaaccaagctctaagtatcctgagtctaagagttactttcccaaatggcccattttccacttttggctctgtacagctctcaaccccaggttcattctcaaaaaggtggatggtgtcactagtgtgcataccttgaggctcactaagtgaatatttgcaccggtgggagactggacagaactggatatttaaattggagtgtccaaatgaatgtgagtgagggtactggctgagaaggatatagcaaggtatgaaaaataaagggtttaggctgggggccaagggccagtgttctctgtgcacagagaacacagagaatttttcctgcacaaaattccaaggaatttgaaaattatatatttaagctaagtataaagtttattaccaggtgtttttatgaatgtagaatgatacaacatattatttaatggattattaacttcattattactttttttttttttgacacaaagttgcactctgttacccaggctgaaatgcagtggcatgatctcggctcaccacaacctctacctcctgggttcaagcaattctcctgcctcagcctcctgagtagctgggactacaggcgtgtgccaccaaccccagctaatttttgtattttcagtagagacagggtttcaccatattggctaggctggtctcgaacttctgacctcgtgctctgcctgccttggcctcccaaagggctgggattacaggcatgagccactgcacccggccacttcattaatacttttaaaacacttaagcacatgttgaacttcatttggaaccaagccttgggacccacagatattatggatgagtctaccttcctctaaactttgctgtctcagttgatgacatcaccatccatccagttgctcaagatagatagttagaagttatccttaattcttctctttgccttgctcttattttctgatacagaagccttaagattctggtataaaatgtgtgttgaaattttatgtatttcttcctatatccattgccaccaccctaggccaagtcatgtcatttctagcttagattagttgaaatagtctccttagctggactttcatgtttacaagctctaatccattctctacatagcagttagaagtcatccttccaaaacgcaaatcagatcatgtcacaagctggcttagtccttcagcagattttcattacccttagaacaatatccagattctttgcagtggcttacaaggccctggctgacttggctcctgcttatctctccaaccttgtcttgtttcctcttgatgattacatttcagtcacacagtctttctcggttttcaaaaaaagctttatttgtgcccagaatattggctatttctctctctgcatgaaatttctttcctcagctcttttcactactggttttgtcacctttttgatgtctgagattttattccatctactaacagaagctttatttggcctcaaacttgtgtgactgcccccactcctgatttccaccttcacggtgtcctctttatttcctgtgttacacttagcacagtctcgaatgtgtgtgcttgtttatatgactgctcatctagaatgagtactgcatgaagacagaaactatgtatctctttatttctattgtattattatcactcagacccatgcctgacacatttgtagaaccaatatgctttgtgatgaatgaatgactgagaagaaatgagaagtaggttatttagtgagtttaatagaaggagtggagcagctgatcattatgggtagagcaggagttcccaatccctggctgtggaccagtactggtctgtggcctattaggaaccaggtcacacagcagggggtgagctgccagctagggaactttactgccttagctccatctcctgtcagatcagcagtggcattagattctcataggagcgtgaaccctattgtcaactgtgcatgcaacggatctaggttgcatgcttcttatgagaatctaatgcctgatgatctgaggtggaacagttttatcctgaaaccatccccatctataccccactaaacccctccctgccatccatggaaaaattgtctttcacaaaattggtccctggtgccaaaaaggttggagatcgctggtgtagagtatatcaaaactatgtatttcttttttggttgtttgtttttgttttgttttgttttttgaaatggagctttactcttgttgcccaggctggagggcagtggtgcaatctcagctcatcgcaacttccgcctcctggattcgagtgattctcctgcctctgagtgattctcctgcctcagcctcccgagtagctgggattacagtgtatatacatatatgaaataaatggtggctgggaagcaatatgacttaaaaggagataatttacatctacatctactaccctttcaattgtacttagctgaagacttctttagaaaagttcaaattttttttgaaaagcagtagtagagtgtgtttgaaaaatagagtttatcattgaagttaagttctaatttctctatacggtgtttaagaacaattttcaaaattaaaaatccagttggattgtgaccaagatttagtgacctccttccaggacaggatttttggagtgtggatcacattgcaatatgttgctatcaatatctgttagttgatctcagctgatgtgttattagtgaattaatggagtggactagagtaccttgcatgataggttaggtattgtttcatggaatttgatccagttgtgtgtatgtacatgtttatatttttttctgtggtaggcttccagaaaaaattgtatttcttttttttttttttttttttttgaggcagagtctcactctgtggcctagactggagtgcaatggcatgatttcatctcactgaaacctccatctcccgggttcaaacgattttcctgcctcagcctcctgagtagctggaactacaggtgcagccaccacacctgggtaatttttgtatttttagtagagacggggttttaccatgttggccacactggtcttgaactcctgacctcatgatccacccgcctcggtctctcaaagtgctgggattataggcgtgagccaccacgtctggcacaaaaaaaatgtatttcttaaaaaggctctaataaaaaacatttgaaagccactgttctaggtgataatgattgtaagatctttgtgtatagttcttgctagctcagtcttattaatagtttcattgagagagaattcaacaggtatttgtttgtaagtactaacaaaaaattgtacattcaatacttatcaaacaaaagttacatgatcttattcttccactattaaatttttattttatttttaaattttgattttttggcatttcacctgcaagtctttttgtcttattagagtcacactatgtgatggtattttttctttatccacaatctcccctgactcccctgttactattatggaataatgtaaagttaagaattaattatgattacagtagttatgggtaattaggtactatgaatcaaatcttagaaatcactttcattattgtaatagtgcctcagaaaacaatttttcctctttgactttttaaattgttaatactatcataaatggcatttatgtattcatttaccaaatattgatcaaaaactactttgtgtctaccatcagaatttaaaagacaccttcctagatcatagagaaggcttactgacatggcacatacagaatggtaaacagatagctacattacacaatgagataagtgcttcaataacaatatagagctgtaagggagtgaattgaagagatactcccctattcttaaatgttcagtgaaattcctttgtcccaaagtgctagttaaacgaagacataaagaatagtctagcaaaaaaaaaaaaaaaaaaaaaatgtgattgtggtagttaatgttccagtcagagaaaatagcatagtatgggagatgagggtggaggagggctatgaaatacagtcgcaagaataagccaagttaaataatttaagctccatcctgggtatatagactttcaagtgtgtgagagagcacatacaaaattactaccatagaagaattttgatggcacttttaattcaagtacacttgaccataggtatctgaggtagtactagattcttgaaaagagagctaatccaagacataaagggtatcaactgataaaaatcctgcaacttttgtatgcagttggaaatggtaagaataccagcatttagaagagaatctccaaaattggcagatagaggaaaacacttctatatgtcttaggatagtagggaagagtgcatcatttgctatataaatggaaatgttcatctaagctgcattttgtatgcacactctgtattggtctggtctcataatgctatgaagaaatacctgagtctgggtaattcataaagaaaagaggtttaattaactcacagatctgcatggcttgggaggcctcaggacacctacggtcatggcagaaggcacctattcacagggtggcaggagagagaatgagcgctgagtgaagggggaagccccttgtaaaaccatcagatctccggaaagctcactcactatcatgagaacagtacggtggaaactgtccccatgatacaattatctccacttggtcccacccttgacacatgggtattattacaattcaaggtgagatttgggtgggaacagagagccaaactatatcacatccccacattcaagatgcatgtaagcacttctgcaccattgccatactcaggctccagctttttatggaatttcatctctggctattcattcatccattcattcatacgtgcatacatacctaaatgcatttagtcaattaatcaatcagccattttggtggccgaaatttataaggcaagtaatacttttagtttctttgatagacaccatgatcagaaacatagtctctttcttaaagggaaaataggaagtcttctgagtcataacagatgcatacataaatttctctgagtcttcataagaaacacaagcaagatttcacagaggcagtggaatttgaactgagtcttgagaaataagcaatatctgaacatgtagaatgcaaaataaaggataagcaagtgctaatgcccagagggtaatacatattaaataaccaataaccaattgctacttgtgtttcttacactagaagacaacttggaactatttatcccaaatattaatttccagtttggggtcctgagacagtaacttcaaaacagtcgacattaacttccagtcctttttttcattccagcctataataataatttgtgtagctgcccacatctctcactaaatgttaagataactctggtttaaaatataaataattgaagaataattagatattttgagattaagaaagaggatggaacttacagaggaaagataaattatagttagaagtaaccttgaggtacttcttgcccaatttctcattttacatatgaaaatataaattatgtgacatcccaaggttgggcacaattgtagtggcagagctgagactggaactcacagttcctgacttgcagtgattttctccccatgataaatctgattttgaaatataggataagaagattgcttgtagaattaaaacctgagaacttgagtgtaatataagtgaaatagaaaattgctaaaataatatttacacataattttacttggatatcactcctaattagtttgagaagtaggtaggacataaataacaaataaatgaagtaatgtatactcaaataaacaaagcttaatctaatatagtcctcatatatagggttaattgttgaaaatccactagtgccaatagactgtatataagtatagaaatagcttcaaattcctgatttctaaaaatatatatgtgatatttcacaaaaattattttatggtagctaatataattaaggaaatgtgtatttcattccataagttaaatattttatgaaattctcaaaacaatgtatacatggagagttgcaaccaaccctaaaaataaatattaataaatattgcaggagaatttttgaggatgatacaaatttattcagttaatatggatgacaaaaataaacaaaataacatgattaaacagaactttctggaaatttagtatactaatgaatgttataaatatcctgtgaataatgtgaacaggagcaaattttggtatttaaaaacctatttatttacattagttaaaatatgaattagttgtataataacttactctctagttattctccttagaattcttacaaatcctgaagaaatggagctttaagtttttcgactttcataccagtatagttactactatggacactacttgttactactatttactactaatggctctcatttttgagcacatttttatgccaagcattgtgctaagtcctttctctacattttctcacttaattctaataatattcttgcaagtttgttattatcacccacattttacagatgaggaaacagcgtctcatggggaataaggaaatgattcaagtcaagcaatcattaaatagcgcagttggtacttaggcctaggcctctctgatttcaaagcccatgctcttgacttccatgctacaccacctctgttcagttgccacatatgtacggagcctctagacactaacactcttttggatattagggatgccaagaacaaaagaacagcttcagcctttccagactttctccagaagagaagacatttaactaaacaattgcaatggaatcttacagttgctgtggcagtaaggcataagaacatagtcagctcatcaaagaagtcgtatcctttctacttacaaattccaaggaaaggctttttctaagaagtgatgcttgagctgagactagaagataaagaaatgttggatggatgagagaatgaatagttgtccagatttgagaaaagactaagaaccatgacacggcatggggaaaagtgtagttttcaaattgactgaagtgagaaatacagctagagaaaaaggcacatgtattagcaaatattgtatgacttttattcacattaatcacatataagaaaggttacaatatattccatagttattgagatactgttgatgaccttatagtactgaaaaaatggccatgtttgttctctgtgttcactctgaacgtaaagcgcaatgccatgaaaggggccacactgggaagaagaaaaccagtaaggagaatgtaaacatgactcccggtgagggctggagggcctttttaaagattttactttttctgtttttaaaacatatttcttgggttagatgaacctaagaaaatatatggagttctgtttatttcttacatactttaagttacatgtttacatctgcaaatatctctgtagttgttgggttatcattgtccatcaaactctttcaaagtagtcattacatccttttcaagtgcacatctattgaatagttaccatataccaggccctgtccatgagaagatagttaaatatctaggattctgggtaagactgctcttcctgttcagaaaagttcagtacagatcaggaaactgagaaacaaatataacaatgtgggatttgtcaaagatatctgatatataggtatttaataaataataaaggtgacatttaggatcatcatggaaaaggcagattattccaaaaaaaggctttaataaagccagctaatcatttgggggaaaaaaggtctggtcagtactccgccctttacaccaatataaatttcggatgaatgggatatttaattatgaaaactgaaaataacccaaaatttgggtgacttaccaacccaaaatttggctgacttagaatgtggggggattttcagtaaattataccaaagacagaaatccataaggaaaagacaaatttgactatataaaaacttccaacttctctgctatgaaataacatatacatggtggaagaaaaataactgtgaaagttgtgttcaacacaagtgagagatgaaaggttactatacacaataaaatattaaaatgtattcagacttgctaataatctaaaaagtagaaataaaatgataatgagatatcattttagcctatccaattcaaaactattttttaaaagtaaaggatacaaaatttcagttagataggaggaagaagctaaagagacctattgtataacatggtgattatagtttataacaatatattatattcttaaaaaatgcaaagacagtgggcattaagtgttctcaccacaaaaatggtaactacctgaggtaatgcctatgactgtaatctgactaactagatttagtcattccacatgtaaatatacttaaaaacaaaacttcatgttgttttgaagagagacggtaggcatatatgtgttgtataacaattttatctgtcagttaaaaaagctatataatatgaatgtgtgattatattatattaatatcctataaagtgatcatattataactgtgtggaattataatgatgtcatattttaataatataataaaacagccattaaaagtggtatagtaatattcctgaatatggaagaaacctttcgcatactcaagataaaatttctttctttcctacatttgcattttaaaatttgtattttctttttttctttttttaaagacagggtcttgctttgccatccagactagaatgtggtggtgcaaaatcatagttcactgtaacctcaaacccctgggctcaaacgatccacctgccttagcctcccaaacagctaagactgcagatgtgcaccaccacacccaaataatttttattgtttttttgtagagatgaggtctcactgcattgcccaggttggtgtcaaactcctagccttgagacatcttcccgacttgggctcccaaagctctgggattacagagtcgcattcatcctatatttacattttatatgtaatgcatttttatattcagagaatacaaaaacttccattttgtaggaaaaaaatctgatgcatttggtggagacattttattactatggcagatctgggttctaggtatacccataacattgtgtcactagtgtgagggagctagactaactcccaccccaaagcacctcactcattccagctttggtctgctttaggtctggtgctgagtagacttggaattaatccttgccttttaaatttgagatagcagaaagcaaggactagtactgcttcttagtcaccactctgccacctccattcttccaaccgttcaaactcaaaaccctggagttttgggtgaactttccttttctttgtcttagccaacatcagtactcaccaagtcctactcattcttgcctccattctttttccttcacttggaccaacattatcatattctggggtctcatgggtattgataatgcaataactttctagttggtcttgtttccctctgtctttttccctttaatttatcctaacattgctacttaaattcttgagaatagcatgtttcatcttagtcattttctattaccttttggatggtgatttcctttctttccttacttcagatgaaaactgtgaaacttgtagatggccaactattgttctaaggatgtgcagtgagcttttcagtctcatttgtctgtagtatcctgatgcacctttgattgtcttgccttcctttcttacttgttggcatctcttttacctatttatctttttgtatctctctgtggaatgaagtataaacataaatatcataaggaaaagccagataactccaataattttcagtgtattaggcatttttggaaaaaaatccagagttaaattgtttatacactttcaagagtctagtcactgctaatttctcctctttgctcatcatttcttagctttggcagattggcccatttgttcatttgtcttttgacccaaataaaaatggtatcttttgtagaaagctctgtaaaggatacctttatatatgtattttcttattctctgttataaaatgacatgcttctttttcacatcttcaacagaaataacataatcttgcaagacttcttcaacctgaatccttgagcttaaactgatgaccaggatacaatgtgatataaggattaagtacttgatctttaatgttaagataggaatttattttaaaaagcatgtttcataactgattcagctgggtgacttggggaaagttacttaagcattttaagctcgagtttccttctctggaaagtgcaaccatttttgagctattttccttcatcggaatgtcctttcctttctgtccatctgcccaccttttaaacattttgaacatcttaaaatcaattttctgagaggacatgcaactttacttcattaaagtatttactaaattgcaaaattttatttatttatttatttttttttttttgagatggagtctcgctctgtagcccaggctggagtgcaatggcacaatctcagctcaccacaacctctgcctcccaggttcaagtgattctcctgcctcagcctcccaaacagctgggactacaggtgggcgcgaccatgcccggctaatttttgtatttttagtagagacggagtttcactaaattggccaggctggtctggaacttctgaccttgtgatctgcccgcctcagcctcccaaagtgctgggattacagacgtgagccaccgcgccgggcctaattgcaaaattttagaaatagaaatgttttgctttgttctaagtagcattttccattttgtttattatgaatattttatgacaattgttattcaaagtttgcattcttcagagtttctttttatttaattataatgtgaaaattaattgacaagtgcaattttattttcattttaagaatttgtagcaaaatacacaaatattcagatgaagttgaaatacaggctaagaagtcagttagacaaactgatttggggcaactgaaccactttagacatagatattcattatcagcttcccctcttccacaataagatttgaaatatgccccttttacttcatgtaccaattatatttcagattgccaattatggctccttgaaatatgataagaatttgtattaaaccatttcttgttgctgtaatttgtagtcaatttgatgttggcatggccagaagataacctcagaatgtcctgcaagattttgatgtgtaagttatataaatcatagaagaagaaatccagaattggaatcttgaatattaacagtttaccttagcagagatgctaaaacctcaacacagcattggatagttagtaatatttttagtacatactatgttactaattcaaagagggtgaaactacattgatatgagttgctaaatattatccaatgcatttctttttctttttctttttcttttttttttttttttttgagacagagtctcatgctgttgccaggctggagtgcagtggtgcgatctcggctcactgcagtctccaactccctggttcaagcgattctcctgcctcagcctcccgagtagctgggattataggcacgtgccaccacacccagctaatttttgtatttttagtagagacagggtttcaccatgttggccaggatggtcttgatctcctgacctcataatccacccaccttggcctcccaaagtgctgggattacagatattaccaacatgattccagttcattaaagctgttctcgtggctgtgtttcatttttattaggacattagatagtttaattatatgacatccagtataatcaacttgagtaagatagtttgcaacgtatatattacattttataaaatggactaaaggcatatttggaaagatgagaacaccatatttatcaacaagtttttgcatctgcccagtgatataaagtaactcaggatcacaaagcaacaatatacataaattacagtaatcaaaatttatgttaagcacaggcagtgaattgtgtaagaataaagtatttttcatcagctgaacagttaccaagaatttagattcacagccttggctaaatgacccttccccacaggaagggttctgtggggttcctttattgccattcagtggtgcttgcttgagtagtttgaatctgcccatatgataggcaccttttttattgtataatgatcctggccaagtcatgcgattgggttgccaccttatgtctctagtaaagcaagacactaggatttgtgctgaaaggaaaagagatgcagaaagggcacactggaacttaaagattgctctgtgtgtgccagacacagacattgtaagggctgtggctttcccatcactcactatacttttccaatcaatatcgtcgtgaggtgactgcagtgatattatttcactgtgtcaaaaaatgaagtgacacctaataaaaatgcaaaggaaaaagctggaaaccaaaagaaaatggtttcatgcttcaaacacaggtagaatataataaaattatgggagatgatgtgtacttcaataaaagtttattaagctgaaagaaataatatggtgtagtataatttacttaattagcacctaattagtaagtaaatgtatttggttcttagatggtgaaccatctaggttcctgtaggataatgatggctgtcaaaatttgatctctccaaatatcctacagaaaaatcaacaaggagagtaaataaaactcttttcaagcaagcttacagaataactagcagaccaagaatactgcacattttaagatacttcttaatgggaaataagttacaggaaacctacacagccagttccaaagcccatgctggaaccagtgtaggcagagagagaagtgaaccagggagtgcagcaggattctcttggtggctgggcataaataagatcactcccaagagggagaagtactgagaacagctctggcagctggtggatgagaccactgtgtactagagaatcctaaggaagaatcttaaaggtatgcagagcagaagtgacagtcttgggtatgcactgcctcagcgggagattctcttagaggctgagaggtgaagggaataaaataagcagttggtagaaatttgaggtattaaagaaaggaatgagtatctgaaaatcatatgacttaccactccctttctggaaataatttttttaaatacattttattacaccgaaaaaacaaagttctattgacaacaacaacaataaaattcaaattcttctttcctagacagaccaattttcttgttattgaagaaaaccctcagataatttaaaataaatagaggaacatcaggctgtattcaaacaccattactataagaagaaaacaaaaagtaagtcttttttaatctgatgattatgattcccaaatacaacccacaactcagaagaaatattattaagcatttgcatatgtgaaagaacatttcagattgaaaatttaaaaactgaggagatgaattaaagaaaagctgaaggatgtggcataagagttgataaaatcaggaaattgaagagaaaggtacaccaaaagaggccaaagattttttttaaaatgaaagtaattggaaatcagctattaaaatatgaatctaaaaaaaagaagaaaaaagtgcaaaaacaaaacaaaagaaaaaaaacactaaaaaatttaaaaacataaaatgtgaatatataagaagaaattaataaccgtaatgttaagctgaattgcttgtaaatcatttaataagcataaaatattttgtagaatgacccacactttctccttcataaaaatataatggtctattatcagaggtgaggtacacatttgttttcagacagtacgacattcattaatgaattaaaaattgggaaatatttataaaatatttctttgatgatgtccagaaattgatcgtatacatattatgagggaaattattttgttgtaaatattttcattgcatgatatctgtccatacatatatatgtatatagatttttttttctccgaagactcaaatcttcttgagggaagactttgttctttatttatatttatatttccagaacatttcatgatgccacatgcatcctaggtgcacggttaaattaacatttgctgcctgaactgtagcatatatcaaccagctactacttaccttataactgcgatattcatatttttagtagagagaaacttgttattttattatgtcttgaaattcatggtgaacctggtgagtaagatcagagagggcgttgactgagcttggcagagaagcaagggggaagataggaaaagtgatgaaaagtcaagccctttgaaggctgtagtggtagggtatgagagaggagagggaaattttagagcttcttccatcaagcttagtaggagtcagcacatccatgtgggcacagagtgacagcaattcagaaaacaggcatggtggtggctgctcacactcagtttgtgacttccagatctgtaattaatataatgaattggacatagtctagttttatgacaatctatagcatgcatcttgtttcttgttacgagtttacaagttgtggctcagaattagtggttctactgtggaccatggggctttacctaggctgacaaggaggtaaagacatcttataccatgttaggcaccataatgacctgagatgtgcagcagctttctgttataggtgctgatgaactatgcttcaaaatggcttgaggctacataaccacattgctagtttttctcctcttgatgtatggtttgaccattccatggttagtaggtatacagaaaatgccttaaacattatgatgtttttattatagagaacagaagaaactctcaccaactgaacacttacatagcttataattcatccatggacaactcaaataaaacataacttgataaatataattgagtcccctcatgcattgaataaatttgggtcattttctaattctatcagaaccaggaaatgtaacaaaatccaactgtaatatgcttaagtagaaaaatatacctcagttaataatttaaaagagctgcatgtgtttatacaatgcctagccgttacatgtctcagaccattaaatctctatggcattatcacagtagttacctcatttccattgtacagatgaggaaactgagacataggttaatagcttactcaaaatcactcagatagtagctgccagggtttacattaagacagcgtggctcggtggggcgtggtggctcacgcctgtagtcctagcactttgggaggctgaggcgggcaggtcatctgagatcaggagttccagaccaccccagccaacatggtgaaatgctgtctctactaaaaatacaaaaattagccagacgtggtggtgtgtgcctgtaatctcagctacccaggaggatgaagcaggagaatcgctggaatctgggaggcagaggctactgtgaagccgagatcgcgccactgcactccagcctgggcacagagtgagactccatctcaaataaataaataaaaataaataaaaataaaaataaaagacagtctggctgtagtgtgtgtgccaaagtactgcagcacatttggtactttctacttaaaattgatttacacagtaaaagtgacagaccaacaatagaaagccaatgttttaattcattgtggaagaatcagtgatagcaatgactaaatttttaaatattatttgtcactgtttgacaatattattgtagacacactaaatttatatattttctaaaccagaattgagacaaatgagtaataaaaacttcccacagtctgtacatttagataaaacaggtaaaaaattaaaaagcaattatacttttgatgttattgttttttaaaaattaaataatgttttctagaaaattgttctatttaaaattctctttagctttgatccttccaaaattccaattaatgtcaattgaggtattgctgattttgaactcttcacttcttgagatctagaatatcgaaagtctggcctctttcttgcaatcagttctaatcagcagatatttattgaatgcctattaagtgcaacactgttactaagaaataaatatcttcaaataacatgcattcttgtagggaactttcattcttcaagatgatagaagaaatgtcacaaggtgaaatatgtgaattcatttccacatgaataaaacagacaggatgtactatggcatttctgaaggagaggggtctttatacttcagcattatggataaaaaaagttctcatggaaagaccaacttgaattaggcatttctaagaactttttaaccagtaactttaaaacactttccagctaagttgtagacttttgattttaacagacaggaatagaaaagatgtgataaaaagctcaaatttgagaatgaactatatcccagtaacagcattgagtgttgacaaaaagatgtgttcttttaaaaatcaaagcaatagatacacatagcttcagaataaaataatggcaataggtttataaacagagtcagcagacacctacctcattccctacctcccttggtattaacagggaaaaattctattaaatattaattttaatatttagctgtgtgtattaaaataatacagatatactgtcatttctaaatatatatacttatatatatttattttggacatgatctgttgattttttgttatagtacttactttgctcacttaaaaaaacatacacatacacacgtgtacatgagtgcctgtgcacacacacaagtacctcccctccatatatttctccaacaaattcattctgataagtttatggtgaggtgtattgtcagtattattgccgttattcccatgtgtctttttttctttctctatatagtctctgcttcctcctggtttgattatcctgcttgtttctattggactttctttttcatgttggaatacctgataatccctggttacgttctccattaagagtaaagcactgaaaagctctgtgtgcttggtgtggcggctggagaatgaagagagaaagtgataggctttccagctgctgagtgtgatcagtgaattggactaaaatctgtatggagggcctggcgcggtggctcatgcctgtaatcccagcactttgggaggctgaggcaggcagatcacgaggtcaagagttcaagaccagcctggctgatatggtgaaaccctatctctattaaaaatatgaaaaaactagccgggcttgggggtgcgtgcctgtagtcccagctactcaggaggctgaggcaggagaatcacttgaatccaggaagtggaggttgccatgaaccaagattgtgccactgcactccagcctggacaatagagggagactgtgtctcaaaaaaaaaaaaaaaaaaatctgtatggaggaggtcttacaaatattagtaaccacactttttgttttttttcttcaacttttcagttttggggtacatgtgcaggatatgcaagtgtgttacataggtaaacatgggccatggtggtttgttgcacagataaacccatcacctagacattaagcccagcatctactggttattcttcctgatgccctccttcctccctcccacacccccaacaggccctagtgtgtgttgttccccccatgtgtccatgtgttctcatcgttcagctcccacttacaagtgagaacatacagtgtttggatttctgtttttgcattagtttgctgaagataatggcttccagttccatccatgtccctgcaacagacacggtcttattccttttaatggctgcatagtattccatagtgcatatgtaccacattttctttatccagtctgtcattgttgggcatttgggttgattccatatttttgctattgtaaatagtgctgcagtatacatgtgtcattataatagaatgatttctattcatttgggtatatacccaataacagaattgctgtgtcagattggtatttctgcctctaaatctttgaggaattgctacagtgtcttccacaatggttgaactaatttacattcccaccaacagtgtaaaagcattcctatttcttcacaaccttgccagcacctgttgtttcttcagtttttaataattgtcattctgactgctgtgagatattttgattttgatttgcatttctctaatgatcagtgatgttgaggtttttttatatgtttgttggctgcatgaatgtcttcttttgagaagtatctgttcatgcgctttgcccactttttgatggggttgtttgttttttacttgtaaatttgtttaagttccttgttgactctggacattaggcttttttcagatggatttgatagattgcaaaaattttctcccattctgtaggttgtctgttcactcttaagatcatttcttttgctgtgcagaagctctttagtttaattagattccatttgtcaatttttgctcttgttacaattgcttttgacattttcatgatgaaatttttgcctgtgctatgttctgaatactgttgtctaagttttcttctagggttttcatagtcttgggttttacatttatgtctttaatccatcttgagttaacttttatataaggtgtaaggaaggggtccggtttcaattttatgcatatggctatccagttctcccagcaccatatattaaacagggaattctttccccattgctgaagatcagatggtttagatgtgaagtcttatttctgagttatctacctgttccattggtctatgtgtctgtttttgtaccaataccatgctgtttggttactgtagccttgtatagtttgaagttgggtagcatgatgcctccagcgtgtttttgttgttgttgttgttgtttcttatgattgacttggctatccaggctgtttttttgttctgtatgaatttgaaagtagttttttctaattctgtgaagaatgtcaatggtagtttaaagtgaataacattgaatctataaattacttagggcagtatggccattttagcaatattgatttttcctatccatgagcatggaatatttttccgtttgtttctgttctctctcacactttttttttttttttttttttgaggtctatcagtcagcttttcagagtggaacaatgtagttttcaatctgggaggtatgcatctctctactcatgttctggaagctagatgagaagaaacagcagagttaaatatgtagacatcagttaattactcactttcccaccctccatatgcatttattcatgttttaatttgcattgtgctttgctgtgccgagtttcctccaatccatgatctctcagattttctttttcaagagaatacccttctagctgggctggttagtcacagtgtagtggcatgaaagatcattacctggcttcacagagttggaatcttgcactataagttaggagtctgggaggatataagtcaggaggacatgcaccctctctttggcatttccctttgaagtcagacttagtcagttgctattattctaagacctttccatcaatgtaaatgaatataggtttcttacttgttcttgtctttctcctcttcattttttctatgtggcttagtaaattattttttttctttactaccatttagtggctttggggcaggggcaggagattaatcatgcatattcaattaaatagaagcaactatgtatcttattaatatgattaatatgattgctattccctataaattttccagtaatcctatgacattatcccatttagtggatgagtatattaagattcagctaaggttaagtgacttaccaaactgggtttgactcaaagatacagaaacataagaatacagaattcttaacattttaattaaggacaaaagtttagtattcttttcccttagataatatcttccaaataattttgatataccaagcaaacagtgtacatgaggttatacaacattccattatttccctttttacatttatctgaatacatcaccaaagtttctgaacaacctgagtagtcagaattgtaccacaggaaaagagtcttcttccttccagttttcaatgtcactttatgtcacatttctttaagctattctgaggtacaaaccattccactttttgcccactgtactgtcttacatctgctgcactatttctttttgtcaggacagcacctcatttccaggtcttagttgtctttgttgttaacccaattacctcaaaaactgcttcaaacaaaaatgatcatttattatctttcacattttgtggattacaaattcagacacatcacagtttctgtggatctgctgggagaatgaaaggtcaggagcttgaattatcagaggtttccttcacttatatctgaaggtggattcttgctgttagttgggacttgtgaagatggtgaagggtctgagattttgccagatatgtaaactatcatacatgctggcagaagacacaagattcctgagtcagagacaaaagactttattaattaaggcatagaagggagagtgattttcaagttcacgcaattacccttgttcttaagtcctacaaggggaacatggagtgactcaggtggatactgcacatatagtatatatgcttcatagatgagcaaccttgagcttggaaaatatcaatctttgcaatgggctggaagtgaacttccttgaactttgcactgaagggcaacatgatcctctgactggtcagtaaacaaatctacccttgctctagagagggacgctgtttctgtcttccagggttctctggtatgcaaaattctcggaaaggtaatctggaacaattgtctctgctagcaagatgtgcagaaacacaaaagactcattgagaagtttctcctcataaaatgaaaggaggacaatggactttaaacaataattggcagcttctgaagtgtcttttaggacagattcatatgaacaaataattttaccagattgtaaaaaatgtagaggaatttggactccttagattggtggtccaaatgaaaggctgataaattctgcttgggggccttgattcagagaagacttcaaatagaaaatgcttgaaaggagcaaattagataataaggaaatctttacatactctattgctgttcttattgttgttgtcattagctgtttaagcgtatgcatatgacttatcacatctaagatgcttgaatagttttggatagcatatattcataagaacatttgttaacattaaagtaaacttctagcctggagaagggtagactcaggggtatgcatgatagcatgtttaaataatctgaaggaatgctgtagggtgggtggagtgacaggtttaaactgctccagaatacagaatcaggatcaatgaataaaggttatgagaaggctgatttaccctcactacaaagaagaacctttcaataattaaagcacagcctgggaggaatcttaattgacaaagagaaagtgcagctttgaaagcaaatgcagagagagcttcacagaaaagagagcatggaaaaatcaagccctgaataatgtaatatcatgtgttggtattcagaagccaaaggaagatggtaaaatggtagcagtgacagtggtcctgggagagagatgttctttggataatttcataattgggtaattatgccaagaacacatgtgtacccccaagaggtagacaacagcaccagtgaagacagatggagctgacttagagtgagcttttcccttccttcctcaccctgcctcattctctctctttccttccctttattacttttcccccactttcacgatataaatatctactttgtgtcagacactatgctcagacctaaggctatagtagtgaatagaaactgtttttaccttcaagaaacttacaagttagtaagagaaacaaaacaaatatatgacaacaaatcataataatttgcaagggagattttcaaggaagaaacttacaagggacaaccaaattagattgaaagactagaaaagcttccctgaagaagtgatatttaagctgagatgtaattccaagtaagaattttccaggtatagaaagaagggattgctatggaaaatatgataggaaagaccttctcacaataagaaactgccagaaggccaatgtggttggaaaaaagcgcctgtggataaatgatctgagaagagactggagacttaagcaggatcctaaagcagaactgggcttctgcttagaggactgattggtgatgaggaggtgtatagagggctgaccctccaggaggctgttgccacagtccaggtgtggtatgtaccaaatacctggatgtggaggaggagagacatgggtggatgcttttccacaccaataagtaaaacaactgaccaatctccaagcaaaaaaaaagtgatcatccatcagtattattttctaattgccatcaaatgtctatgaccctcagaaagcatgatggttaacaatacagactttggagtgagattggctatgtccagatcctagcttttgtatttactagttgcatgaacttgtgcagtctggccttcagtgcatatacctgtaacataagctgcatagacatgtctgttttatagggttagtgaaattatccaaatggcgattatccaaatcacgatggtgatttatggaaagacatcacaggcaaagtatacaagtttctttaaagaagttaacaagaactgaactgggtagaaatggttgtacaaagccagaagctttccacattattcctattagaggagcaaatatcccatgccattcaagtatgtcaaatgtgccctagcatttattggaccattaggtttttcttggtgtttctttatcattcttctgtgatgtcttaaacccttttggtttgttttaatatttatgtatttcttaagaggtacatgtaactggtaggcacactgccaacacattactgaatttttctcaaggttaccataccaagtgtattatcctttagcaggccaaatattaggttttcttgaagtttattcctgcaagtttgtgcaacaatttaatgacacattttaaatttaaaaaaaaaaaagaaaaaaaaacttggtgcaaacctggaaatttgtaaatatagaataggacgcaggctttaattactagtgaattgttaaataaatctgtttggtttagttttggttattctaaattctattctaaaaagaatttcttgtattattttccaagagcttataataaagtaccccttcaagtgtaataatacagacacgtctaatcgaagtgagccagctcaccatctgctcacagttctgctacttaagcagtgataacactaaaaacagtctgccagagtttcagttatgcaaataaaataaatggtgggactcagactatcctagctttgcattaatttgtgtgtcttcagaatgacaccaaagtagaaacagttcttctgtgtattatgtcaaaggaatatattttataaaagctctctgtcaagtggaaaattagtttcaagatataaacagtttttgtgcttaagtttactaaactaataaattttaatcatgataattacaacaataatatacataaataaggtacgtacagcttattcctcctttaatttgcttaggggagggctttatgtacctgagaggaaaaaataggaggattaccaatttatatgcttggtaccaaaatatgtgattaaatttagttggctacatcaggccatcatgagatatctctttaggatgctcataaataaattggccaggtgtaggcttacagcctgaacaacatttcagggggcttatgggagtaaatagaagtaaagattagtcagtagtagtcctattcagcaactttatcaaacctggaccaaataatctcctgataggcaaacaatgccgtgtctttcccaagggatagcacttgatgtgtccctcttagtacacctaagagctctttgtggtcagaattcatacatcattaatgattgttctaatattgtttccacaaaatggtaacagcagtaatttgatgctgtcttttgttgcaaatatagtctgcttttgcgtaatccttagtcatcttgtattctccaccaaaactttctctcctgcttttagatttacattgtgaggctgtagatggagaaaacattcttcctctcactcttctttcttgttatctgttctgatgctattggacattttgggttgagaatctatcatattgaatgttggcatgaaatctgtgcattattcaaactcatatttaactcatatttatatgcttccaaaatgaaagcatataagtagcagcagtttcattttgtggaaggatttacattttccttttgagttacagaatataaggaagaaaatcaacaaagtcttcagagacttgatgttttaaaggtagcttgaaatacctcaaacataaattatccagcttgattatgtcaagaaaaaaagaaagaaatatcactttgtagtcatggttctctttttatatatttgtttattttgtagtcatggaacgagcatttcttgaacaaaagtagttattcattatgataaaagggtcaatattattttaaaaagaactgtgttggcaatattgaggcagcgtaaaacaatattggaattatttaaaatattgaaaaatacaaaggagatgatattcaagaaaccctaacgtcacaaaattgggtaaggaattaaaggaagattgcctggaacttgataaattaaattaaaaagttgttatttatgttgttcctttttcctactataatttcactgtatttagccaggcacagtcagctaacctgttagattgctgtaaaatttgcaagacaaaacttgtacaagagtttagataaatgtttagacctgacctatctgagttctacatcattgagaagaaaacatagtataaccctcatttaaaatctctcctttaagatagtccagcaacttatatccataagcaattaaaatttgtaactttatcaaaccatttttgaaataagtgattcttttaactttatttttacaattctacaattttaaaagccaaaacacaattacttgagggaagtgataaaggtgaatgaggaatcctatagtcttgaaactgaaaaatagttgagtacatattttctctgcactttatggaagactaaactgaattctagaaaatcagaagatgcctctagattgttttcaagccaagaccacatgggcatcttgatgtcttagagagtatatattctactgcactatactacatgtagaagattctaagtccattgaaaaaaattaccagggagagaaaatataaaataaataatagtacctggagttaatgtattgttaattttgagttcaaaggttttttttttcctatatgcacataaccaagctattaataataaaataacaagaagatataaaaaggtgatttttttttagtaagtaaagtattttgaaaaatgttccaaaatttataaaaatattggtatgggatttctaattttattcgtgtttcagattaatttattacaatatccagtgtcctgctttattaaacagctgagacaatacagaaaggaaaactagaaattaaattatctatttatgccttttaattttagggaaacagaggcttcatagcactcaaaaaatttattatggccgtcaaacagcggttcacaatagtgttctaaaatttaaaaaaatctttttgaacttcacattacaatgagcaactgagcagatggtactaagaaaagcttcaggtgtgtcttcctcttttatacatattttgtttaatttatattgaaatgcagtccagagatgttatgtttcgtttttattttattttatttttattttttttgagacagagttttgctcccattgcccaggctggagtgcagtggcatgatctcagctcactgcaacctctgcctcctgggttcaagcgattcttctgcctcagcctcctgagtagctgggattacaagtgtccaccacccagagacataatggccatttttgatattgttatggacaaaactttgattggtatattaattataggcaatttcaagatagaagtatagaattatgtgaatttttgcttagaagaaaatgaaagcaaataacacatacatgctgctgaattgcttcaaaaaattatatgcaaaaattgacgctgtagtcaatgctggttttccttagtatgaaaaaggtgacttttcagtctatcatgtactttcttggagacttttactaaagatttatctgcaaattaatggaaaaatagggtgtaatgaataaaaaaagagaaccaaacagccccattttcactccctcaacctttggctagaaagtaagtattctaaaagttatactttggaaccatatctcctgggttgatcttctactcagttttagcatgtcagttgatttttattccttcttgcacagttatttgttcccaattcttcaatattaaataggttcttaaaattcgaaaaggagtaatggtgaaacagtgtttccaaaacacaacatgacaggtaaggagttctaagaaacatttacaagttatttttgactgagaatgccttttttacttcctacactcttgtataaatgtagatggggaaggcattattattttctttacataattaagaaaaccgaagcagataacatattaaatgatggcttttgcagcatcaaggttgtgaaatgtagacctcagaggaggactcagaaattctgctgtccagatcaagtttccattctatttctgcaaagatactgtcttgggatacagaaacaaagttgttagtatatttattataaattttgataggaatttactttcattgtcaaatagtaaatatgctgactcttacataataaaattgtctccttgacaccacttttgaattacggtcattttctggcagtgcaaactgttattttttttttgaaagaagcaagttctatctaattttagagtctagagtctatttagactgatactaaacaaacacacccattaaaaaacattccactttgtctgaaattgatatatttgtccttgagtgtacatttcgccttacctttgtatgacattttcttttatggtgtttttgaaaactgcatatagttgatttttattcacaatctgaaaatatttgtattttaataagggcattaatccattgacttttactgtcacagctgataggctgttatatttgctgttttgattcgtgccttttgttttttgtgtgtattattacatttgtttttttcttttaatatgtggaatttattttcatttctttttttttctctaatgattggggggaagttttagaaagatttattttccttttcaaattctcctggtagttccattttagttttttgtttgtttgtttctttacttaatacttgaacctatatttctctattaatgttaatgaggatattatatcaacttaatgtatattaaatgggggaatctgtactctttacttcccctatgcccttaactcacttgtttcacaggttttgttgatatatccttatataacatggaaccgttatatttttatctttgagtccaaaatttttacaattacattttgtggtgcaccctatttgtgacaaacattgagagaaacctccgcattttcactgttttcaacatagtctaccaacacttaataaactaggtcttccctattactatcatttattttatttataggtagccagtgctcattttttgatatatttttcagagttacatgaagatattatatcagaaatcaaattattttgcttcagacacaaattaaatattaattagttataaaattctccataaactagaggttaaagaaaactcacaaacgcctacacggtacaagctggaaatgtaaattgtgaaatatgcctaatgtaagatcataggtaaagtctatagcatgatgcaaaggcgcagacctattctgaaggcattcatattcaactatgtatttttaagcttggatagaaaaaagaaatgacaacaggccatttagggtcacagatagctagcgttcctgtagacattgcttgcgtgatctttatcatttagtggtgaagagaagtctgaggcaagtgtgattcctggtgcacatgacctgcttttctctacctgacttttttcattatcctcaaagaactagaaaaaaatccctgaaataggcctaactgttgatggtttttaattaagttgatgtataattgataaccccttcagttttgaaggttagcattccaaataaattatttaatttttgaatgttgtgtctgtgccatgtgttctgctgttttctttaagaacatcaatatcctatgtttcatttgcttccacatagctttatttccttgcataatgtgagagtcttctcatttgtaatttatattgtaggtttagttttctacataaggactttgtgtatggcttctgattttgtttttgccattgtacttatgttgactaaaactacttctttaacagcctgtgccctttatttgatatatacatacctttcaaccaatattactgcccttcttataaatatgcgtttgtgtgtatgtgtctgtgtgtagttctgcagtttttttttttttttttttttttttttttttgagacagaatctcgctctgttgcccaggctggaatgcagtggtgcgatctcagctcacttcaacctccaccttccgggttcaagctattctcctgcctcagcttccctagtagctgagattataggtgtgtgccaccacgccaggctaatttttgtatttttttttttttttttagtagagatgggttttcaccatgttggccaggatggtctacatctcccaatctcgtgatccgcctgcctcagcctctcaaagtgctaggattacaggcgtgagccactgcacctggccctgtagtctcattttactttatttactgttgaatgaagaggactttccatgtctgttatttgaatagtaattgattgagaaaggttctaattgtcctgctcttcaacccccggggtgctgttacagttcttgtatcagaccttaaaatagaaaagaagttgacaggtaaacattcacatcatcctttttggatcttgtttttgcataggtataggtctcttgaattaggaaatctctcagttacctctgtctgtctaggtagagtagaatttatgcttggataatttaaaacagtatttcttcctctgacactgttgatacagaaaagcactctcacagtttttcattgcttcatccttgcctactgccaatctcttattccaacatgtgacatactattgcctctccacttcagctcaatccatattgtctatctggaaactggtgttgctgaatagctgaaaatattatttctcatatttttgtaaataggttgacaaatgcatcatgatatgttcagcactgtactggttttagcactgtaaatctcaagtcctggggaccgccacagttttaggcaaaccaaataattgtccactttataagcaaccataaaatataaacttcccagagattgtaacttctagtagaccatgttccttttacctcattactaacattatttgcctttttaatatcaacactagctaagttaattttatcttctgttgtatatatttttaaaaagcagtaaactattttttgctttaaagatataagattaaattataatattaaatgtacttgttcaaattgttggtaccactctaactgaagcaattctgaaacttggctagcctgccctcaaataatgtagtcagagaagtacaaatggaaggaaagtaaagatgaaattttgtctccttggctagctgttctataaaagtctgtgggatctgcaagccctgtgatcagtgaaacccttgtgcctttgacactgggacatgtcatggtaggaggggtgagtaaattttcctttacttggatttagcttgagtatctttcctgagggctccaattgcctttggcttgtgaaaattttcctgagttctacaaattaatatgtgggaatgccaaagtttgtgtgtgtgggagtgagggtggtgtcaaatggaatgaaaaagtgaagatgtaatagttcgttttcacactgctataaagaactacccaagactgggtaatttatgaaaaaaaaaaaaaagaggtttaattgactcacagctcaccatggctggggaagcttcaggaaacttagaatcatggctgaagacgaacggggaacaagggaccttcttcacaaggtggcaggaagaatgatgaatgcaggaggaactaccaaacaatcataaaaccatcagatgtcgtgagtgagctcttatgacaacacgaacagcatgggggaaactgcttccatgatccaattatctccacctcgtctctcccttgacatctgggcattatggggattatggggttacaatcaaaatgagattttgggttgggacacagccaaaccatatcagaagggtaagtcagtttcgtatcacaaaatgatatgtgcttaaactgaaagtcttaattatttaaaaaaacttatttcagtaaatatttgcagaataatttgtatatgtaagctactatgctagaatgtgtaggacataaaaatttagatatagactctgcctttacagaactttcttatagtaagagttaccaaacccactgcaaagtctgaaatgtcatgtaaaagtaatttgaaagtgctgaaaaaatatagattatttttgattggtgaagatcatggaaaaattagttaagataatattaaaagatatattgaatttaaattgacagaatttggggaaacatctcaaacccttagaataatatgtgaactgggtaagttcaggatgtatttggaaattcaaaagaacctgttttaactggtgcttcagatcattgatggaagttagtgcaaatttttctggaaagtttggtcaggaccagtgggtgcagagatttgaaatccagatttaagagtctgacattttttttaatcacttgaactttttcacggagaaactgtgccctgtttatctttctattcatcaaacattgccgcagaataaacactcaataaatatttgtgcaaaaataaattactaatgacataatagctgcacatctgaaatgactgtgtctgtgtttacatgcacttatgtagagttttccccggaaaatttatttacatttttcaaaaccaattatatggaaatgaatgaatgaatgagatattgcatataatttcactgtagactaaattagaagatattttttcccttttataaccaggagcataactaaggataccacttagcaaaattattatgattatgagtaaggtttcatttaaaaatattttgaaaggcatagacagagtatcatgaaataatctgggtgattgtaaaataaacaatttgcacaattacaggtccaccgaaggccagagctgcaaagggtatgtctgattgctggtgaagggtataattatctctgaggttgggaagggttatatgtgctggcttgtttgccaacatctgtcagctgtttctgtgtaccacattttctgttctagttttgagtcttaatataaagtcttcaaatattcctggcaagagtagagttatgtatatgcaaaaatatattcaggtttgtctcttaacatatgttcttacacagagaataacatttctactttctgaacaacatttttaattttctagcagaaacctgtattttgctacctattttcattaattcaagttgtgttcttatatcgaatagcaggtaaggggcttcctatgtaccaactgagagtgatttacattaaaagacattccagacataaaatcatttctgaaggttatacttcctgtcctgaggacttttagagtaattttggcactacttgatgtccttatcttggctgtatccttaaaatagtaggctctcatgcagctgtggtagagcaagtgaactggacttaggtaacagaaatttgtctgaatcagggcaatgttatttattgactttgtaactttcaacaaatgagttaacctctttgtgtctcaattcacttttcttattctaagggccttaaatgaattaacttatttaattctcagacaactctagggaatggtaccacaacggtcatgctcactttctaaattaggaaactgaagtagaaagaggttaagtaatttacccagacaggtgaatgcaagcataagaattgaatcgggcttctgtcccctgatccataactttacccacgttcttctgtgtctcgctaatattatctattttattattttgaggattaaatgagataatttctggccatggcagatatttattatattggtttaatatacttattaaacaaatataaccacgatataaatataatatattcattaaaccaatataaaatattaaaccaagattttatattggtttaataaatatactgataagatatttattattttggatatttattagtttttttactcttgagtataaactttggagaattcgagattttttttaaagttaatttttttacaacaaaaattattcttgataaacttgctgagaaaaagattgcgtgaatcatctggtcagtaaatgcaattagaaaatgttcaggtggttggtagagccccactttcagcatgaattgctttatagagcattaggtcacagattattgaatcttataattacagaagaaaatttatgcaggatttcattgtttttgactacttaaattccagttaccactggctatgcctggagttgaagggtcatacttaagagcaaagacactttgacaaaatgaagacccacttaattacttaatgggactgcaaaataccaggtgcagccataaaatgctaaaagttcatagcaggaaaaccttttggtgttacaaattttcatcaacatcgtcatggagatattaacatatgccttctaaaaccaggtcagaaattacatcatgcctggtttgtggccagttgttggcaggctaggagtaactctagagcgttaggcaacagacacttgtcatactcaaagcatcttttctctgtgtgattgcataagctatctaactggaaaggtacgactcctgaagctgcattggcttggttttcccagtgaaaatttaaaataggcaaaaatgtttgctacaaacatcagtttgtggatatttaaaacttatttgctatttaaagaacaaattattttgtgaaaaaaagaactgtcatttctagatgagactatttggataaaactgcctttaagcaagttggatagtaacaggaaaatatttcagggacaaatagaaataaaaaaggagttttggactactgaatttagagttcttgttgggtatctacacgaaaattctagaagatatctagacatacagttcttgaacttggaaacagcttatttggtgtctgaagcctgggggccgaagtagccacatgtacgtagtgttgtttatcaggtgttcaataaggtggaggattgtggtggtggggtttacttgtggtcctcttcctttatctgtttgtctcatcagtaatttagatgagcacagataacatgggtgagtttctcaggatttcaaatatcataaaaatgcgtggcataattaatatatgacaaaatcagaattcagtaaattttgactagaatcagtgtcaacaaagtgaaaatttaaaggaatagatattaaattctacatttacattgaaacagtaaatacagtcctgcagaaagattagtgaagccacactttaaagtgcttagttgaagatgaactaggtgttcttttgattacttttttttttctcacaagtggcttctacaactcctcctccttgcccaaataaacaagttgcagtatttgattgtatcaaaaaaaggcattctttctataatttatgtctgggactttgcatattgtttctaattctcattcttaagattgtaatacagtcagagaaattacagtagttttaatggttggaaagtagattatttgctgtaaagatgatatatagatgttttaagaatttttttaccagggtgatattgggtgcatataattcaacgattgttactgtattgcctttccccacagtcactttttaacattttcccgcaaactcattcacatcattgtctttgaaagttcaggtctagagatacctcctctgtgaggacttccttaatattcccaggtgtgaaccaatccctcttttgtgttctctttgtgtttctgttctatctttattgttttaggacttaccatattgaaagacattaatttattgatacttgcgtctgtctcctctagactgcaagggatgtgagaactcagacctcatcttactaacatgttatttatgtctgtggcctaagtcttagctcatttctgacaatatgcttttgtaccaaattgaactgggggcataatagaaatgttccatcgttctctggaggaaagaaatagggccagagggcagaagtgacaaggacacagattatttaagctcattactaataattagagctgtctgaaaatgaaatgacccgcctttacaatgtaggtcaagcacaaggtgaatgataatgcagaagaaatgttgcatagcctgacctctaaattcccctccaacttctgtattccatgccttacatttttctcttgtgttattaactaccctcacaggtagtcttcaaaagcactttcatatatgttatctcatttatttgaacaaatttcctgtgatgtatgtagggacaggtattatcattctaattgttcagtaaaatgaggcataaagaagttaagcgacttgaacagggatactcagcattaaatgtgagaccagaatacaatcttcctcatggcagtttagtaatttttttagatgaactatctgaaattatcaagtttgcacattttgggggacatagtgattcaaatattcattaaataatatgtttttcctgattatgcttgtatacagccttgtgtttttgtgatcaaactactgtttatctttttatcccacctttaattttcatacttactgatgattctcaacagccagaaaaacaacagaaaagtgtataatataaaacttagtgcctaaaaaaagcagtgataacatgctgtgtgtttcagcagtctggttgtgtgatggaagctcatgaatacacacactgcgttccctttcaggatccccaagaacggagaccaggctgttgcaatttgctcatctgatttagcagggatatctgagttcactgtattccctggaaaggctaaagatacagaagagtcattctggcttgcattaaaaactgactgtgtattttattttattatggtctatctgggtctggtctggcagctatacaagaaggattgcacttacaagttagatatttcctgaagaagagttaagaccatgtgagaaaagttaaccgattatttctgatacttttttctgtaaaagaaaccacattagccccagaaacatgcaatttacccatgaaacaaagctgcacatgtgcctccagaacctaaaataaaagttggaagaaaaaaatagaaactgccttaaaatttagtggcttaacacactggcaattattttttctcatgatgatgtgtatttattgttcctgtcccaggaacaagaccacttagagtggtctcaggtgtgatcgctcatgcagctacaagtcagctggtggtcgggctgtggtgtcagctgaagccccttagttctcctctatgtggcctgctcagacagctagtttgtgccaagttctcagagagagaacatggaagctgccagcctgattaaggctcagactctgaagtacaggaatgtcactttagtcacgttctcttgatcacagcaagtcaagtcactagcccagctcaaattaaagaggagaagttgccttttgaagagaggagcaatatgcatgaaagggataaggagaattgatggtggccactgttggtgaccatagttgcatgtagcctattaccatgacctactaggaaaacagtaacattcagaaagatgtgagttctggaatagcattgctaattttcaagatcatagaaccagttacctaaaaatcatatgaatggtgtttctcctctatatgttgattaaaagccctaaaacaccaaatttcttggagtaaaccaatttgtgattaattctgttgttacagttatgctttactatttatgtagcaatttttgtaattttgagtgtgataaacattttctgataagtggcagatgacaattttgggatcttgaatttttatgatctatatatttattgtttaaccgtttttgctgccttaagatacttaattatgtttaaatatggtttgtcccactaactttgtgtaactacagtagttatttacaggtttttttttttataatttactctttgattaattcctaagttttattcaggtggaattaatttttaagattcctttaaaaatatctgatttagttataaattatctcagcaaaatcatgaattgcatttgcttttaccacttcttatcaatattgatagagtttggctgtgtcgccacaaaaatctcatctttaattgtagttcccataatccccacgtgtggtggaagggaccaggtggagataatagaatcatgggggcggtttctcccatcctttcctccttatagtaagttctgaggagatctggtggttttacaatggacttctcccttttgcactgcacttctccttgcatctaccatatgaagaaggacatgtttgcttccccttctgccatgattatatgtttcctaaggcctccccagccctgcaaaaccgtgagtcaattaaacctctttccttacccagtctcaggccgttctttatagcagcatgagaatggactgatataaatatttaacaaatgttcagttttttttctatagaacactattttgaaatctgaatatatggctttcaatatgaatccaaatcatctgagcttgcttttattaattttaccttgatttattcattttctagacaatcaatgcatgcaaattttatttttaatatgttttattactttatttgtgatatggaattagaatagcaatcttagtgtttttaagatgtatatcttaaaaactttaagctgcatttttgaagttcatcacattaattcagatttcataatttaaaaaaataaaattcactattgctcaattgccttgcaatagacttcacataataaagacacttgacagaggaaattttgtgtcatcacttattaaactcaaagttatataaaaaatgttcttctacatcactaccatactcagaatattctcatggcaataaattcagctctgttctgttgatagaaatttgtatgacaccagtgaatgtggagtcatggttccagaacagggatttttgatatgttttctgttggtagatgttattaattttagtgtttaaagcctagtcctctgatttaacatttcattctggcaactgtgttatttcacgagtggaaaaatatagtgcactttttttaaaatcatggtttttatatgcataagagtgtttgttctgattcacaatggaaactcaaaataacatttcaagtttccttatgtgcaaagactatttacaaatctaaactgaaaacagacaatctttcaatgtgttatcaaaatgtttatagtttctttttctggagatgccaaatgataattattgaataaaattctaatctgttgagcatttctgtaaataaaaagtgaataaaactatgatttgttgttttttataaatgttttataatgaatgataatacatttacatataatttaacaaattgtcctatcctgttctgtaaaataactggcctgaattacttttatagacttttgatacatagaaataatgtttttacattcttaggtgaattatatagaatattctgcaactagagttgtccaacctgttggtgatctattaatgggtcatgaaatcaactttgttggttaaacttggcattaccaaaaaggaatcaaattgactaaaatagatcagagtgaagaatagtagaatacataggtgtgcagtaaagagtagattttatttcatgaagattttgtttcacttttatacatctatgtgtggttggtcactgtaaaatatgcctctagctaagggtaatggtcaaatcaattggaaaggtacctgttgagaagtgtctctagttttttaataacaagattaaatttcattattgaactaagtctagtgtttctagctgtaatttgatcagccacagactgttttaaaatatactatcctgacttctccaaaatgcaatatatcaatgtagcaaaattccacttataccttatgaatatatgcaaataaaataaagattagctattattaattgggaaaagtgtgaaattttggtcttcaaagttctaagtaaatatttgcctcctgtattaaatgctttctttgatactaaaatgcctgggactcatgtattgatttacctcaaatttctcagtttattactcataaccatagaacagttgtctgtcatacttgaagtattttgacagaaaacttcccatgtgtaagagttaatgtgttgacttacacaacaggaagtgttacaacattaaaaaatagcaagtttctattacttgtatgttgtgacatgacaagttactttcagaatgaggtgaagtataatgtataaaaaatctatatagtaaaaatgcaaattccctcattctgaatgcaatttaaataattattgtggttaaaaatctgtagttgttaaccaaaggttaatctattaggttagtattgaagacggattttttattttttatttttcatttttatttttagtgctggggtacatgtgcaggatgtgcaggtttgttacataggttaacgtgtgccataatggtttgctgcacctatgaacccatcacctcaggtattaagctcagcatctattagctatttctcctaatactctatccttccccgacctcaccccgacacaacaggcccaagtgtgggttgttcctctccctgtgtccatgtgatctcattgttcatctcccacttataagtgagaacatgtggtgtttggttttctattcctgcattagtttgttgaggataatggcttccagcttcatccatgtccctgcaaaggacatgatctcattcttttttatggttgcatagtattccatggtatatatgtaccacattttctttatccattctatcattgatgggcatttgggttgattccttgtccttgctattgtgaatagtgctgcagtgaacatatgcatgcatgtatctttgtaatagaatgatttatattcctttgggtatgtatccaataatggaattgctgggtcagatagtatttctggtgctaggtccttgaggaattgccacattatcttccaaaatggttgaactaatttacactcccactaacagtgtaaaagcattcctatttctccaccacctcaccagcatctgttgtttcttggctttttaataatggccattctgactggtgtgagatggtgtctcattgtggtttttatttgtatttctctaatgatcagtgatgttgagcttttttcatatgtttcgtggttgcatgaatgtcacttgagatgtgtctgtgtccgttgcccactttttaatggttttttttttttttttttgtaaatttgtttgagttccttgtagattctggatattaggcctttgttgcataaatagatttcaaagattttctcctactctgttagttgtctgttcactctgatgatagtttctttggctgtgcagaagctctttagtttaattagattttttaaattcttagtaattgatcagtcatataattgtaccttggtttagtatactgctgaaacaccaaaggtatgattctctcttcaagagactaacattttaattgaggagataaaattaaaactcatgcaatatgtgagctcttgaaatcaacaatgactgatgtttatatttataactcttatatcttcagtagtttctttaacaaaacctcagtattgttgaatgaatggattattgaatgaattgatttacatgatgtaggaaaactgtggtaatgtctaaaatttaacatgtagttagagaatgaaggagctaatatgatctcaagttgttagaaaaagtattaaaggcagtcagattagatctgaatgctaatgactagtctgatgtgttctagattagggggaactgcataagcaaaagtgctgtcatgagctagatgtgcttgtaaagcctgccctaatctgcctcttttctttttctagagaaagataatctttttcatagtccttgttggtgtacacatattaacagccccctaaagttgtctgtaccctaatcctcagaacctgtgaatgccaccttacatacaaaaggtaatttgaagatctgattaaggatatggacgttgagatgggtaaattatcctggactacacaggtgggctcagatgaatcacatgagtccttaatgtagataatctttccagttgtggccagaaagagatactatgacagagggaagaacaattccaactgtgagagatacccaacctgccgttactggctttctagatgcaggaaagggccctgaggcaaggaatggtgggtggcatctaaaagctgggacaggccctcagctgacagccaggaaggagacagggacctcagtgctacacccagatggaagtgaatcctaccagtaacctgatgattaaggaaagtggtgcttctctagagccacccgaaaggaacacagccatgtgaaactgattttagcctgatgaaaccaatgtcagactgtgatatacagaactgtaaaataaaaaacttggattgtttaaaacactaaatttgtggttaatttgcaatagcagcatataccccatcacagtgatggttcaggcagctgataactctgtgattggtttgatagtaccatcctttacctaatcgttcctgaatctgtcactcaccaccttctatacacaaacctataattttttatcaagatgagatattgcaatatttgagtagttccaattctcatattcatccctttctttcctttcctgtacccacagtcctaatcctgggctcatcacatcttgacttgctaagtacatgagcctccttttaaataaattttttaaaactccttttgaacttgttgcttcccaagtcaagaactttaaatgattccttgacgttaatagcctcctctgtggtatagctttcaaggtactctgcagcctggtttcaacttacatttattatgtctcatatctcagtatatttctacagaaatcatcttacctagccaacttggctccttcagaattccccaaatatacctcttggttttttgccagtgtgatttttttttttgcctgtctcattcctctcaccttcaatgtatttacttcctggcatactttgcgaattcaaaccctagttctcttttgtttagtgtctttcaaattagcaaaagttttgcccctggaatagattatgctcctattatcttaataacaatgaaaaggaaacttcagagctccaagagaatgagaccaatgaaatcatgtttcctttcttccctatgaaatgtaatgtcagatagtatttcgatttttccaaaatcattttcctgtttagtcctgaaggcaggaatctgcaaatatcaaactatcctagacttcacagctgggtcagacagatcaggctagccctctggcaaggggtgttttgaccctttgtttttcattacttttcctagacagagattgagagttcctggtgaaatcaaattacaacctcagtaggtaaatgccagtcctttaaattgatgtgagaatcacgcctgtaatcccagcactttgggaggccgaggcgggcggatcacgaggtcaggagatcgagaccatccgggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaattgatgtgagaaacaaagggatacctatctccctgatgagtattcagggacttatactgagagagcgtataaacatgaggacttaagcagcggatgtgctcattattcactcccagagcagatctgcaggaatcttaacaggaaagggcagagtgatcttgcttggcagtcttgctaaaggaaaatgaccaaaatctattcttttcctctttcaaataagaaagaaaaattatttcatagtgatctatgagttttaggatgcctttattttcctgagaatccctcaaaatatccacttcaaatattaaacattttgatcccgattgtaaactccagaagcctctaacacctgaagcatgcattgatgaacttaaccgtgaattggctgatgagactcatgatctttcattcttatttaaattatatattgtgttttaattattacctccttttgttacatttccttaagcaaattataagttctttgatggtaggaccttatccttattttttgctgtattcataacggtgcacacagaactatcactcaaataatgtttactaaatatttacctcaagtcaagcacgcttctgcctatgttacgccatgtcttgcctatgttaagttctttttctcctgcctggaataccatttaaaactatctgctaccaagaaagccacaccctttcagcagacccagagaactacagccaaaaaaacaaactgtttattagttgaatattttacagacgtctctgcgctggatccaataccttataaaatccttgattggtctaaaatagtttaaagtttgggcacaagaattgagaggtgtttttttgttgttgttgtttttaaagcagagtttatataaatcctatcactgcaattgaaatcaaagcagagagaattccaagaactttgactatgctagattcagtatcaggcagtctaggctaccctatcatttgttttattttactgaatgcttgctaaaatgactatcagtgttaaaacattaaacttgctccacttgttcaggtcattaaagaataggtaataaacaatatggttgatatgaagaatagaggaaaactactttgaatatccctgagaataaaataaacaatttgtgatggctgggagctgtacagctaatcctatatgacatgaagctatcagaaataggttacatcttttttagcaaatggcttcacaaggttgagactcaacgagacagtcagacacagtgagaggttcttgaaacagtttcagtcataaaccagtgacaacattccgtatatttataggggccatttagagggccattagctgacttctgcccttttcagtcatacctgcatacttgaaatcacctccatgagagacttcacttttaaaactcattggcaatttaatatgtaatatgtaggttcaattctagtgttttcaggaaatagagtaagctcagtctaaagtcaaatcaagtcaaatcacataataaatagtaatattaataagaaagagtaataattgcattattgtgtagtttattgtattacttggaatttctgtttcaccaaaacacagaaatacctcttttacaaattagttaagatacgcggaactacattatagtatagctaccattttcaatattaattggaggtacaaatggagacagaggtcattttagggttactcctttctactgagagtgattgttttatctagtccattcaagcaatttctataacaaagtattaatagctgccatgtgctgtagccttctgaagtaagtgagaaaactgcatgggtcttttggtatcccgtatttaataaatgttcattctttggaatataagttcccataaggcaagggaagcatatcatatatgagaaagaattttaaaagcttgaatgttatgcgataatctactagcatatacagtcaaattaagggtatttttaaaagtcactataacatgcccactactaaatatgatagatctagaagataaaagagtactgagtagtaagtactgagcataaatggtgaaatcacattgcatttacagatgtaataaacttctagtgttgcttcttttcaggtaatgagcttgtaattcattatttttctaaatattttaggtctttcaagagcaatacctcttattttacactattgaaattatataattaatatgggaaagaatgactccactgcataatgatactagaattatagtggtgaatatagattaaattaccaactaattaatttgaaatttatggactggtggccactagtgccatggcacactgaatgctttagtaagcaattgcattattcaacagaagtcttagtgggagtgattgacaaatgtgggatgcaggtctcctattatgaatacagattatgaatcagaggtagaatttttatcttgtgaatgattatatcttgtgaaatatattatttgttgtctgatttaaacctactttgttttggctctctgttctttcagtttcaattccattatctattttaagttctttaggaattataaaccacatgctgtcaatgacaggaaaacactgcccattaagtttaatgaatcattcagactgattttcaatggctgagaaatatcaaagtggcttcagtaatgtatgtaatgtgtagaaaatctaagtataattcttaagaaagatcatcaactctgagtgtttgtgatataatactgtatgtatggttaatattttttctgtttttataaatatttcctaggagaaataggttctaatattgtggatcataggaaaaaaatccaaatatattattagaaaatgtatttaaaactaatactatagaagtttagttgaaactcattatttgattattaatattttaaaattatagtagaaatgtttatctttaacatttccaaaattttaaagagtaaattagggtaaagaactagtttctgattgtataattttactgttggaatgcctcaattatagtagacatctccttattgttcataataacactgctgtggacaaaagccacaagcagaatgttggcatcatgtgagcagtactgcatgaaggtaggattgagtgctcaccagcaacggattaagtcattacagcccagttcttaacaaatccaaagaacaaattgtcttttacacctgcacataccaggaccacctctaagatgtgcattgtgatcaatgacaggaaagtaaaaacaagtcactctgtgggaaggaagaaggagcacaaataatggtcaagggacgtggtgatggtggaacgcattataagatacaagcttcaaaggtgctccttgaaaggtttttgataacacacacaagacaaaggcaaatatagattagaacagagtttaagatgcatttgtaaacaaagatcttcaaagtaattattcaggaaaaagggggagaatactgacagaagagctgtaaggagattcttatgtccaaaggagtgcaacatgaggaaacttctggcttgaggtttcgattaaccagtgacatgaaattcgtgtgtgtgtgtgtgtgtgtgtgtgtgtgtatgtatgtataattttcacatatctttctataaaacattattacacagtgtactgtcctaaggatgacactgtgacactataatatttatactgcatgttttattccacactttttattcctactttctaatattaaaaatgaggaagtgaaataaatttcttacacatttcttaaaattttgccaataggtaagtaaatgttaaaaatttaaaattaattttgttctgagtctaacaagttatagtgaatagatgaacttagtggtagattaagggatctcatgggatattccagtgtcagcataaatcattagaagtcagaggagtcaaatggaatcccatgtgcaataacatctaaaagacatgaattcaggaactaaaattatgaaattcttaaaacgtagagaatatttgtaatctgcaaattatggatttttttaaggacaagaaggtgtaaaaatggcaaatagaactttatcaaattaaaaatatttgctctttacaagataccaccaagaaaataaaaacaagctagagtgaaatgaaacattttcaaaatgtgtatctgataacagacatttaaaaaaaaaacaggtgaagaggaattgccactaaaatacaaaaagacaacacaatttaaaaatgggaaaaatatttgaatagacctaacaaaaatatacaaatggcaaacaagcacataaagtatactcaacatcattaggcattaggaaatacacatattaaattcacaatgagttacaactacaaacccatgaaaattgctaaaattgaataccaagtataggtgagtatgtggggaaactaggaccctcatgcagtattggggatagtttgcatctagtagccactttagaaaatagttgtgtgtgtgtgtgtgtgtgtgtgttttaacattctatccagcagttacatttctagtatctaggtaagataaatgaaaacacatgtgcacacaagcatcttataggtaaattgaataaacctaaatgaccatcatcttgtgaatgggtgaataaatatggtgtatccatatgatggactactacccagcagtaaatggaatgaatcactgacacatgcgacaacatgaatgatctcaaaagtattatgccaaacagaaggtgctagacacaaaagactacatagtacactattccacttacatggaagttttagaaaaggcaaagctatagggacagaaagcagatctgtgctgggaggaggagtggggaaaggctgcaaatgggcataatgcaatttggggagttatgaaataattttaaaattgcattgtgataattattgcacaactatataatggtactaaaattgaattgtgtgcttaaaatagatgaattttctggtagtaaattaccttagtagagctttaaacaattattaggctaccaccataatgagattctaagattattttctgtttttagtaggaaaagtgtgtacatgtttttttggttctttgttttgttttatttttgtttttttggagatggagtttcactattgttgcccaggctgtagtgcaatggcttgatctcagctcactgcaacctccacctcccaggttcaagcgattctcctgcctcagcctcctgagtagctgggaaaacaggcgcccaccactatgcccagctaattttttgtatttttagtagagatggggtttcatcatgttggccaggctggtctcgaactcctgacctcaggtgatccacccacctgagtctcccaaagtgctgggattacaggcgtaagccaccgcacctggccaagtgtgtacatgtttaattgaaagagagacattgaaaggaaaagcatccatctggagagaaaactagcaggctgctgctacctgcaagatttcagaaagtggcattttttaacttggtaaacttactgtgatggaatatctggctgagaaacttgactttgtcagcaggatgacaaatatcattgtcacatgggccaggatactagcatacatgtaataattttagtactgataacagaactatatagcaagtaaaatggcaatttcatttatcagtcataatgaaataccttggtatattttaggtaatagcaatggcaaagtcaagaatgtcagcctgtatgaatggctcataaaatacataaaaattagcactttgcttgataagttcagactcacaactagggcagttaattagaaaaagttgacattttctggaaccaggatacaataggatggtttcttcattccacagcaaggatagtgtttttccatgtctaaccatccccctcagagaaattatataaacatagacatagatacatgtatagagatgtagagatgtagacatagtgatatacatttgctagattgattccttttattctagcaattattcagcctacttagatggatttgcatttgtcagcactgaaaatttatgttgatcataacgttttatagtcagaggacaagtttactgctttttctattagttatctattactacacaatcaaagctcagcacttgaaaacaccaaccacttattgtcttacagtttctatagatcagacatccagagtctaagtgcttctaactcagggcctcttacaaggctgcaattaaatcatctcagggctctagtgggagagcatcaactgccaagctcacccatgtgtggctgttggcaggcctcaggtcctctctggctttgggccaggtactcgccacatgggcctctccgtagggaagctcactacatggcagctggtttccctcagagcaagtaaccagagaacaagtgaaggcacttagatggaagccacagtctttttgtaagttaaactcagaagtaaactgttacccctgccacatacttttcaacagagaagggtcattaaatccccattcagggatataggattacacaaggacatgatacaaggaggtggagtcatcataccatctcagccatcttcaaggatgcgtacatgtctgtctttatatgttttgggagaggcttcattttagctcttagtattacttgacatgtcatccctggtgaaaatacgtagttcctacaaagaaagtctgaattaaatatagatgtaagactccattgttaacaattgaagggcaagagcctttttattaaaaatcaggcaatataatgataaaggcaggaggaaatatattttgtctcaaggggaggaatgagaagtacagggttgcttgaatagcattaagaatcatgctcccgtgtaaattgttactgtctgttttctcacttagcatcaatctagatggagacagaagaaaactagaaaccatataaaacatgtattttatgcctcgcttgtccactgcgttcttcttttcttttttctcattttaaaactcatacccacttttaaattaaattggcaaaaaacacatttttttcattaaccttttgtgatgcccccaaactctggggtcatgattatatgcctagaataacattttacttgaatgtaaaagtgaaatgtgaactttaaaaaaccatagtacttaaatgtggtagcgctggtggtggtgatgcatatgtgtgcctcagtttaggaagctattgataaatgttacaagtctagcaaaatgcctttactttcatcccttaatatgtttctaatgtatttgatttactattatctttgttcttcttttccatttaatgacttttattaaacacaataatcaagagataaaatacactaatattcgctctggttaacttcaggaagctgagctgtgtattctgagtatagagtactcagcataatcagtacacagtgccctgaaactaagttattcattcttaggtaatgtacctaagaagaaagaataatgctttcatctttaaagtaaaagtagaagcacaaatttttgcgcctgagtcttttttgggcaataaagcaaatcaaaaacatttaaataaataccagaggtgacattaataaaactgttgctgacaccataagagactgctcctttggtgttggcatttttgtgtaattcaggaattgtatctctataagtcatgaaaatctaattcaaataagcacaggcaaaattgttgttttattgaaagtctcctatattacgaagagaagattaaaaactaaagctgtataaatgtctagaactctgccaaaactctgtcatctcttcttatggtagtttttttgccatatggcatctgaaagagacagtcttcaaagatctgtaacttagagctctaccatcagagtgaaaaaatcccagagttatattctgatttgtcaggtttgggtcacatttctactctggaaacaatcagctgaggccagagagtcaagatactgtgactgaccatatttgcatctggtgttcctcttgtaccaatcaactacagccagcatgtagtgcaatacacaaacatcaaagttacaaatcatcttcttttggtctctaagcttaatatattttccttattttttagactttttgatagagaattctattacaagtataacaaacacagactcagttctctgtgcttgcattagagccattgtcatctctaaacctctaatgtttttgaaatcttagcttgctattttttgagtattttgtgcatgtatattaaatgtaatctaacttgttggtatatttcataactgcactgagaagtaggaattatacatgaatttgctgccaatattaaattcggaattcatattacaagcaacttacatttgtaaaatcagtactaacttttttgttactgcatttttaaattgacagataaaattatgtattatgtacagcatgatgttttgaaatatatatatatatatatattatgaaatggctaaatctagctaatgcacatagttaccactttcatggtgagaacccaacatccactgatcatttttcaagacagtatattgttattatctatagtcataattttctgcaatagatccattgaatttattctttctatcaaatcgaaattcaatattctttgaccatcatcttctcaatatgccagcctgcccaacgcctggtaaccaacatgctactttctactcggtgagatcaactctattagactcagttgaatatttatttcttttacaaggatagcctttggaaagatgaaatagccaatctagtcagtatttaaaattttcttagcaagatctttacaaatgtcatgcttgaaatgagttaaccagaagtcagtagccttgagacattttttgtttttatattctataatgcaaaaattaaatttactttggcaaactaatttttaaaaaaaatatatcattcatctaaccagtctgcactcggtggcatataaaacatcacattgcttttttattatgcttttattcttaaaacataacatgttaactgtacttttgccatctatacatattattgatgtatgtattataacctctgaagtcaaactccattggtaatacattgttttattttttgtttgtttcttaataatctatggtgttttgaaaagaagagctttggagactgactgaatctgagctctgacacttattagctaatacgaatgtggtcatgattctactgtttttgaatcctaaattatcaaatactgaaatgtgttattgggaaggaaaagtgctctagcatctgtaaggcacctttatggacacctttatggaacctaatgtggctcagcaaatgggatttccctcccctgtctttactgaacctcacttccagtaatctttattattttgcattttacaaaacattttcttctaattcctgctttttgaaccatataacatcttcctgcggtaagaaagaaagctgttatctccattttgcaattaatcaaactgagaagcaaagttgaaaataggagacataaagtatacttctggaaagtttattgagaggcatcagaactaggcctgctatagtcatcctattgactcagtccttgtgtccttataagcagataacagtgagatgaaaaggaatttaagaagaatccctgagaacaaggaggagatgagtgctaaatgaggtttgatatttgacatttaagttggactaaatttggaattgctctagtcattcttcagggacaggaaagagttgtattgtgactgaagaataaaacaaaactaatatttgttaatctagaaaagtttagacttttcaatgaaacatttacaatgactaggttacaattttatgtgaaaacatattgtcatcattctgtcttcatgtcagggataatcaaaaaataaacagataattttttccctaagaaaagcaatgctgatgtaaggtgaagaaagcacgcagctgccattgcacaaggtttgatgctcatctctgtatatttttatatctctactgtgtctttgccttatacctttaatattaatgtagcatttactgtattagtctgttctcatgctgataataatgacatacctgaaactgggtaatttatgaaagaaagaggtttaatggtcttacagttccacatggcttgggaggcctcacagtcatggtggtaggcaaaggagaagcaaaggcacattgtggcaggcaacaggccttgtgcaggggagctcccatttataaaaccatcagatcttgtgagacttattcactaccatgagaacagtatgggggaaactgcccccatgattgaattatctccacctggtgcttcacacatggggcttattataattaaaggtgagatttgggtggggacacagccaaaccatatcattctgcccccagcccctcccaaatcttatatcctcacatttcaaaaccaatcatgccttcccaacagtcccccaaagtcttaactcatttcagcattaactcaaaagtccacagtccaaagtcacatctgagacaaggcaagtcccttctgcctatgagcctgtaaaattaaaaacaagttagttacttcctagattcagtgggggtacaggcattggataaatacacctattttaaatgggagaaattggccacaacacagggattacaggcctcatgccaagtcagaaatccagcagggcaatcaaatcttaaagatccaaaatgatctcctttgactgcatgtctcacatctagggcatgctgatgcaagaggtgcattcccacagcattgggcagctccacccctgtggccttgcaggatacagcctcgctcctggctgctttcatgggctggcattgagtgtctgtggcttttccaggtgcacagtgcaagctgccagtggatttacaattctggggtctggaggatggtggccatcttctcacagctccactaggcagtgccccagagggcaccctgttggagggctccaaccccacattccctttcacacggccctagcagaggttctccatgaagaccctgcccctgcagcaaacttctgcctagacatacaggagtttccatacatcctctgaaatctaggcagaggttcccaaacatcaattattgacttctgtgcacctgcaggctcaacaccatgtgtaaaccagggcttggggcttgcaccctctgagcaatggcctgagctgtacatcggccccttttagccacagctagagctgaagagtctggggtacagggtgccatgtcccaaagctgcatcaagtggggtccctgggcctggcccaataaaccatttttcctcctaggcctccaggcctgtgatgggaggagctgccatgaaggtctgtggagacatttcccccattatcttggtgcttaacatttggttcctcgttaattatgcaaatttctgcagctggcttgaatttctccctagaaaatgggtttttcctttctattgcattgtcaggtgcccagtttccaaaattccatgccttgctttctcttgaaggctttgccatgtagaaatttcttctaccagataccctaaatcgtctctctcaagttcaaagttccacaaacctctagggcaggggcaaaatgctgccagtccctttgcatagcaagagtggcttttacttgtcagtgtcagttcctaacaaattgttcatctccacctgagaccacctcaacctggacttcattgtccatatcactatcagcattttggtcaaagccattcaacaagtctctaggaagttacaaactttcccacatcttcctgtcctcttctgagccctccaagtggtttcaacctctgcctgttacccagttccaaagttatttccatgttttcaggtatctttatagtagcacctcactcctggtaccaatttactgtattagtctgtcctcaggctgttaataaagacacagacaagactgggtaatttataaaggaaagaggtttaatggactcacagtcccacatggctggggatggtggaaggcaaaggagaagcaaaagcatggcttacatggcagcaggcaagagagcatgtgcaggggaactccatttataaaaccgtcagatgtcatgagaacttactaccacaagaacagtatgggggaaactgtccccatgactcaattaacatcacctggcaacacccttgacatgtagggattattacaattcaaggtgagatttgggtggggacacagccgaaccatatcacttactatgtttgggatgttcctccaagttctgtggtttctgcagccaacaagataggtaagtttgatgtccatattaaagagtttttattcaaaattggacagatatatttatgagattcagaaagcaggaaatttcaggtagaggtaagtgttatgaaagaaaataaaaatgaagtgtattaatcttctattgctattactggctcaaagtttctaatagaaagtttctagtaaaagttctaatattagaacaaattcattatcttacatttctggagtccagaagtctaaagtcaaggtgttagtagagctatgttatttgtggaggctttggaggagcatccactttcttgctttttttcagattctagaggccctcccctcaattttttggtttatagctttttcctagtatcactacaacctcttatttctgtcaccatatctttttaccactgatttttaccttcttgcctccctcttacagggactcttgtgcttatacttgtggcccactcagctaatccaggataatttcctacctcattctcataagaatcctaaatctcatttgcagtgtatatttcactaaacaagataacatatttacaggttcttggggtgaggatgtggatatcttagttgggcagagtttttcagcctactgagtgaatatagataacagaataatcttgagtggacagggcattgtcagattggatgttcatggttggtttatttgaagtagtaacagttcagctgaggtagaaatgctgaaagaactgctataatggctttctctgaaaagaattatcagtacctatgagatgatacagtctactgattccatgtgactataccattaaaatcatgtctcaattatgaatatacagtggtatatttcaatttgcccttgaaagcttttgacagcaaaatacttacattaaatttcagcaacttgtgatatctttaaagtatctagatgagaactctagaagtttctcataggttagaaaacaatataccaaaatttctacatggaaaaatattaatttacagatatttttaaaatttcattgaaagggaagatataatatatccacctactttcctaaaacgactaaataaacagtatgttaccaatttttattttatttacaaagtttaaacaaaattagtttatatttctaatttagggagttgaaaaatttcagacagaggtattattagaaacttagtaatatatttttatttctggatttaacaccacacacagagtacatcaccataccataataaaggtcaacaaaaaactcaaagaccctgactttatctttgcagcaattattttgccttaagtacatcatagcttagctttgaattcatagtacccaacaaagtacatatatgtctctacatatacatatataacacatatataaatatatataatatacatatatatgtatacatattttaactggaagatggttaaactcttcccacccattaatgattagtccgtgtgaaaatacatttttgggtaggagataatattttttattattccatgaagtaaaaatatgaagagtattcaaactgactctcttgcttatttattttccacatttaaaactctgtgatgttgtgagcctgtgttttcacacttcagtttgcatagggaggaggtgcattatcaccaggatagatgcttgtgtgaatgagcagtccaagctgatagctatgcagcactttcattagcactggaaagtggtgttagcatgactatacagaggtttttctttggcttgactcctagcttgctttttgattttgattctggattgaagactcaatttgtggtgggacatctaagtggagcaatttcctaaaatcacttgggatactggaatatctctggatgcctaaatatctctgggtaattttagatacatgaacaaacatgaggttatttttaatgttgattttattatatcagttttgctaagtatcatcacttggaaggaaaattgagatggagtattttatatctcctcacttatcaacactaagatgctttgttcgaattttttttctcaaaatggataaaagatgtaaggttttacaacatatgaatgaaagaatttaatgctggaagctaaatataactacacagagtgtcctctcttgagcatatggcactgttcattcacctgactcttgccctaccctcctttccagaattatcttcttctaattccagtatgtgaattattaaacatgtttgggaaaactcagcagaagctagtcttccccagatatccatccccaaacttttctttttccttctttaatctactcacctgaaagtaataagaaaaattgtatgtgtatgtgtgtgtgcacgcatgtatatatgtaatctccaagtgtatgtgtgtgtgcacccatgtatatatgtaatctctaagtgtatgtgtgtgtgtgtatatatatatttacacacacatacacatatatacacatgcacacatactctttcccttcacggccaatgactccccatttcattttgaacttatgcctgaattctaccatgatctaatccctgcctgcttttcacacttcatgttgatgctactcttctatttgtactctatgatttagccattaatgtgccctttcagttatctgagcatgtgaagtttgctgctgcctaaagaaatagtacatgatagtctctgtggaaatctcttgcccctcctctgtatttgcctgtcctgttgtccatgagtctttgccttaagatgtacaagctcaaagagacttttctgtcctgggaattttctctaagtgacttccttcttttattctctatcactataggtattatctgacatatatttacatgtagcgttgaaaaattataattttgtgtatgtatttgtttagttaattatagtccctctttctcactagattgtaagttccaccaggtcaggggtccttattacttttgttctccagtatttatccagtgcttagtggtatggctggcacatagtaattgctaaaggatatttggatgaatttttgagtaaataaaacaatatttctatttttatttctctctgttctatattgtcattcctttcaaagtgtgaaccttctgaactactgggagtaaaaaggcaggaggaggtagggatgaggggtggttcataattttaaggctctttctttagctgcacaaagacccagccaaaattttgcaaggtcctgtttattcatttgttctgcccttttgttgaggttttgggattattcagaggagaatgctatgttgataattgaggagcagatatctaagcaagaattaaaacgtgtgtacatatatatgtgtgtatatatatgtatctatatatgtgtatgcgtgtgtgtgtgtgtgtgtgtgtgtgtgtgtgtatacatatatataatttagatctataaaatcagttgagtatatatgtataggtcacccagtctttttgggctagaccaaaccaaatgttggaacttgacaaaatagaagagcgcgttcaactaagtggattgtctgtatctttcctggttggaatacaagtaggacactgctcctccctgttttaatggcattatgataagataatccacatggaaatatagtaaacaataattagaataattataataattagaaatgtagtcattccagctagctcctttttaagaaaagaacaaagtataatgaaggaatttgaaaagcatttgtaccataaagaataacataatgatatgtgaaacttaagtgatgtataagagttgttatgtataaatgttgagttatgtataatgttgagttatgtataaaagaattatgtgtaaaagagttaacctgagtttgctattgcataggcttcctgggcattgctgacctgttgtctttcttttgctttagtcaagtcattgtgggcaaaaatcatatgtttgcacatccatggagtctttctgctctgtttctcagcatcactacctagaaagagccatcaaaggaaaaaaggcaaaagctctctttcacattaaaagatagtcccatgaggagaaaatgatttcccttgttccctctttcttcctgtgatgctggttttaggctataatcctggagaggtagcatccatctggggaccgtcatgtaattaacatggggaagaaatcccaacatgatgctgtaattaagtaaaagagactaggtccttatttagtcactgaaggaatcccagaaccaaacaccattttagtgatcaaaaacattcctatggttctggccacatttagttgggttttctattatttgcacccaaaataatcttttacagattttttgcctttaatatcacccaatagattggcttacccaagagaaattgcaggaggggcagtcagggtgggaaggtagcatatctaagggattcagaattttctgggaggtggagacttggaatatatttatcacataattctcacagtcagtgaaatggctgattcccagaagtgaatacatatcctagtggaattataaaaggtattggttatatgtattaaatggaaccttacattagaccagtaaaaaaaaatgaaagctattgtagaacagtaaattaaggaaataaattaaaataggatactgactataatacaaactataattttgttgtaaagactaaagaaaagatagagcaacaaatcaaataggcggacatagttgaaatagttgacaaagtagtctttagagaattattcctgtattatgataaactctggacaaagaaaatattgcgatgagatgcggtctcattcaatgacagacatactgcatttccttaccccagattacaaggtgtgaaaatatttagtaacactgttttctttcaattttccattatatagaaggttagttattttcagaaagtcaagcagtaatgcagaaaattgctcggtttgaaagactgttttttagcttcaaaagtcatctgtagttcagcattagagaaatgtatgatgttaggctatataaaattcatttttattctcataatagtgacattggtgttttgttaaacaaactagcacacttctagctaagtaatgaaatctttagattctgaaataagtcacttagaaacacataaggaccagttatgtagctttcaattttttcttgtttacaaatgttttcaccacttcataacagggttgttcaaggaaagagcagttttcactggaaaggattcatagaccattggcagtgctttaaccttatcacagtcaggctgggcatctcctagagatttttggattaaaggaactcatgaagtcattaattggaaagagacacaggttaaaattcatttggcagtgatacttcatatactcagtaatagcagaagatggttagggccaagctctttctaactagtattttttccattatcttaaaatatgtactttgaattatattaattacagtgaaggatataataactaggaaacctaaaattagtgtcatttctaatgctgaaagcatattaaacatgaggtctgcttggatgtctatttaaactacaatattcaagtgaatttctttctgtggaaaaaatgtgaaatgaaaaggaggggtgagttgaagagaggacaagaagggagaaatgagaggagagaattatgattgtatatgatgttggaaggccaaggcctaataagttcatttttttcattcaagcacattaatgcagtcctcatgagattatggatgctgcgctaatgccaaacacggctccgtgtcatcactcttataagctagtagctctaacaaaacctgtaatacttaaaataactataaagatgcatttcagtgctacaatcccaaaatattcttactagagttcaaagatctaaaaagtcatttaagtatatattctagagtatagaaaatatattttgacatttgagagttatcactcaagtaaaaataagtaatatatagagggctaattattagtgataattgttagtaagatatgcacatcttccaattttttaagatactaagcctaaggacaaacatattaatgggagaagaataattttaaaattatatagtgtgatggatggttataaatgctatggaacatggaagggggatcaggagtacagggatggtggagcgggggcattatcgttctaaataaggttgtgacttagccaataacatttgataaaggtttggaggaggtgagagaagagttatagggatatcttgggaagaagatacttcgctcaaggaatagcaagtgtaaaggttctggggtaaaagcatgcctaacatgttggaggaatagaaaggaggttggtgtaactaatgaggagtaagcaagggagaacagccaaaggaagtgaggtcagactgaacaatacagaaaattgtagtcagtagtgaggactttgccttttactaagtgagagtggaagtcattggaggattttgagtagaggaataacatgatttgatttatagtttagaaggacctctgggtgttttgttgatggacgccttagggagatcactgaggaggctattatagtaagaaacgtgagaaattttggtggtttagatcacccagatcacagtgacagcagagggtggtgacaaatgatcagattgtagatacacattgacagtttaactggtggggtttgctgatgattgagtttatggtatgagagaaagagtgaagccaaggatgacttgaatgttttttttgagacctcgtgatctgcccgcctcggcctcccaaagtgctgggattacaggcatgagccactgcgcctggccgaatgtttttaatttacacaactgaaagatgcatcagttggtacagctatgtctttttctctggtcatgtttggtttgtgcaagcggaaataagaatatggtgagagttagatgtaaccaagattgatcttttattcatgtgggtacaatgaggcaagagaatgttagggagtggagtatatatgcaaagagctatcatttttgttaccgaactgaacttgggtccatttgtctggtgcagcaaagctaaacattcacatgaggattgcagcaagagaaagtgtgacatttattgcagagcacctcgcaaggagaatctgggagctcgtgcttaaaacccaaattcttggatggcttgtagataaggaggtttaaaggcaggaaggcagaggttataggtaaagtcataaatcaatacatggagactatatattggtatgatctagaaaggtgggacatcttgaagccagagcccacaggtcataagtggattaaaagattttctgatttgtgatttgttaaggaagcaaagctttttctaaaacgttgagattgacagaaaaaaatgttagttctggcctctgggtgtgacttcctcaggcccttcagaagaggccatttagagcaaagaatggcagtcagggttcagtcatcagatcctccttatctgaggtctacatgccaacaaatccatttggtgggggtcccggtttctggaaaacaacttagggatgtaaattaagatgttatctttagctttgatagaggaccaaacttcttgtgactctgactttcttggctactgttttaagctactgttactttcttgcttatcagtactttcttgctcatttacttctcaggaccagtgaggtgcctggaatttcctttggaggaactcaagattttattttattttatttccatgcttgggagtaggggtcagggagtaggcctctaagagggatctccattccatctcattatgataggctaaacaatttaatttggataataaaatggtgagggtgagttgaggatagtagtggatgagatatggaaactaagtgctcaggaaactactgggctaggttattaggaagatcattgaaatcgtcaaaatcacaaaaagttacagttgggctaggttattaggaagatcattgaaatcgtcaaaatcacaaaaagttacagttagtttgggaaagaatgaagtcatgatctgaaatcctcaaggaaggaggggaattgagtggcagttggtagaagaataaaatgaagaagggtcatgggtggcatcttgtttgttacatgagaatcgaaagaggagagtgtagggagaatagaaggaaatggtctggaagtggcaaacagaaacaacccattgtttcgaaggccatgggggaaaaaaaagccccttaatagggctataagaaaaccattatcctctgtggacacatgggagtaagatgatgatagaaatattcaaagagagtgtgtaaaataattttgctgataatttgatgattaattctagaagatccaatcgtttcaggaattggagaatggttagaaatggggtcatttgggggatgtagaaagatataaaatattttcattgaggttgagatataactttggagtctagggcactcttgatggctgaagaacaaacaatcctcatttgtcctggttctgtgattactgagatcaaagcatgttactatcaaatctcagtcatcacagagctgtgcaaagaaagaactataagtattctgaaataaatggaatgagattgatccagctctagtgaataaataaagcccacaggctgagtgtcaggctggaagtcaggccagtgtggaaacagagctgagcatcggaggacttatgcagaggaccaggagtattggttacagaggtggttctcctgtttttttttgttttgtttttgtttttgttttgttttttttctgtgccttagaaatgtctggttgctttcaaaaatcccgacacccaggccacatccgcaggaatcagcattttaaaaaattccctaagttgattccaatgggcagccaatttgagtgccactgtgctacagtatctcttaatcctatcatatgcaaatcattgaaaatatctgtcatgtcatcattgccgattttctcttcttcagttgtatctattcaaactgtgacagggcctcatttttcaatggcttagcttgttatttaagtagttgcagaacatcacattcatcaattacatgaaattctgtgtggaaagtttttaatgtcatgttgtatcttttttctgcatttttagttgcatcttttttctgcatttttagttgcatattattgttctattaaattgtattgcccagtttgaaataataattcactaacagatgttaaccccatgaatgagaagagatgcaagatattttcatcttacagtttctttgcttttctacctaaaaacctgtatgtagagatttgtaaaaggaaagatatattttttctctgtacattttatttgctttacaatatttatactttaagtaattagtataattagatatttaaaaattcttttttgctatcgtaaataatgcattaatgaatacaataatatataccgttttatgctgtagaagtacatattgcactgaacaaagttgaatggcaaagaagattttatttaaagctatcacaataggagagagaaagaccaaaatgtagtctgaacttgactgtgccaaaacaaagggtgggaagacttttaagcgctggggtgagctggagaccagaggccatcagtgtttgctaattagcttcacccaaaggaaaaataaatgttctcttattgttgtgacaggaggtagtttcataattaaagcaaggctccagcagaagttaggcttccagcatcccacaaaattgggaaacagcagcactatctcccttgatgtttacatttgaaagagatggctgccaggtccttgagaaagagattcctgggttgtaaaactggcaagaggcttttaaaaatatttacataagggcataggaaaaatttactattgcaagttttttaaagtaaagaaaaaaatgctgtaagaaaagggaaatcagggcctagtcagaaggaagcaggtacggagtttttccaagctgaggagaaccctaaggtctttttgatcaatgcttatttctcattatataagaggagttgtaaatggctaggtgagtgcaagaatgttttaaaaccagttgatttgtattgggaaattgcgttcagaatattttttttttatttatctcccactagtagagtatgaggatttccattttgctatgtgtgtgccaacatgagattgttaaagaaactctttccagattttatgtttatttggacaaatgtttaaatgaagaatgaaatatctcacttccaattaccagtgaaattaaactttaaaagatatattttttgttcttttgtaattctttttccaggacttgccattttgtaaagttttctacatttttttatactgtttatattatttttaaagacaactgtagtattattctgcttactggttcagaaacaagagaaaatctgtattgtaccaagagctaatgaaacctgggtatttgttttttccctggaaatttcacacttttgtttccactagattccttagttttgaataaaagcaactggggtaggagactgtctggtttgaggatgttttcttattttggcttcaggccaaaggaattgctatatcttagtttaataaaatattagacgctgataccactgttgcatagagacaatcactgcttgttggagaaaggaaagtaaatattttactgtatacatcaaatgataagcaaaactatcatgaaggaaagacaaaacttctttcatgtggcatcccagcctctctcccagcaacaaccacccacctacaacacagcacaccaaggtccatatcttccatgttttaattgttacattaaatattcttggttgtggcactttgatagtcacctcttgttttcatgcgcgtctgtgtgaagagaccaccaaacaggctttgtgtgagcaacatggctgtttatttcacctgggtgcaggcgggctgagtccgaaaatagagtcagcaaagggagataagggtggggccgttttataggatttgggtaggtaaaggaaaattacagtcaaagggggtttgttctctggcgggcaggagtggggggtcacaaggtgctcagtgggggtgctttttgagccaggatgagccaggaaaaggactttcacaaggtaatgtcatcagttaaggcaaggaccgcccatttacacttcttttgtggtggaatgtcatcagttaaggtggggcagggcatattcacttcttttgtgattcttcagttacttcaggccatctgggcgtatacctgcaagtcacaggggatgccatggcttggcttgggctcagaggcctgacacttgtttacatactttggcctttttaagtccccctatctttatatgttcattaaattctgaaagcttcagtgtttctcagtaacaaccataaatcattggagaaaagtagtatattgaaattactgtaatacttttgatatgtataatacttttgatatctttcagatctctaatacttttgatatctttctataatacttttgatatctttcagatctcttttccatatctattacttttatctcttttcaagtaatgaattgattgcgtattctaaaataaacactattctatactgttgaaatactgaaatgaaaccctacaagctcattgtaagggaacaagcttaaaagtatgtaatttcagtgaagtatattggaacataggcttcataaaaggtataaaaagaagtaagggaaaagaggacggtgagactaaagtttactgagtgatttctaactgccaagccctgagagaaatccagtcttatttaaaaaagaagcactattggctgaaagacttgtgagaaacactgttttgtttttagttttgcccacttagaatttgccataggatctggcacataatgcttagtaaaaaggtacagaagttgggaaagctagtgacatttgatctagttttaaaagatgtgtagaataaatgggcatttagaaaatcttaaaaattctttgtacaatatatgttgtcaataattttatggttatcaaaaatatcagttgaattatattttctctaggaaatattaatggtcaaaagtttaacttttaaaacattgcttaaaaacttaagccaacatattaatgactggtgagtaccatgactttattcctgatgagaataattaaagctagttaaatattatgtatattgattataaaaatgtgcttactatagatataattgtcatccagtttcaagagagcttattgtttgaatgggaggtcttgtattttttaaaaaagactgttttgatcttgaattataaccaataaaatggcattacgttcatgcagagcctcaatgaagataattaagaataaatagtggtttctgataaactgttagtgaagagaagatatctcacatttcccattgttcaaatttaagaagctaaataataaaaaataatatattcatatatataatctaaatatacaaagattatatatattatataatacatgcattaggaatatatattagctatatatggaatctatatgtggaacatacatatatatgtactactcagaaaaataatgttacaggttgttttggtataaaaagtcaggcttgctgaaacaagaaaaatagataactgaattttggatataataaaatgtggagaaacaaataagaagaagaaggtgaagcagtgagaaaagtttcaatgcttggagaatagtttgtgaatcttaacctttatcataaaaggtgaggaggtaggtatgtgcaatagatatccatttatattcttagcagtttgcaatctgatttaccccaaacctgcaaattccagttacaagtgcatactattctattctcctcatatttctgtgttgaaatttttgtctcacagattttctttaacctacgttagattattaacagagtacacacagatcacttataaaagggaggggagaaatgccaggggcgtgtgaaccagagcaactccctcttaaataggagtggggtaaaatgaggctgaaacctactgggctgcattcccagatggttaaggtattctaagtcacaggatgagataggaggtcaacacaaaatacaggtcataaagaccttgctggataaaacaagttgcagtaaagaagctggccaaaacccaccaaaaccaaactggcgacgagagtgaccgctggtcatcctcactgctacactctcaccagcgccatgacagtttacaaatgccatagcaatgtcagaaagttactttatatggtctaaaaaggggagacatgaataatcctccccttgtttagcatatcatcaataaataaccataaaaatgggcagccagcaaacctcagaactgctctgtctatggagtagccattcttttattcctttactttcttaataaacttgctttcactttgcactgcgtacttgccctgaattctttctcacatcacatttcttttggtctcaatctccagtgaaataactcctcacacatttcttactttccacatcatgcttccaccttctgaatataggtagtgctaatgaattccttttaaacattacttcagtattacatttgaatatgtaacattcaaattacataatatggtaatggaaaacgtggatggcagaaatgaaaaggaactactactaagtttaactacttttttaagtttaaaactcaaagcagagaataactaaataccaacagactgagcaataggggaaatttttcaaaataggaagaaaaagagagcgagagaaagaacaactccaattgttagtcctattaattaacgttcatatgactacaatggtagaaccatcgatcccttagatgttggttgcctagatgttcccaaatcctctggtcctgagggattattcttctttaataaataagtaaaattcatgttggtttccatcctaatgattatagaaaagccagcatttccctcacatcatctataggaacacttgggatctacatttctacacatcacctcttggcctgatttcacatggtcattgaaattctctcctgtggcctgttttctgtattctgtgttgatataaacacctacatattttttctttgatactccaaacccattgtgataacaaagctcttgaatttagcatagtctttctaaatcattttgagtagcacagcgtagaaaacactaacaaattgaatactagactattcttattagtagaatattattcttaacagtctttctttcattcacactgttggaatccctcacaggctgtcatttgtcatcaaacatccatgtcctcatctcctcaccttttaggataagtgttgggattcacaaacaacactctccaagcacgaaactttccttactacttcttcttcctcttgtttctccacattttcttatgtatgaaattcagttttctatttttcttcttgcagcagtccttttacttgtgataccaaaacaacctgtaacattatttttctgagtaatcatccaccctggagaaaaattatgtgcctctcttagaaggcatattatttgttttgtcttcattctgcatgaagaactgtagggttttccctctccactctatgtaagaaaaatgataattttataatcctttatattctactttttaatttattttggtgcctggttaaaaaaagtacatacttagaaatgtggttggcatgtaagaagggtttaaaagataataaaatcgacaatttaggattgttgtaagtggtgctgaagtagaaaaaaatgaattgtgcttatctaagtacatgataactagatgtggaattagaggatgcaaattgagagatgtagaaaagttatttttttaaaaagaggcatgatttgaggatgatttttatacatggattggattaaattgttcagcaatgcttgcttattggtatcttcagtttcatatgaggataatagtagtatctaaaactcagctgtccctgaaactcttggctgggcagggagtttactaattcctgttaaaagcttgactggaaaattaataattctgaaaaacatgctatcaattcattattctaaaagcttctcctgtatttttcaagtcctgtcaaaagctggctctcatagaaagcaaggaaggtcgccaaaatgagagcaaatagaggccactcaatcagaccttgttataacaaaggtcaccgaccttcacttgtgtgactcacagaagtcacacttgtggcagagactcaaaggtagacagagaagtgggttaactttgtactaaaaaaaaaaagaatctgggaagacctcagttttgctctgattggaggttgttggcatggggaagctgtaggtgggcaacctagaatgggaggcatcttttatgtttggctagggaacataattgactttctctggggttggccctgcattcaaagcagggcaaaaattggggaagctgacagtccttgaccaagtcctaattctcctgcattgattgctgcagaggttgtgcatcagagttctattgtcacgtatgatctctcactccccagatattacctacagaacctgttggttagacaaacctgaaattgtttcttatctgggtaagagagaatgcaatctcacaaagatatgacagtggattggggtggggagagtaaaagtcagtttgttgagaattggaagtttgatttaaggcaagtctttcaaacagagaaaatttgattagagttgggtaaggataaggatacaactaagaccgtttgaagcagcaagataaggattttgtggtgagtgagtcaatgcctgttgatgtttgtcattgaggagatctttaaggaagttcctatagtgaacaatcaaaccattttgcttgggcaggagactcctgcaaaaagagtcatgctattgacaaaataagagcaaactcatgtttatagagacagtgaggaatggttttattttatttaattatttatattttcatttttatagagatggagtcttgctatgttgcccaggctcttcccaaactcctgtgctctagtgatcctcctgtcttggcctcccaaagtgctgaaattataggcatgagccacccacccagcctgaagtgtggtgttccttttcagtatatagaccaactgtgggagtagacagtttttgctctctttttacttggaccatatcttctttcttccccttagataacactgtcctgtattgaagcttgcacaatatatgaaatagtcatgtcaaattcataatcacattttatgtgaggaaatctctcagaattttgcactgcattctatttcctagtattattctctacaaatactgtttattcttcctaaaggtgttctctatgggtctaagaatccttgcattatttggaacttgaacttgtttgcttttgctgactgtggaagggacactaccaggacactttgagctaatggggaaaagctactgagttggggaagcagtgctacttctggtgaatagtataatgtagtagcttggtgcaaaagtaattgtggtttttgctgtttaaaagtaatggcaaaaacacagctatttctgcaccatcctaataggtattgtccctgaggaggattaaggatgggtggcactagaatgtctatgtagtagaagattttttaaagaagtgatatgtctatgagaaacatgcactctatattgctgtatttgtctttcaagtaacttcagggtgtataaccactaaagccataacttggcatctgctactggctgaatgcagatttgctcaaaggtagtaattattcaagatgtggaaattttcctaatgaaagacttagatcagagaattcaagactaaaaggttcccaagaaaccagaaaattatcttagtgagcagtactttcagatcacatacatatatcccaggacacatctttcctaggtctgtgacatcttaccctgttcaccatgttcatctttcctttcctttgaaaatgccccaggctccttatgttaattattccatccagtttgcagagctctgcatgcaaagatgtgacatgccgagtcacaagaaaggcctgttttacctattccctagagcaggagacatctttctctctcttgcatttttttttttttttttttttttttttgactgagaggtgtatctctcaaggaacatgtaggaaaagttaaatctgctccaaggttacttggttttgcacaaatctagagtaattacttgtttcttttgcttaaaaatgatcaatcaataaatggagtaggaagcatctggtggggacatgcatacactacttcacaagtaaatgaatatgtaatgctgatcagctgaatattatactttgatttgttgcctaaagagtcttagaaatattggcatttttttaatgaggtaaatgtacgtatgagagagagctgaataagcaccttaaattctatatgtgacagatgagttggtcctggaagaaactgaaagactttgaagaataacgtgttgtatgattagaattaagacagtacaggcatttcttcatttacaaaaaaaaaaaatttagggtcagggtttcatgtgcaggttatataggtaaactgcatgccacaggagtatggtttacagactgattatttcatcacccagatgatgagcatagtacctgataggtagtttttccttcctctccctcctcccactgtctaccctcaagtaggccctggtgtctgttgtcccttctttgtatccatatgtactcaatatttggttcccacttataagtgagaatatgtggtatttagttttctgttcctgtgttagttcacttaagataatggcctccacctccatccatgttgctgcaaaagacatgatctcattcatttttatggctgcatagtattctatggtgtatatgtaccacattttctttattcagtctactcttgatgggcattaaggttgattctattactttgctttcatgagtggtgctgtaatgaacatgcacatgcatctgtctgtgtggtagcataatttatatttttggaggtatatacccaataatgggattgataggtcgaatggtagtttaagttctttgagaaatctcaaaactgctttctacagtggttgaattaatttacattctaatcaacagtggataagcatttctttttctctgcagccttgccagcatcttttgtcccctgactttttaataatggccattctgactggtgtgaaatatctcattgtggttttgatttgcatttctctaatgattagtgttattgagcattttttcatatcttgttgtttgcgtgtatgtcttcttttaagaagtgactgtttatgcactctgcccacttttctaatggtgttgtttgtttaactgtttaagttccttatagactcttgatagccctttgtcagatgcctagtttgcaaatattttctcccattctgcaggttgtcagcttattctgttgatactttcttatgctctgcaggtgctctttagttttattaggtcctatttgttgatttttatttttgttgcaattgcttttggcatcttcatcatgaaatctttgccagagcctatgttcagagtggtatttcctagttttcttctggggtttgtatagttttaggttttacatctaagcctttaatccatcttgagttgatttttgtggatggtgaaaggaaaggatacaatttcaatctcttacacaaggctagccagttatcccagcaccatttattgaacatagagtcctttcctcattgcttgtttttgctgactttgttgatgatcagatggttttaggtgtgtgaccttatttctgcactttctattcggttccattgtctattgtgtttgtatttgtgccattgtctattgtgtttgtatttgtgccatgctgttttggttactgtagccttggagtatagtttgaagttgggtaatgtgatgcctccagctttgttctttttgcttaggattactttggctatttgggctcttttttggtctcacatgcattttagaatagtcttttctaattcagtgaaaaatgtcattggtgggtttgttaggaatagcattgaatctgtaagttgctttgggcagtatgtccattttagcagtattgattctttctgttcataagcatgaaatatttttccatttgtttgtatcatctttgatttatttcagcacagttttgtagttctccttgtagagatctttcgcctccctggttagctgttttcctagctttgtgtgtgtgtgtgaatgggactattgtgaatgggatttcattcttgatttggatctcatttgaatgttactggtgtatagaaatactactgtattttgtacattggtttcgtatcctgaaactttgcccaagttgtgtaacagatctaggagcttttgcgaagagactatagagttttctaggtataaaaccataataatctgcaggcagacagtttgacttctctgtttctatttggatgccttttatttctcttgcatgattgttctggctaggacttgcagtactatgttgaataggagtggtgagagtgagcattcctgtattgttgtgattcttaagagaagtgtttctagcttttcctcatttagtatgatgttatctgtggattttattgaaagccttttctgcatctattaagatgaccatgaggtttttggttttaattctgcttatgtgatgaatcacatttattcattcctatgtgttgaaccaaacttgcatcctagaaatgaagcctacttgatcgtggtggactagctttttgatgtgctgctggattcagtttgccagtattttgttgaaaatttttgcatctttgtatataaaggatattggcctgaagttttatttttttgttgtgtctctgcttgtttcggtatcaggatgatactggcctcatagaatgagttaaggaggagtcccttctcttcaattttttggaacagtttcagtaggaatggtaccagttcttctgtgtaattccggtagaattcaactgtgaatctgtgtggtccagggctttccctggttggtcggcttttaattattgattcaactttggaattcattattgctctgattagaatttcaatttcctgctgatttaaacttgggagtttgtatattgccaggaattatccatttattgtagatattctaatttgtgtgcatagaagagtttgaaatggtttctgcagggttttttgtgtttctgagacatcagtggtaatgtcccctttgtgatggtgtttatttggatcttctctctttttcttctttattagtctcactagctgtcgatcacatttattctttcaaagaaccaacttctggtttcattcatctttggaatggatttttgtgtctcaattacattcagttcagttctgattttggtttggggttgattttgcttttattttttgagttcctctaagagtgatattaggttgttaatttgagatctttctaaatttttgatgtggacatttagtgctataaactttcctcttagcactgctttagatgtattccagagattctagtatgttgtattattgttttaattagtttcacagaatgtcttgatttctgccttaattttattatttatcaaaaagtcattcaggatcaggttgtttaatttccatgtaattgtatggttttaagcaatcttcatagtactgacttctatttttgttgcactgtagtctgagagtgtgattggtatgatttcagttgtttttttttaatttactcagaattgtattatggctgattatgtggtttttagagtatgtgccatttacaaataataggaatgtatattttgttgtttttgattggagagttttatagatttctgttaggtccatttggtcaagtgtcaagtataggtcctgaatatctttgttagatttctgcgttggggatctaataatactgttagtagggtgttgaactcttttactattattgtggggttatctatgtctctttgtaggtctctaagaacttgctttattaatctgggtgctcctgtgtttggtacatatatatttagcatagtttaattgagcactttaccattatgtaatgcctttctttgtcttttgtatcattgtttgaaagtctgttttgtttgaaattagaataacaacccctgctttttggttttgcttggtttggttttatctttgctttgaccctatgagtgtcttgaagacagcatacagttgggtcttgtccctttattcaacttgccagcataccttttaagtgggggcatttgtcctatttatattcaaggttaatattgatatatgtggatttgaccctgtcatcctgatgttagctggttattattcagacttgattgtgtaattactttatagtgtaaatgatctatgtatgtaagtgtgtttttggtggctggtaatggcctgtttctatatttaacccctgtgtaaggtacctcttatgaggcaggtctggtggtaacaaatttccttagcatttgcttttctgaaaaggcttttatttctcctttttaaatgaagcttaatttggctgtataagaaatcatggttggaatttcttttctttaagaatgctgaatataggcccatgatttcttctcacttgtaggattcctgatgaaaggtcgactgttggcccaatggggttccctttgtaggtgacctgacccttctttctagctgccttaaaaaaaatttttttttacatgttgaccttggagaatatgatgactatatttcttgggaaagtcatcttttatagcatcacacaggaggtctctgcatttcctgagtttgaatgttggcctatgtagtgagattggggaaattttcatggacaatatcttcaaacatcttatccaacttgcttgctttctctcccatttcttacttttaacgatagtgcgaggccataaaaatgactgtatgttgaaactcacaacgtgatcttaataatcaatgggagaattatgattgctctgtgacctttaaatttttgtcaaagtatttaaaactcttttgctctaaattgtacatccataggggaaaataatagtaaaacttccatttgagggctctagttatcttataaagtaactagataattttactagtaaactaatattatttagtgcattataatttaaacattagaaacattgagaaagtgttttttatatataatttaattaatcctaattatcaattttgtataaaaattaagtacttatctttttcttctccttatataacttatatctaatgagcatcctttctacccattggaagcaatttggaaaatgtgtcttttgctaatagaggattttcatttcttcaatttaaaaagtcatagtttgggtaaggggaattaaaaattatctgcaccttaattacaaatcaagtctttacagaattatcatttagccttttggagtattaaccaatgcaataatagttgaaatgtggagcaattgctgggctgtatcaaagattatcatacaactgagacatataagggatgtggagtcacttaccccatcttttcctcaatgtagggattatctttttaaaatttgtgaacattctgatacttttgaaagttgttccttaagagagcttcacatcatatctaatacagtgatcactgaaaaatttattcttgttaagtcaaagacttctcattacctttccttggtcccttattcttttctctagatcttaagaactaagcccacttgttgaacaggatactcgctaaacattcagacagctttcctgctcacgtccctcttttctctaagctgtagtttattctagtgccttctgatttctgaaaacctcataggatacttagttccaccctctttactctttttatagtgcttatccccaagagagtttattaatttggaaattttatccttttggtaatcctgattgctgtagtgccgaagagcaaggtcgtacatcttgggagatggaatcttgatttgatcctcaagtcagtggaaagccatttacgggttatatgtagtaggcagaggagtgagataaacagatttgcatttttatgaagatacctgcgcagcattttggaaaaaggaatggagtcgatgagggacagtgggatctgcaggggagtttaattatgaattgatcagggtgagtctttcaagtacctttctgtcaatgagcatttataaggtctctccaattatttctgggagtctttctatttctgctctggcagagtaaaatagatgattagttaagatcttacgttagacacccaaaggacttgcagaaatagttggcgagactttgagatggagaatcttaagtcttgtagttatgtaggtaggagtttgtgtactagagaattttaatattgatgttaatatactttaatttttaccaatatgctgttgaggttaggacacattcagggtacattttcacttataataaattattcttcatatgtgtctatctctcactagactatttattgtctgactgatgtttgagagactgacatgttagtgtttatgtctttgtaaatagcagagcatctggaacatattagaaaaaatatgaatgaatgaatgatagacataatgtgtagttgttattgaaattatgtatttcggtgagttggataaaatttgtctgttatttaccttgtttaaaaataaattgatgtgagttaaaatttagtaatgaagagcagcattgtaaatactacaaaaaacatttccagataatatttaatagctttacaagtgtgtctttaatgaacttaagatataccttcccctgtaattgctgacaactgtgttgttgtaggttggagatcacacgtgcttatcagaggtactattgacttatacttgttctgcttattgattacttaattagttttctaagatagctaatcagagagagatgtaggtatttaggagtctttcattaaaacatgctaagaaatttaaaacagaaatgtgtgacctgaaaggaaagctcagtaaaggcagagttcttgaggaccttggatataatgtaatgtcctactgtaggtaaaactggtataatttaatttctattttcttcttcagaataatgatatatttttttgttccattggttagggaaatatatcacatgcatgcctctatgatttatgggtatttccatttccatctgaattgtagattagcagaagtaagtgcacatttctacgacctatatattaaacacacttaacttttgacactttctctttttattggaattctattgataaaatataaaactaatgggaactttctctttttattggacttctattgataaaatataaaactaatgggaactttccctttttattggaattctactgataaaatataaaaataatgggaactttctctttttattggaattctattgataaaatataaaactcatatttcattattttttaaagttttgtttgtttatttatttatttatttttagatggagtctcattctgttgcccaggctggagtgcagtggcgcgatctcagctcactgcgacctccacctcccgggttcacgccattgtcctgcctcagcctcccgattagctgggactacaggcgcccgccaccaagcccagctaattttttgtatttttagtagagatgaggtttcaccgtgttagtcagggtggtctcgatctcctgacctcgtgatctgcccgtctctgcctccctaaaggtttattttttaatccaaatccgttttgtgtttctgttcaaatactaactaatataatatgggatattagtgaagtccttcatctaacaattctttaacttcaattatcttctttagaaaatgagttgttctcatcttcttatttaaattaattaataaacactagcacttttacatcatatcctgtgttttatgtaaaataaactctcataaagtttacactattttttttaaaagaagtgacttctaatgttatactttcctcacaatcagagtttttaaagaaaagtcataggaatattttgctctttctacatatctgtacattttattagttggtttgctgtcatgctttttcttaatattaaagttgaccaaaacaaaacagaataggtaaaactgtgcagtaatgaaagctgatcattaatgacatgtccttaaattgagctttgagatatgtacattgagataagaatatttattctggagaattctagatgctgcacttaacggtaaatttgctaaatagttctgatcttggaatttttacatactagtgtggaaagcttttattgttcagttatatcattattttattaaaactgtttattcatatgacttttgggaaacattacagagctggtttgtcacaagttctttgtacctaacagaatgagaaatgagatgataaaatagaatacagttttatttttctgttttaagcttaatacctaaaagatgtatgaactattaagtaaaaaaacactcaattattcattctttcatccaagtatataaccaatttattaagcatatatgtgctcatgtgaaaattgaataagagctttttgtttcagagcaattttttatttaaaaattcttaacataaagtaatacaagactcatctatacctctagctttcactgattccttgctttaatcattcgtctagtaattcaactgatatttattcagcaacagctgctcatttacataaaataagaaacaatatgttcaggaattggaggatattaaaaaacagttatcttaagcttaagtttggaaaaataacgtatatagaggattacttaaaaatttgtatagatttaattgtgtaaaatgtgagaaaagggaacaaattgcaaatgaaacaaatgaagaaaaagtacatgttttccatctttcttcaattgctgttttttgttgtttgtacataatttagaggcatagattggattagtagtatatcacttttcatatagtttatttgaaaacttgtattccctcttccggtctcatcccctatcttcccctactaatggtaaggaaaacaagttggttggtaattgaatataatagcattcatcccagcaggttgcatagtctccgctactgcaatagttcaaaaccagtgggatgatttggattagaaaattgaaggtaaaatgaactattaatgtaaatgaaggaaggcactgtgatttgttgaggaagaaaacaaagagtatgtaattccagtgtcctaagaggcagagagacttttagaaagccccacccctatcatgaggtcaggagatcaagaccatcctggccaacatagtgaaaccccatctctactaaaaatacaaaaaattagccaggcatggtggcgggcacctgtagtcctagctattcgggaggctgaggcaggagaatggcgtgaacctgggaggcggagctttcagtgagctgagattgcgccactgcaccccagcctgggtgacagagcgagactccgtctaaaaaaaaaaaaaacgaaaaccccacctctttcagtggcaaagcttattctaatagtgttcaaaataagtctcaggtacctatgactataacaaattgggttcttaggaaaatatttttgctacaattagttttttgggggatgcttgtacatgataaaaaggaggaggagtatttctgaagtgatattttgggtgggtctgctaactatatagattctggaaccatgtctatcaggcgaagtgtttttaaaccatcttttgataagtataggtcagactttggtgttatcatggattcattggcacacctccctgatccctcttcagggccaatacacccatccataattacctacagtgcctgatgcgcctcacttcaacttcaggaaagtgcctgggacaaggttatacctctcaggggacagcctacaaccactgacaaactcatgcatggacacaaatgttgggcccccttgtctcacttcaggacagctctgcaggagctgacactgcttgacaatgaagatcctttcagaagtggccactcagcccaaagatgtgaggataaagggatttgaacaaagatgaggattaaaaacttcccataactctgggtaatttattctacaaaggcagaatcttcatcctgaagaggtcaagttgaattgctagggttctgtatcctggtgtttagatcaggattaagaaaatggcacaagcattctaaactacctggagggaacttttcccagtcttagcatgtgcattatatggcatgggcttaaccagcaaaagctctcaaattccttctacttggagtggatgtggggggaatgacaagttctaccacacagagtatgtgaacaaggcaggcttatataactcctttaggatcaacaagtgaggcttgagggttccagtggttgattcacactgtcagctaaggtgatgttttacattaagtacacagggaggaatagtgatcttcctatgagttaggaagagaagagaaaccccattcagatattcctctgtgtatttatatggagagtagacttgcctttattccttctctttttattcagccatttatgggcacacttcaccctggttcatagcataatcaatctcaaaacctatcttggcagatatatttgctgtaacacctcagaaaacacaaacaatggatcttttatgaatatcatgaatcagggcttaagttaaaggttagcccagatgaaacagaaaattagagattaaatagtttgccctctcttgtcaattccagcttatatcttgtcactctttatagccaaatgaagaaaaaaaagcacaaccacgtatattttaaattatttcattgattaaagtagtatcaattcaaaatggcatcaaaaccaaaaatttcctctttgccattctgaaatttactcaaggccagaaggagaatagaacatagacctttaatatttttggtgacaagaagtttgaagggctgctaaacaaaagaaggagcaggggcgaatggggaagaaagaggagcaaggaccgccccagttacacatctgagaaaaccaatccagttcacttttcaaagatgcagggcacaaattgagacacaggactacatcttttatttgcagagatcagaatggggttattagcttgaatcaggaactttctagactatagtttgtttctcacaaaaaaagggctcagataaataaggaatgttcaccaaagctgtaatttcaggaagtagctggaagtccttgagttgtgtaaagcaagttagtttcctatttccattagctgttaagaagtaaaggctaattgagctgccgctcaaaaccgtaggtcagaaaaaaaaaaaaatccctctcagaccataactctgattctttctaaacaaaagccacatataaatagatcaccaagaaaaaaattaggaacataaaggctaaataatcaaaagggaaccaacaaagattctacacggaaaaaaaaaggaacataaaagacaaagagcagagaagaaaaatacttacaaaaataataaaatgtagccatgtagcagataaaaataaaccatcttgacaaaaatttaaagatcgtatgcctctgtgaagcacataccagagtgaaacaagtgctcatagagaatatggagacataagagacttattatatatcttaattaaaaaaaaaattatttaaaacagtctcaactcccaagttttctcatgccattgatttgttggatgctggcactttctaggtctcttcctcaagtagttaataacaaataaccaaatgacccacaaacagatttttgaccacagatatccagtcatgccaccttgaataacattgaggtcacttcactttttagatagttaatgcatgctagggagtgaagttgtaataacttccagtagtcaaaagcaattgtaaaacactgaaaattgtattaccccatggattttaatagtacatcccaatttcagagttgttaaaagtgtgataaaatgtgtatttttaaatttaaagaatagattaaaatgtactgtcagaactaagacaaacatctgtaatacaaataaataaaaatgggttgaatttaactattgaaagaaaaatgtgttatatttaatcacatatcaaagtccaattttgttctttcaacaacaaatatttctaaaataaggcattcttatagattgataaaaacatgggcaaagatataaaaataaaatgctaataaacaaatatcaagggtcatgataattatatcaccatatgttgaattaaggcaataattactaattgacataaaattatagtgctaaagtatatactatacaattatgtatagcaattatactaaatttgcatgcaagcaatatatcaacatccatagaagcaaaaaccataggaaaaaatattaaatagaacaaaatcacattcttattataagtaaaaaactttaatttgcctgtcttagaccatgatagatttaaacaaacaaaatttaaaaatataaattatataattaattaggtgcattaatgttgtataatgctataacctgaaaagaacaaatacatattatttttcatatcaatggaaaattcacaggaattgataacatcttagattgtaaaaacagtcttaattaagcaaatcagaagtagtatagaaaacattgctgtactgaaggtatactaataatgcactgaaaaatatattaataacaaaattaaaaagtaagattcctaccactttgatattaaaagataaaaatcctctctataacacttttattaaaaagtaattctaaaataaaacattgtagtaattatagaaaattaacataatgaaaatgctgaatatccagattagtgaaatagaggtagcagtgctcagaaatatattcatagaccaaaactatcttctattagtaaaaaagaagttaaacgaaataagcatataatttatggaaacatggacctatgaaaaccaaacattaataaaggtaacactggaaaaaggtgaatcaaaaaaataaaaagcaaaacagtaaaaaacttcataagaaaagaaatctcagagctaagtgggtgtttgtttgtttttgtttttgagatggagtctcccattgtcactcagtctggagtgcagtggcgccatctcagctcactgcaacccccgccaccacgaccggctaatttctgtatttttagtagagacaggctttcactcttttgagcaggcttgtccagaactcctgacctcaggtgatatccacctgccttgggctcccaaagtgctgaaattacaggcgtgagccacagcacctagctgctaagtgttttcttttttctttttttttttctttttcttgagacagagtctcgctctgtcacacaggctggagtgcaatggcatgatagctcactgcaagctctgcctccctggttgaaatgattctgcctcagcctcccaagtacctggggttacaggcacataccactactcctggctaatttttgtatttttgtagagatgggtttcaccatgttgtcctggctggtcttgaactcctgacctcgtgatccacctgcctcagccttccaaagtgctgggattacaggcatgagccaccatgcctggcatatgtgtttttttaaagaaaaaaaaaattggctaacccaacagagaaaaattgaatatatgttaatttaatagtggtaatcatcacacaatgtctatgtatatcaaataaaagatgaaaaagcaaaaagaaaaatggaaaacggcaataaatccgaaaagaaagaaaatggaaggaaggaagggaagggaaatgaacgaaagggattaaaggcaggaaggaaggaagggacgaagggacaagagcaaaataatataaacaaggatgaaaatggcacaaattatgttcaatcatataaaaataaatgtgaaatatgaatttgaggagaaaacatagttatctgtggattgtcataacagcatttgatagaattttttgtaaggcagaagtaaatggctaattctaatgtatgattaaaatgtatattaggccgggtgcggtggctcacgcctgtaatcccagcactttgggaggccgaggcgggtggatcatgaggtcaggagatcgagaccgtcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaaaaaaaaaaaatgtatattaatgtatagtataaatatgtgaaacatatataatatggttattatgtataatcaactgtaaaaagaatgtatcaactcctaaactaaaattatgcttaatgtaaaaaacctttaaaaagtcccattgaattcagaattaaagcaaggctattcattatcaccactactgtttaataaaaagtcagttaaagaagacattgaaacaataagtataaaattgagaatgttttccaggcatataagcattatcttatccaataatgatgaattgtctgaaaaataaagaaaataaacagaaaatctactataaacaaaataattcagcaaattaataactttttctattcataaatgacaatgtttaaacatagaatgggagagaagactcattttttactatggtagcaaaaaatactataaataaacttgaagtaatgtgcaaaagctatataaagctctatggacatggaagactgaactcttatcctaaagagaattggttacctgtaaattaatctctggaattcataggatcccaataaaataccatagagattattttagtaccttatgtcatgatttctggataagaaaaaagaataaataactaaaatcatctgaaaatgaagagtaatgaagggaagctagccatgctggatattgaaatttattacaatatttcaatcatttaagaagcatggtactgtacatatacttagaaaaagagtcagagcaacaataccaaaaacaataacagaaatagaacaaatacatcaaggaatttagtaaaagagtgataatcaaatcagagattatacaataaacagtgttggaacagtcttgtgtttatgagtgtattagtccattctcacactgctgtaaacatactacctgataatggataatttataagaaaggtttaattgactcacaattctgcatggctgggggaggcctcaggaaacttgcaatcatggtggaaggtgaaggggaagcaaggaccttcttcataaggtggcaggagagagatagcaagggcaggggaaatgcctgacatgtaccaaacaagcagatcctgcaagaattccctcactatcaagagaacagcataggggagactgcccccataatccagtcacctcccaccaggtcctttcctgaacacatggggattacaattcaagatgagatttaggtggggacacagagcaaaaccatattattccaccttggctcctctcaaatctcatgttcttttcacatttcaaaaccagtcatgccttcccaacagtcccccaacatcttaactcattccagcattaactcaaaagtccaagtccacaatttcatctgggacaaggcaagtcccttccacttatgagcctgtaaaatcaaaagcaagttagttacttcctagatacagtgggggtacaggcattgggtaccaaataggagaaaattggccaaaacaaggcacaggacctatgcacatccaaaacatggtgggggcagtcattaaatcttaaagctctgaaatgatctctttggaccccgtgtctcacacccagggcatgctgatgcaaagggtgggctcccatggccttgggcaggtctgcccctgtggctccagagtgtaaagccctggtggctgcctttcctttccagatggcattgagtgtctgtggcttttccaagcacatggtgcaagctgtcagaggatctaccattctggggtctggaggacagtggcccttttctcacagctccactaggctctactagtgccccagtggggatcctgtgtggggactccaaccccacattcccctctttattgctcaagtagagtttcaacatgagggctctgcccctgcagcaggcttctgcatggacatccaggcatttccatacatcctctgaaatttacgtggaggctgccaagcctcacctcttgtcttctgcacacctgcagtcccaacatcacatggaaaccaccaaggctttggacttgggctcccctgaatcaacagcccgagctgtaccttggcctcctttagccatggctggaggtggagcatctggacacagggcactaagtcctcaggctacacagaggaatggagccctagacctggcccacgaaaccattttttcctcctaggcctctaggcctgtgatgggaggggctgtctcaaagatctctgacatgccctgagacatgttcttcattgtcttggctattaaatttggctcctcattacttatgcaaatttctgcacccagctcgaacttctccccagaaagtggggttttctatcacggtcagtctgcaaatcttccaaaccattatgatctgcttcctttttaaacataagttccaatttcaaatcatctctttgtgaacacatataaccatacactttcaggaaaagctagatcacttcttgaatactttgctgcttggaaatttcttctgcgagataccctaagtcatcactctgaagttcaaatttgcatagatctctaggtaaggtgcaaaatgctgccagtctctttgctaaagcatagcaagagtcacctttgcttcacttcccaagaagtccctcatctccatctgagaccacctcagtctggacttcattgtccgtattactatcagcattttggtcaaaaccattcaacaagtctctagaaagttccaaattttccctcatttttctatcttcttctgatccctccaaactgttccaaagtcttcctgttacccatttccacagttgcttccacattttcaagttatctttgtagcagtatcccactatcctggtaccaagtctctgtattagttcattctcacactgccataaacatactacctgaaactgggtaatttataagaaagagggattaattgcctcacagttctgcatggctgggggagggctcaggaaacttccaatcatggtggaaggtcaaggggaagcaagtaccttcttcacaaggcagcaggagagagagcgcaagtgcagggtaaacactggacacttatcaaacaaccagatcctatcagaactccctcattatcaagggtacaacatggggaaagccactgccatgatccagtcacctcccaccagatccctcccttgacacgtagggattataatttgagatgagatttgggtggagatacagagcaacaccatatcaataaggaaaaataaataaattttacattatatataataccttaagccctcagtattttaaattgagcaaataaaaagaagagaaaagataagaaatggaaaatattaaaagaagataatgactataaatatacaagtatatatgtatatttatgtataaaaatatgtgtattatatatataaatgtcataccaaaaaagatcttctcaataaatatatgtgaaaccaaaaccgaattgaagaagataatatgtaaacacataaaaaaatagttgagcattgtggcacatgcctatagtcccagctattcaggaagctgaggcaggaggatcacctgagccctagagtttgaggctacagtgagctatgaggctggagttactgcactccagcctgggcaacaacaaagtgagaccccatcgttaatcagtcaatcagttttaaagacagcatcaccataagcgaaatataacaaaatgacagattttgatatgtattttcttaagatatttataaagagcttttgaaaaatataaattgatatgaaaaagaacagttcaatagaaaaataggctggagatctgaccaaactgttcacagaaaataaatagctcttaaacatatcagataacctcaaagtcactctttggtgcataactttggagagacaggtgttccatgaatagatgaaaagtggtttgacaactgttattgaaattaccatgcgcatctgaaaatttttctgtgggtacattcctatatgtacaagaggatatagataaaactttacacaatattatttgtgataacaaaacattggaaataaaccaaatgtgcttcaataagccagaggttaaataaattacaacccatatacacaatccatgtaagatatattatatatgcatattcccatatatataagtgaacactgattaaataatttatattcatccacattatagaatcaaaagcagctttcaaaaggattgatgaagtctctatgtactgatgggagataatcccccaattatactaaatgatttgccaagagtatgtttactttaatttttaaaactatttgtatataaaagaacaaagaacatttgtacatatttgttgaatatgcaacattatatatctacatacaagagactgataacaatttgcaacttttaggaaaaggaattgcaggtctaggggagaattgtaggttaggaaactttcactgagtaactttgatacgcttcctgaattttgaaccattcacaaattattaatttcggaagcatccaacatctatcaaaattggttgaataaactaccaaatttcttgttaatgtaagctcagttaagtagattttatatattgaagtacaatgagaattcatgtagcctttacaagcatgtagcccaagtgcataggaaaatccattagctgcataatttatagccaatttaaaatatttaatttgagcaagaagttgacactctgctatcccactgcctgaaaaaaaaaaaaaactttctgaatcaaggacacaaatattaaaattgtattgaacatcttattgaatttttagcctaaatgaaaattacaggttgctttggtaataacaaccaaataaaatctggggtaggatgaagctttaagcacaactgatgctatttagtccaattacttgactgaaatacaaagaatgtaacactttgtaaaattatctttactttggggtaaaagtgtcttccactttttattaacttagattcagataattttatatttggaaagtccttaaagctcacgtttccatcaggattttacaaagccatctttactctgatttcccagaaataacaactataactttgtttgctaacgatttactctttagcatctctacccaaagtcagcctaaatccctcatttgcaatttacatttatttccagacgttctggatgagaaagacatggaaaattttgtactggtggtatttctttctataacaacctttcatatattctaaatcatttattatacttttctcaaagtatttctataatatcaggtttaaaaatgaggaagctaaattatatttccataagtgaagtcatcattagtacttacattagaatgttttattagatgacataaaaaattacgcagaaaattggaaaaggtacttttctttgttgttacatgtacattctagtaggtatgattaaatctgagtgatttattattttggtttatatgctttctactgtttgcttaaacgttgttcatctgtagttgttttcctggcagatctatttcttttttattaaagcatgttcaaatgtttgttctcattctgcatccgcaaattcaatgtttaaacttagcaccttcttagaatttgaatttagaaggctacctttctttacatccatgatttttatcagtctctattctgaccgagtaagaaatagacacatatgggaggttttctattttagcagaaaaatggtatactaaatcttttaaaaaataaaacatcatttgaagtcagtagagagctactgcttctttttatgtgtctgatcatttgcttagcactgttttagttatgtatctgattaattttgaatagcacacattaattaaaatttaataacacttcatttaattaggttaggtattctcaaaagcactccagagctagatttcatgattcataggagcaaaaatacccacttcttactcaacataatgatcccatgtttaaaaggaatatagtcagagcagcagggatgaagcacataaaaacttgcactacatattattttgtgatattttagttataatcctttgtttctaaattaactcatctttcatagtatgagatacagcaaagagattgaaaacattatgttagatgctggagggcaaaacaaagaatgaaacagtgtctgaccttaaggatattaaatctaaaccaaaggacttttattattgtactttcaaatttctgaatagatgatcagaggctgggtaattcagcaactgcatacagatttttaccatcttgctgccctgttatcctgagcttgtttccttctgcatgatgtcaagatagctgcctcaattctaatgtcatgtggcaagctcaagtggaaaagggtaggaaaagagactagatgtgtctctttagcaatgagagaatcttttcaggaacccttaaacagacttttcatccgtcagaattgccgcataccactgtttctaaagcaataaccaacagagggaatgtgtttgccatgattagcttagttaagcacatggccctgtaaaaacaagttttgacagaacaaaattgggcttttgctaaccaggatggaagagagaagggatgtatattctgtaagcaactatcagtgtctgctatataattgaaaatttttgaagagggaagtgtcatgatcaatctgtgcttttttgtcttggcaattaaaatgtacgttgacctacttggaaaatcacagtcctaggtttcacggaaactggctattttatgcttctttttattctctctttctaccttttttctttctcttcttattatcttaattattatttcaattattaagtttttatgtctatcaccaatattttctgtttttcctcttaaatgccattaccttctatattcaccttagtctgttcacattatttcttttgtagacaacgaaaatagccataaaacatgtctaccttaatttactattatgcctctatggtaggactggctacatcatttgtagggtctactgtaaaaataagatgtggggcttctgttaaagacgtattaagaacttcagcgtggcaacagtagagtatcaaattcaagcatgggaccctgtgggactgcacaagctgcatgcctgtgaggctgggccctgctttccaacttgtcctccacccagtgccctcaaatatcttttctgttgctctcagaatgaggatctacatctttaatatgaactaaatgttatcagcttaattatcttatctgcatctacaacataccagcccctgttcttacttctgtgctctagccatggtaatctttcactgactctcttttatcatcataccactagacatttgcaaattctgtttctctcacaacattcattacatcctctttcaaccttcactgacttcataaatttggcaaattatcgtgtgatgttttttgtagccattgtaatataaattacaatatttttgctcactaattttctttttccttcttgttattggccatttactcaggaagttcaaatttatttatttatacattaaaaccttactgcctagtacagggccaggcctgtacaagagtctcaaaaatactcatcaattgaatggcagtataggagtgataaaagagttgagagtaggacaaatgtagtttttgtcatcataatgtttacaatataggaaaactagcaggtaattctatgaagcatgtccattagtttcaatatctgtaaaatatttgaaattaaatcaatgaaagattatttattaatattttcctcctcataaaagtcttacaggctttatttgtggagaatagaatggcctgccaacacatgctgtgtttgacatggataacactgctttgcctaggaatggacattaacagagttacgtgaatttaagtatttaacatacttttttcattgatactcaacgaagagctattttcctaaataaatttgaaatatacatatggcttacccatgtgactgattatcagccaactatacattggcatcaggaactggaatgaacttggtgggtgtcttgaagaaggttcatctcccttcaatagtcatagaataaatagcttggttacatttatacttaaaacaacagaattattgtacttattcataatgctaagtgttttaagtggtctagaaagcatttattaatgttatgttctgtcttcttagtgactatagatggtaaaatttttcaaagaaaagtttcactcttctaaagggtccttggattttgtccttggtttgaaagtagttttaatagatctatttaaaacaacctaaagtgcatgtattttgtgaatagatgaccaatttcataaccttctctcctatcaaaaagaagactagttgttctttttcattgatgtgatattcagacagaggaaggcttctttaagttcttgttaaagttattgcagataccagatgatacgctcaaagaactttgcttgttgtctttttaactttccacttctttaatcatagctaggtgacaagtctttaaaaagtcttaatatttgctaagtgtaagtaaagctttcattaatgattcttgagttattggtgcacagaagaggcttagaaaaggtgaagcaatttgaggtgaagaaagcaatactttttctctccatcattccatcacttaaatatattagaatatgtttctgttacccttccaaggaagatgtatcttctgaactgtagtcataattttttttcaaaaaatataaattctttaaggtaatttgtaagacagaattcaaatatgtaactagttctgttttcttctatagcttatatttatgtataaaactcttgcattacacttaaaatacataaatggtgtcagtgtgtataaattcctaaataaaatatttattgtaaaatataagctgggtaaatgctttctccacgtttgaattccagtctctatagttggaattctaattttctgccatagtagtaattttacagtaaagcacacatatctatcaaagtcagaatagttgatgtcagattcagatttaccatattttgcttaggcttttcatgaagcatataataacaaccattgttctgtgttgtctgcgctagagtcatatgaaatataagtgagtacatgatgagggttctaagcttgacatttccattatgcattcatcttcctattccccttctaccttctcttgctctctttctctcaccatatatatatatgtatatctttctcactatatatctatacacatatatacacttgtgcatatatgtgtgtatgtgtatatacatgcacatacacacacttatgtctcattctctatttttattaaaaaattcattgtaataaagctgtactctatagttatagatttatataaaagtatgtcttatatgttggctacataacacaattaaatgcaaataccaaagatacagaatttaaatgttagttgttggcttttgaagctaaaatgaaattatttattcattcatgaagcaaatggttacttaatatctgttatgtattagagtacaataaatgaccttcttcctatttctaggcctctattcccccaatgcctttttggggtactttattaatttttctggttcatgcaaataaagtagagttagagaactaaaaactaaaatatagttttagattcttcatgaatccagccaagatagattatcagatttttttttctctttctacagtgcctctgaggctaacttaggaccatctaggcataaaagaaaagctgatttcctgtcatgaaagtaattcctacttggacttaatgacttaccatagcaccattcttcaaccttttcattttttggcatattgcaaaatatctaaattttctagggaaatgtcaggggttaggggagacttctatttgtatggtagtgaaaagctttttcttagtatcgtaatagaaagaagaagagactagatggaaacggaagtgaatagaagaaaagcagtttaaaagacaggaatggtaaattagatatgtgtattttaccaccattataaaacaaaatgcacgagtgggacttacagtctttgcttcaacatgtgaagaagttggaagtcataattcctgactttaccataacaaaaagctgaataaactgaaaatcaatgacattttttaggcacataagagaaatgatatcttggggcagactgccatgctgaaatctagagagatgggctaatccagagagccacatcaaagatctgcttacttgaagcagaagccactggagccatacctggtagagacacaaggtaattttaataagttgctagagcctatggaataacacaaaagtgagaaacttattggggctacattgttggtggggaggtcattgtatttgtataggttttacatcctgtggaactgagaaatattctctcatagatatggaagggggatttcccccacgacagcccactctatcttttctttgtcacctaagctgggagaagggagaagctaagaaaaacttgggacataaccagggacacagagccacgaaaagactgagatttaaccataaggtagtagaatctttcccattctccacaccttaccacacatcaacaaagctctagtataataataaattacagctgaaagagctttaagacagacttaaagtaaagaaatggtgacaaatatgccatggtcaaaagaaagctgaagtatctattatgattttagagaaaacagacataagaacaaggaaaattatcagaaataggagagacactgcttaataataaagggatcaattctccaagaagacccaaaaaccctaaacatgcatgtacctaacaacagatatcaaaatatgtgacaaaaaacctgatagaactgaaaggagaaacagacaaaatcactattataattcgagtctttaatactcctccctcagtaactgatacataaagcagacaaaaactcattagcaatataattgacccaaatagcagtataaatcaacttcatctaactgatctttatagaatataaaacagcagagtacacattattctcaagctcacatgaagtatccaccaaagtagatcatattctgtgcccataacagaccagaacagaatgtagaaagggaaagtgatagaggagaagatttatctcaaaataattttggcagaaaaaaattataggtaggaggaacaaagaataaagctaggaaaacagtaaaagtaaataatagctaccacctcttactgagcttttactgtatataggtgggttctgttcccagcacattatatacatgacttgatttaatcatcttccactttcatctgggcttttgtcatcatttgcagatgaggaaactgagactcgaagaatatgagcaatttgtaagtgacagagccgagatttaaagccagagacctaaccttaaccaagacttgactttgttgactctttaaatatggagtcaaggtaccttttgtgaagctgggttggatggcttaaatctaaaactgattcattcatgagtaagagttttagagagtgaccagtgcctggtagagtatttgcatttttctcaggtcctatttctcatcagtctcaagcttccctacttccggccagctattcttggctctcatattcctaccagtaaatcttgttttcctctgcaggtcaagttattgctgctaggatactttcatcaaatatcccacgttgatcacttcatattatttaaaatatgtatgtgaaaagactattggtgactttgcaaatagaagtcacaagtatatattattcttgggtaatgggatgaagattgagatacaagtaagataaagaagattgttaaaatcagacagcatctttttctctcctaaattgtgaaataatgtttttcacagaaaatatatattgtggtacattcatgcttcataagggcaaggactataacttattcagcttcgtttcctccagcttgggtcttcataaatagaagttgttttaataaatgttaaatgaattgtaatccttaataattattttaaatagtaaaacatgcctcaagttttaggaaaagctcataaatatattgcatataaaattaagtatattttatacaaaggaatgaagtatgctgtacatagagaacataaataatataactctaatgtatcataaatttggtctaaagctaacaagctagctataaaaagcatttccaatttcttgtgcctttaaatttaaaagagcttgttagaagggttaggatgaactaagtttctataaaaggctgaccttggaactttgaattatactttcctttgatctcagtatatgtcccttaacaaacaaaaaatcatttcatttcttggtctagagctgagctcttcagaataaacagtctagtttattctgtgcatttcaatgcacagtgttaaactggtaaaccagcacatcagtaggtaaaggcacttgaaatgttcttctagattaaatatcttcagataaaccaaatgaagaaaattatggatatcctatatgaccacacatattaaattccagggtgttactatgaaagcaactttttcttggattctgatttccatccttcatgatcaaacaagtattttgtcagttaaaaatttaaatatgccatcttacaatggatgagtgctacaatatgactcagtgcagaaattgttctttaatcacagggttgaaatactagcatgtgttaaaatatattggaacgtcactacagcagttatataattatcctttaaatgttttctttttgagtctcttgtattattatagttggatcatgtaatatagttattagtgtatgtgaaacaatagaactgtgctgtactaaattttaaagtatgcacgtgtgtgtttgtgatagtgtgtgggctgtgaataatattttgtctaagatacaagtattctaatgtatcttagaaggtctctttattttcactaattggtttcagaacgtgtggtttgagctattcaactaaatagactggttatttgactttgagtatcttgattgttttcctgttgtatcaaccaactgttttgattccacatacagttaatttcttttttttccttccttccttccttcatctttatgactgaggataacattactcactgtctttacttcaaacaaaatgaactttgagtggttgtatagcttagagtcatttactagtgacctttttaaatcattccatgcttcagtttcctcatttagaaccaacctcgtggagttcttttgaagaatgcattaaacatattaaagttctcaatatattgagaacccattcaaaggagtttcattacgaggaatatattcctttaggaatctttcagttccctgtttatattttttcagtaaatagttgtgtttttttttgtaaacttttccaggttttatttttttaaaaaattaatttctggttgcggagtgatgcttttgttttacattatttaatagtactattatggaattattactgcttcccaaaatcctgctcccttcccactcccacagattagtgaaggtaaacttttggaagatttatcacttgacgaatcaggtttcagctactgtacctcctagctggattatgaaggtattaaattcataattctgttactaatgcttccctccttcataaccataataatgtgctttcatcaggaagcatcttaaaatatatcatgtaaaggcccttgttactctatacctcccacactgtcacttccttggtacccttaattctttgaagcttgaatcatactgtgtatatatacttcatccatgtccagccttttaataatctttctcattgtggcataaagattgttgtactagtagaaaagaagttccatttcccttaaagtttcctatgtccacaattctatgaaacttttcagtggaggtcaccaagtccacttttacagattttctgttatggggagagggcacctcacaacttgctctcagatactgtattcaaaatttcattatcgtcaggaaatatatctcctttaaatcaccaaaccgttcagttgcagttgttctcaatagcctagtcaatttcattcactgaattatagatttccctgattcttaataaatttactaattatactttcctcctaacaccctctgctatgactgtaaaatcactatttataactgataaaatttgccaaactcagtttcctgatgtactcaacgcctctggattttgacatttcttcattttagccacccagtggcaatgccaattcttcaaaagtgtcaactctcagaaattctccacctctgatttgacagtctcaaagatagacaaggactgcctctccacttttttgacaagtgacaaacactgaactgacaactgataaatttgtacctgaatctggtcctcctgtatattctttatttgtccacttctgttgctaggttagagatgaagataatttgtttccacgctgcccagttagtatctgagatggcctgactcttagcattcaaaagtatcactttgctaacaccattctacgtggctagcagataacttttggtctgtgtctcttgtggaaaatccacagaacaagaatagttgtgtcacttatttattaaaaaataggctgggtgcagtggctcatgcctgtaattcttacactttgggaggctgaggcggttggatctcttgagctcaagagtttgagaccagccccgtctctaccagaaatataaaaacttagctgggtgtggtggcccatgcctgtggtctcagctacttgggaggctgaggcaggagaatcccttgaacctgggaggcggaggttgcagtgagctgagatcctgccactgtactccagcctgggccacagagcaagacactgtctcaaaacaaagcaaaacaataagtagtaagcacttactacaaactactagatttattcactattaacaataaaatatacatatatgagtatgcacattatagtgtcatatgtaatgtgtatgaattacaatgccaaaaatttaatgaacattccacttatttattcctctaatccttatactgttttagataatatgtctcttatggtccattttaagctgtttcagattccagcctttgttgattgcttctttgctaatgaccacttactgtcccaattgaactgttcactgcttctctaggagataaaattagagtattttctctttgcatttagctaacagcttaactttcctgaattgaagtaatccctacaatgggtagacagttgaaatattattcgcttagttgatgcctcaaacatgttagctatttttcttttaaaataatatcataacgaaaaggaatatttttaaataacattataccagcccaataaatacatacgtttatatttctgcagcaacatgtttcaagatcaaaacataaacattaaatatatttatgaattactacattaagtatatttttatataactaaggtaaaatgcaattatatgtgacagatatcaaaattaaaatggtttaaaaagacaacttattttcccatataaaaatccatgtctttttaagggtaatactcagaattttcatgtagtatttgtgtctcaatctcatgggacaaaacttatcagcaaatcagattttaaatgtagactttattctaggcatccatgtacttgtcttgaaataggaagttctatgaggaaggactaaagtgttaatggagaatggggggcaactagctgtctctgcctctgatattcatgagatttctgtggtcctattccaaaaacacttggttgacatgctaccacatgtttgatccagaggatataaaaattaatgaaatatggcctttacctggaagattataagcaatttattgtgaaagggggtggtagagcctaggaatgtagtgcagtgaaaactcaggaatggaaatgattaactcagtttggggtggggaggggaaacaaagcatttcagagaagatcaggcacttgtaaatgattttgagtttaattaggaatttttcaggtgaagtatagggtaagatattctaggtggtctgatacacaagaaaacaagctctattatggaatggcacaatctagagaacaggcacaattccacagtggcagcctgtggagtctgcagagggaatgtgggaggagataggtctatagaggcagcttgtggtgtgatgtaaagggccatgtatgtttgaatttcaacgtatggaccagcgtcttgcaacctagggtccataggccatatctggcctgctacctctttttggaaatagttttgttggaacacaatcacatccagttgtttaccttatgtatctatggctgcgttcctgctgcaatggcagacttgagtggttgtgacggaggtggtatgacccacaaagcccaaaatcctttctatctggcccttcacagaaaaaaaaaaaaattgccattcccctcatctgtctcatcaattgttcttggaagctttaaagcagtaggaattcattaatgggagttcttttaaaaaagtgtggagtaacagctcatttattttgaagatcttcatagttttttctgttttgctcttttttaaatctttaatatagactatgcttagaaattagaatgcaaaagaatcagaagaatatacactataaatagtttatttaccaccagtatagaaagctaactaaaaaatgattaaagaatttgccaaaaaggtattaaagaatttgcttaaggagggaaaggaggaccacactttcacagtgaaagcatggatgggctttgcctgctattttaattagtttttgaggctgtctttcatagtctttcacttagaacttattacggtaacattaattattgggaattatattggctgtattcattgtcatgtcaacacaataggaagtgctacagtacacaagtctgggccatgacaactactgaacaactgcagagaacatctgggttagctcaccgtttctagacccagaaatttgtcagttttaagaatgacttcttttcacagccaagtcttcctaggttgtcttaaacttgaagccttttaagtgctcttcatgaagttgtcatacagtatgaatacacaataagcgtcattcattaactctacattaatctgacagacattgtacttcacataattactgcctgctgcattacctttgtcctttgtaagctttaatttcacatgtcaacagcaatcactttagagtgttatatttgtagatacagaaaaaggcttgccatggcaaatatgtacttgaaaggtaagccataaactcttgcacttttgtttgcctcccagcttattatagagttttaatttaattttattttttataatttcaacttttagacttgggggtacatgtgctggtttattacatgagtatattgcaggatgctaaggtttgggatacaaaagatcctgtcacccagtgagcatagtacccaacagttagtcaacctttgtccacctctctccctccccactctgggagtccccagtgtctatcattatcaactttatgtccatgaatgcccagtgtttaggtcctacttacaagtgagaacatggagtatttggttttctgttcctgcattgattcgattaggatgatggcctctagctgcatctatgttgctgcaaaggacgtgatttcattcgttttaaggttacattgtattccacggtgtatgtgtaccacattttatttatccagtctaccggtgatggacacctaggttgattccatgcctttgttactgggaatagagctgtgatgaagatacgagtgcatttatctttttggtggaatgatttattttttggggatatatactcagtaatgggattgttgggtcaaatgggagttctgttttaagttctttgagaaatctccaaacagctttccacagtagctgacctaatttacattcccaccaacagtatgtaagcatttctttttctccacagcctcgccagcatctgttgtttttaactttttaataatagccattctgactgttgtgagatggtatctcattgtggttttgattagcatttctctgatgattagtgatgtagaatattttgtcatgtttattggccacttgtatgtcttctttagagaaatatctgttcatgctctttgcccactttttatgggattatgtgttttgtgctttttgaactgtttaaattttttatacattctggttattagacctttgttagatgcatagtttgcaaatattttctcccattctgtaggttgtctgtttgctctattgatagtttcttttgctgtgcaaaagctccttagtttaattaggtattatagggtcctgcaagcttgagttttacttgtataatttttcctgttatattgttgtaaataagactatttgctattttattaatgaaatataaagcactgtgatctgttattaaataagcagattctattagaacttctatatttttcacaataatttcctatcaattccttaggttttaaatgacagccatactatagaactatttattttgcatattgaagatgtaagctaatttgatgccttcagatgcaggcctgagtctgttttcagtggaactctgttttattaaaaatcatattgaataaatcccttcaagacttactttaaaagcactaccttatagttaaaacatgaaagacaaactggaaaatcagaaaaggggatattattatgaatatgtaaagaattcataaatatattaaataaaaatgtgtatctcaattgaaattaaacaaaaacgtggacattcaatccacaatgtagatataagtagctaataaatatgtgtagagatgcataacttctctggaataaaagaaatacaaattaaaagcacagtgtcgtatttatatttttacttacttgattgtaaaggtgagtgaaacatattagctacagtagtagctagggcacataaaaacataaacactctactgtttataagagcataattcttagtctttctgaaggagtgtttgacaatatatactacatcttaaatgttatactatttacaaacttattttagtaattttgcaggaatttatgctaaggaaatggtagatcaagggcataaagattcatgcataaatttgctcatcatagcattgttgatactgtgaatactagaaacaaccaaagttattatctgctgggaggtggcaaaatgctgtaggatacactcataaaatggatattattcagctactataaatgacaaataaaagtaaaacgtagtttccttttcaagtactcttccctttccttccatcacagcatactttgggttttcttctaatgcctctagattttgcttatctttgaaggcctgttatcccctaactggcattgaaatttggcatttcacaaaattctacccgactcacttcctttgtccagctttctccttcaatcatactttttcaaactgtgggttttgatagaatcttgagacattaaatcaatacagtgggtaataatcaaaattttagaaatgtattaaaaagaaaatagcatgagcaagggtggtgtatttgaagaatttcatgaacttctagaaaactgcattatgttcatttgcacacattctaggacttgagcctggcaggaaaagtaatggagagcattgtatgctgtgagaaatggatagcatttggtcttggaaatgatgaagaaacactgatattttaaggtgaattttattgaagaatgtaatgtactcaatctctttataagcaggaagaacagtgaatattctgcttattggaaatgtatataagacattctaacatatccttagcctaaggtgatatcccagctcatcaatcatctccacaaagactgaacttatgtcagtagtctatcagggcctattagagtagttagccaccataatattgatctttgcacttttagagttgttgcattgataacaattatctttgtctttactatcaaggcaatatccaagagcatgtgtgtctgagtcacagagaagtataaggctcatcttatgttgtacaattataatgtgtaacactggagccacagcatcaaattactataataatcctcatgtctttgggattcaataaaatctgatgttaccttttaaaataattactatcttagactgcttacagtctctgaacttggatgccacatctttcttgaagctgtcttcagaaatcccatgaaagttagtatttcattatgcatccagaagtgttggtctatgctcatagccaaggtccactgcagggatgaggaaagcattctgaatttaaaaacaaaaacttatctgaaaggtctatataaattagttttttcccaagatatttttcatagaagtaaatttagctatgactaagcagtgcataaagcaggtcagtatataattgtcttattttctcataaaaatgacagtgtttccataaattctgaaatgcattaaacacatgctgacttattaagcataatattctgtaatcaaacacataccttctacctattcttgatggttcagagtaaatattgtagtcatgcaaatcataataattccttaaatctctgtaatgtattatagtaaacaggcatatattatttgaatattgtgcaattatatgtttatgttacgaggttcttaaaatagctgaagttatatgacctgacatttaacaaccccatcctgccaacattttgtggtcccgaatcctctttttaattttttctctgcctttcacatcttacaggattttaattttctcttactgctgcaggcaacgtggctccctcaaataatgctctttttcttgtaagaaaaagatcatgacttgtgtgtgtagaagagaagggcattttactaacgtgtcagtctgaagtgtcatctgactcttctttcagccttattggtctgattgcctctcacattacctttctttgttttggaggtatccagagcttggttcttaagaatcagcagaaaaaagaaagtacagaggacaggaaagaatccatagactgagaaagggaaatgtaaagattatacacagtttgacccaattgattattgttttattatatatgcatatacaagttctgactgaaaagacagaggacaaaggggcaggggaattctcggagcatgagaaatggaaataggaggattatacaaggttggatcctttaaaaagtcaatcttacagaaaacgagaaaccagtcaatgaaggaacaaggtaataaagagaaatcttatctccatttatattttgtgaagaccattattaataatatttccccttttttatgtgtacaagtttataatttttaaactcctacctattttccttttattgcctgctgccagtgcctgtcttcctagtgacctttacaagaggatccatgagcagagaaagactaatggaagtatgcccagatagtggcagcaaagatgagcctctggaggccattctttggattcagagaaaaagagctggaggggaggtgacctggaaactaaactaagatccagaagtgaacccagacaattaaatctcacagtgatccctgggtgatttccctaaaaacgtatcagcagcgctgttatttcaagccacttaagcaggaaagcaggccttactctagtacattcctacgctaacgaagagaatttccagtatacaagaatgcagaaatactcaaacattttacagaagagtcatgatagctactttagaatccatttacatttggttatgtcctacttgttattttgtttttgttttttattttccctaccaagagaatggtctcaagtttaatgttgaattaacacttggaataaccattgcatgttcttaccttattgtgctaatgttggacacctcactatatcattttagttgtttgttcagtctcaccataaatatcattgagataatgatgaaagtgcctataaaacacctgagatgcactaggtgttctttaatattagtgatctgcttgcaaataaaacacactgtgttaggcacagtgaaaactattaagatcaattaaaatatagtctatcccttagaaacatctcagtctaatcgggaaaataatataggcatgtagtcatagttaaaatggaaaaatattagataaaactctgatacagtctttttgctttgattttgaaatgaccacccattgctcactcccagttccctcatagcagcccaaaggaatttaccttatcttctttatctggccgggtcaacttctaatacaggtgacttggcctagaaagcctgctgactctcaattttcagatattctgacatgttcccatttggatcagatgagcttggctttctataattgagtcacacagcttaggtgagagttggagactgtaatcccagtttttggaaaagtcaattgttgcatatttccagatgtagataatcctcttgagtatatacctcaatagtaaattaattaatttatttattttagaatttgaacagcaggggtgggggcagcttgaaagagtcttattttaacttgtttttttccccccttgggacacggtctcactgtgttgcccaggttggagggcagtggggcgatctctgtttcactgcaacctccatctcctgggatcaagggattctcccacctcagcctcctgggtagctgggactatgggtgcatgctaccacacagctaaatttgtattttttgtagagatggggtttagccatgttgcccaggctggtctcaaactcctgggctcaagtgatccacccacctcagcctccccaagtgctgggattataggtgtgagccacctcaccaggccatgttttaataccaggccgtctttttaaaaaatcagttttagcacttttatctcaccatattcagtactttaaatcagtcatgtatttgatcatcaggaaatgtactgacaggtaaaaagttgataattaaattttatatcaaattatactacataacaattttatcaattatgtataataattttatgtaagctatataaatgaatttatatagagaaataaatttagagcaaattacaaacatgttcttttatacataaatgcttcagtatgtatttcctaagaacaagaacatccttttacataattcttaaattataaatatcataaaatatataattaaataattacatattaaagtaaattaaaattgtaacttaacatttaatattatgtgtaattaaactatgtaattataaaaatcaagaagtttaacctacagtgtttatataaattttattggttttccctgtaatgtgttttgtaactgttttcttcctaatccacaatccaatccagaatcatttattgcatttagatatcaattctctttattttaccttagtctggaacataacctcagctttctagacctttacattttttgcattatgaagaattataaaatatttgatattttgttccattagcacaatctctagtccagtcccatttagagtcagaattccaaacatcttctaaattaaccctgtcctcttatccatctcaagcctactttggactggatgcctatcatggtaaaggaagaggaagacaacgtcagatagttttctgttctttccctctattgtactttatccttcccctcactgctgtttctttgtcgactaactcttgtttctgacctccttagggttggcagaggggagaggcaggagggagggtgagctacacatcactgttgttgcagtggctggcattgctcatctctgggtttactaagttcaaagaatactctagtggaacatctccacagccttcagagattcctcacaagagcttctggttgcagcagtctctctcctcttgctggcctcttacgacatattctcagcttctgaatgtgatgggtgcatatccatcttctctctgctgatgtttccttgctcccagatgaagctgtctcagtccatcagcatactgcatggccagtattcactcggtccatgggaaacaagcatcttttgctttgttgtctttgaaagcacagttgccttctaatatggctgtttcttttccctcaacagctaagcaggcagttccattaaggttgtcttagaatctttggggactatgagtcaggaacctattgtgcaaactgtgggggacacaaatcaaattttctgaattttgtattgaatcgtctctcttacctgattggaggggaaggaaagcaatcttctcccctccactcccgcaagaagatcagaaaaaaaataccatgccatcattttgactacctcaaagagtggtttaatatttctaatatatgtgttttcttacctttttttttttttttttttccaagacctgattttgccaaatcatttgctcatcttacttggtgggcaaacatttccgttgggaatgtaagagcatgtgccctgctattttggtttctgctttttgggccttctgccaaaactgagacagaggcccttgaaacatccaggatagtgattaaatctagcaagtgcaattaagtaaacatttccagctcctgtcctcctttagagaaaaacaaatgaagaaaaagtttaatttctagagggagattttgtgcatgagcaggactaaatctaataatcccaatagtctggcatatggcatacgtggatattcagtgagaatgtaaaatcatcctgcaagcttttctgtatttatttttggggattgattacaatctctatagtacagtgacttctctacatggattacaggagactgttgtctcagtccacagttcttggaatagtcatatttctgagcaactgattttttttaaccttatggacactgaattgattgtttttcacttgtgataactgctagatctactggagctgagacggtttttcacttctagaaaatgtgcaaaactgcaagacacatgtttggtttacaatttcaacccaggcttttttattttactttttttcatttttctttcttccaatgtcctcacttttttcttgacatgtagacttgtatttaaaaaatgatgtttgggaaaaaagtaatgtatgagtaaataactttattggaaggatagctattaacactttcttttgtatcagagaaggacctcattcccagtttctacatgccttagggatagaatgggatatttttaaagtatgtaaaaggataagtattcttatatatccctttatagtggttggggaatcatttaaaaataaagcaacacaaattggtaattgttaggggattgtcatgtgtttgttttttaagatgagaagttccaaagaaacaagccttatttccttttcgtggtattaaacagctactgccaacagtttatacagagccacaaccatcactgcagctgaccctgaaaacagaaagtgagggccatccattaagaggtccacgactgcactgagtctatgatgcgcaatgtagtggagcagaaatgatgcttgctgcacatttagttgagcctaggagagcagggccctccatagacactagtttgaacattgctaggtttaaaatggtttaaatataagatggaaatctgcacactactagtgtttgtattcatattttttatttggaataacctgtctgtgtatctatgtatctagttgctttagtcttctcatagaattagtataacagttggttatgtataataattatggaaaagggttaatcaaattattacatttttacttgaagcctacatcacagcattacaatggaaagctagactgttactattttgttttcacaagtgtttggtgcatatttgattcatttcagtattgttagaaaattaaactggcattatttttctgatgatgtctcacattgtcgtcactatagaaatgaggctaataatgccagctcattcgaggaatatagcttcaggaatgaattgttttttttttttctttatattgaaatggtagttttttaatagagatactgaatggtgtatttcagatatctttaaaggaacacttaattcagaattgagtgcaaaaaagctgcagaagatcattcatccatgtagatacaattatattgtggtggataatggatttgtgttattcttaatgtctatacatggctacagtaagactgaagttgtttttataacttttcagtacattgaatgaaagaaagtatgacagcagaaaacatctgataaattaaatgtgacatgttttttattcatataaaatggtttctgagcagctggtaattgtgaatatttcagcagtcatttttgatgtggaatacttcttctgtggtaaacactaatgagttgtgagttgtacttcatcaaattgacagtttccttacttttgtaaataggcatttgatacaccttgtaaaagctggtaaaagacactcaactcaccttttaaatgcatagaattttccccttattctctttctacattgtgccatccacttttcctataaggaagataatgcaaagaaaggctaccattcactgggagcttaaaaaattcccagaatcattctgggtaccataatatacactatccattcataattcttacagctcaaattagctcaaaggaaaaactaagactgtacattggctgggagagtaaacgagtgcaccaagaaattacccgtactcaggttttgtaaagtgtcttaatgtgaaatagttgtgtttcttgttattttaaatactaggtatttttagagaatgagataccttacattcctccatcttaaaaaaaaaactttatttataataatcctgtaaaataggaatttgatgtactattctcattttataggtaagagaaattacatagagatgaatgttagtcacagagtgggaccatagtgcagactcctgttctttaatatattgtattgtttttacttagagaaataaattaattgtactagggacatgaaagaacatagaataagaattgtccgaagagaactaaagatgttaagattaattaatcaggaagtatattttaacaaatctaagaggataaaattagctgtggtactgcaattaaaaaaaaaaaaaaacctcttgaaacagattgagtattattaacaagattaacccaactcattctttggggagggaacattatatattaagagctctcttaaaacatgaataatgctacatattttgagtggaagtgtaacttagtgctcaactagcacagctgaattagtacagctgctgctagactttcaaatcaaacagccctctttggtcttttttataccttggtattgtatataatatttctgtgagtaaagagttctgatactaacacattgtctgacatagtcatccatattttaatgtaaattacactgataataatttagaataccactaatagacatgatagtgatagcatcttatgcttttacagaatattattattttccaaaagagttttattttgatggttctgccaatatgtcaaaatcagtaacctgcaatcccttcaaaaacaagtgtatagaaattttaaaaatataacaaacctattttataaaggcataaataagttcacaaaatataagaggtatcctcagaaaccaaatacgaacaagtcaccaaaagtcagggtggcgcagacatgatctgacgatggggttaactagagctaaggggattggggtcaatgttctcagtccagaggtttgtgatgtcccatttgtacacatgagcaaatttacatcttagttttttgcataaattggaaccaccaagagactgcatgtaacctagatgtactagaacaggggtccacaatgccctggccatgaaccagtaccagtttgtggcctgttgggaaccaggctgcacagtgggagatgagtaacaggcaaaccagtgaagcttcatctgtatttgcagccactcccaattcctcgcattaccacctgagctctgcctcctgtcagattaatggcaggattagattctcataggagcatgaatcctattgtaggttgtgcactccttatgaaaatctaatgcctgatgttctgtcattgtctcccagatgggaccatctagttgcaggaaaacaagctgtgggctcccactgattctacattatggtgaattgtagaactattttattatatattacaatgtaataataatagaaataaagtgtacaacacatgtaatgttcttgaattatcctgaaagcaccccaccccccagtttgtggaaaaatggtcttctgcaaaaccagtccctgttacaaaaaagcttagggactgctggactcgaaaacatttcccccgtaagcatagggatgtgacagaaaaatttgcagtaagctgaaatcgacctatgcctcttcctagttctgctcacaagacaacttagtacgaaatctagtgcttcctccatgagttgttctttcattttatgaggacagttatgtgatatggtttggctgtgtccccacccaaatctcatcttgaagtgtagcttctataatccccacatgtcatgggagggacccaatggaaggtaatttaatcatggggatgggtttttcccatgctgttcccgtgatagtgaataattctcatgagatctgatggttttataaaggacagttctcttgcacatgctctcttgcctgccatcatgcaggacagggctttgctcctcctttgcctttcaccgtgattgtgagacctccccagccatgtgaaactgtgtgtccattaaacctctttttctttattaaattacctagtctcaggtatttcttcatagcagtatgaaaatggactaatacatcaggtctttgctaggtcttgccttttctaaactaaacttaaaaaaagtagtaagaacacagtgtaagatctactcacttgatttttaagtgtaaaatacagtgttattaactgtgggtacagtgttgtacagcagatctctggaacttaatcatcttacataactgaaacaccatatccattgaactgcaactccccatttcccttcctgctaacccttggtaaccactattctactctttatttaaaagactttgactattttagatacttcatgtaagtggaaccatgcagtatctattcttctgttactgacttattttacttggcataatgtcctccaggttcatccatgtcatcacatttggcaggattcccctcctttttaaggctgaataaattccatcactattcaagtcactattttaagacgaaaaaatcaattgcttgtatataatacattttttaaattcattcatcagtgggtagttaaggtgtttccatatcttggctgttttaaatgatgctgcaatgtgcatgggagtgcagatatctcttctagaccctgatttcaaatctttcagatatatatccagaagtagaattgctgaattatattgtaattctatttttaagtcttttggaattgctatactgtttgtatacaggccacaccattttacattcctaccaatactgtataatggttccagtttttccataattttgcaagtatttgttgttatttttggtaataatagccattctaacaggtgtgagatgatatctcattgtggttttgatttacgtttccctaatgattagtggtatggagcatcttttcatatgcttgttgaccatttgtatgtcatctttggagaaatgtctattccagttcttcctgttttctaaccaggtgattttttttttttttttttgccattgatttgtaggagttttataattttggctattaactatttatcagataagtggtttgccaatgagagactaaatattaccattttatttaaatattatgtgcacagtcattagtattacaatattatattccccttgctcttaactgggtgaagcgtgcaggttaacatgtgaaattctgtgctcaaattctagttctttgaatctagtttccctgattttaaaattgagaggattgctacctgagacataaacaagattaggaagcatgtaaccccttagcccctgatacatagtaaatacttaacaatttccttcttaaaatgattatttttctataatgtatcggtatcgcatttatatatctacaattctgttataacataccatttgtttacaaactaatttaaattgcccttgaaaaagttaaccatatataaataagttaattcagaagaatgactgcttgttttatttaaaatttaaaacattcctaataatagaaatacatcattcttgaaaatatgcccatagaacccatagaagcttcttatgtaaggattttgtttgaaaatatcaatgtgaaccagctgtaaagataaccattgtacagatacatttcacccatctagaagtcactattcaagtcactattccaaagtaatcaatatctatcatttgagagttatggagaatttcccatatgtagaatgtaatagacaaaagtagctcatacctcataaaattgtgataaggaggatttaattaggttgcacatgataacctagtgtaactaacacagaggatagcccatagtaaagattagatgcattattatcatttgcattatgataaaataggcaagaaaaaatattgttaataagactggactgacaagataaatgaaatatgaacacacacatacactaaagttgatgaaattcatttatgggagaaccaaacctttacttagggaactgtaattcagaaaataaaaaggacaaaaagagcagaatctattaatgtcagtcaagttcacagcagcaaaaattgttaacaatgccttaacagtgagtgagggtacagagcatcgttcaatatatatatatatatataaaactcaaaaagtgtggtcctcccaaatcatttaatatgagaacagccaggcctacacacattaatcgtctgtgaaggcatcagcacagtccaccatagggccaaattgatgtctatggtttttattttctgggataacagaggaatatataatacactgaacagaaaatgaaaattgagcaaaccaaaagctttggtgcttgaagaagcgaatttctattatctagaaaaatcactgaagtaggtgtttctttccaaatgatgatggataagccaagcatttctataattgcatactgaacagataaatgtttgacctaggcttcatatgccaattactcctagatgtggtacagtgggatccagctagccaaggtaatgcagattaatatcatgtcacttctgcatgcctgggtaatatgttgtttcatcagatggtgctttaccttggcttcctttggtgtatgaacatattacagcagaagaaaatggtctgggtgggaaaatctgatgaagcaggtgatgtaaactgtctgtaatcactaaatataatgagtggacaagtagaactcctgttaggcctctagcttttcctactgtttggaacttgaatcaaaagtcataatagaattatgccaatctttcctatttttaaagtgcacagaaattctgcaaagtaatatgatacttagacactgaccatttggtaggcagcacagaagtaaagaagtcactcttcattcaaagtggatcacagcattaacagctgtgattcttgctattaaagaataatttttatcaaaggagtatattttaaagatttagttctataggttacttctctatgaaaatttaaagaaaatccttccacagagaggtatggaggatatttactgtcaataggtttatactattaatgagttatattcatagtggtatgaaatattagttatgtcagcttcttacaattcatgggacttttgcagaccttcagaaatgcagataagcattgctctgctcactttgaatatcggatacatcctccttgcactttgaaaagcaaatagaatacatacatttatcaatgctgacattgatacctttctacatagctcagcaaagaatcatccaaataatacaaaattgaaaaactggaaggctaaacaaaataagccgtcttatattttacagttgaaatacttagatgtaagtgaattaagtaattctacccctatataaagtgatattttttcctcctcttaattctttctttcaggaagaagcacagataaacagaaggctaacacaatatgatttatttatttatttatttattttatttcatttttttaagaaaaggtctcactctgccacccagactggagtacagtggtgcaatcatggctcactgcaacctcaacctccagggctgaaccattcctcctgcctcagcctcccaagtagctgggactatcagcatgagccaccacactgggctaatttttgttgtttttgtaaagatgaggtttaatcatgtttcccaggttggtcttgaactcctgagctcaagagtttttttgtttgtttgtttgtttttttttttaacaattgaaaacgaaacagaaataacttatataaaagtttaaagataactggatatgacctgcggtgatatatggcaattgttttactgattatgtttagaaaaatccccaacgtgttcaatttcatattaaaatgcctagtatttatggtttataattatcatttttagtgcaatcttgcgcaacaggaatttcattttttataaagttatttgtcacagtgggaggatttgttttctctttagtttatattttataacaattgcaacccatgatttcacagaggagactatgattaggtataatacagattaacctattaagaaatacttgtaaatcttacaattgatcaagattattttgttatgcaaaaaaatagaaaattttattattattgaaagtgctatcatcatacctttaaactttataattgtatgtatttttcctttattcaaggaagattatttaaagtagtgtaacatacctacatactttcaggagctgggcagcgacataagtgaataaatgagtctgttggggaaggtgtaggatgattgcattaacctgcttttagtttgacatagtaacacctacctcattatatttactttcttattctgggggtgtgtttgtttcgatttaatttaattttttgtaatttattgtgactaattgtggggtacagagttatgatatatgtatgcagtgtggaataattaaatcacactaacatatctatcatcttaaatattaattatttaatctctcaattgcaactttccaccctttgataacattatcccatcccaattcccatccccttaccaccaatctaccctctgctactatgagttcaacttttttagattcctcatatcagtgagatgagtggtatttgtctttatgtccttggcttatttcactcaacataatgtcttccaggttcattcatgttgttgcaaattatagaatttccttcttttttcaaggctgagtaatattacattgagcttacaaaccacattttctttatccattcatccactgatggacacaggttgatttcagatagtggcttttgtaaataatgctggagtgaacatgggagtagatatctttttaattcctcatgatatatacaccaaagtgggattgctggatcatatgataattctagtttcagtttttctttctttctctttttttttttttttaggaacttccatacagtttcccataatggccatactattttacactctcaccaacagtgtgcaagggttccctttctttacattgttacacatctgggagacaaacagaacatgtttatggggtgtagtgggcctcagaaagtcaccaactatagcctcctctattacgttactcagtaagatagatgctcccagggagatgttaggtcaatggtatctgccaacttttcattagaaagtattaccctcccctcacaaaggcagtttagaaatacttcatcatggaagtgaaataaaatgctgtcataatttctctactatgacatatctacctcagtctcttcctgttcaatccatatacacattacccttgccccagggttatctttagatacatgagtctttttatgtattctgtaagtagttaatggatttaattcaatgaaatgatatcaccttcaaaagaaaatctaaactcttagactattactaaagcagcctttgggaagaccctccagcatctccctctcattttcatttctccctgtctaccttccttcacgccctaatatatagaaacacatctcattcacttccccactaatgtaaattgagcaccacaaagaagtcaggcactatgctagatacaagtgttaaatatgagtgaacgagaaagacttcatcctactcttggggagcttcacagaggctagtggggttgacagatattaatcaaataattatgatgcatgccgtggaaaagtttaggtaccatggactgtgcatcagttttccaagttgctttttactattttactcatacctgccctttccatctgtgaaaccttcactcaaccctccaatcctcgttgatttacctccttgggacaattattataacttgtatgcatttctcttattcaaaattatcctaatgaaatgggttgcttggttgcttatatgttttcacatgagcaattgctctattttctcttcctttgcagatatagcccttggcgaggtgcctggctccatagtaagtgttcaacaaatgtttgaataaaatattgcattgttgaattttaaatgtatttaagcaaattgataaccaacatctgaccagatttcccaaatttagatgcaatgtcagatgcttcttttaatggtgtcagagattggctgacaggcttgcctgtctttaaagtaatttattacccatgttggttttttggtataaatggttactgtttgtcattggagtatgtttgtattcatggtagagattaaatacatatgtattgcatgaattaacaaatggttatgctagttgtaggaaagattgataagtgaaagtttctaatgctctttttttgagatggagtctcactctgtcacccaggctggagtgcagtggtgctatcttggccaattgcaaccttcgcctcctgggttcaagtgattcttgtgcctcagcctcccaagtagatagaagtacaggtgtgtgccaccatgtccagctaatttttgtagttttagtagagacagggtttcgccatgttggccaggctggtctcaaactcctaatttcaggtgatctgcccatcttagcctcccaaagtctaatgttctttacaggcctatgagtattttatgccagaatattgattttattggagaactaaaaattgatacaatccatagcttgaaagtaaaaatgtcaaaatacttaagaccatacacaaataagtattctaaaataaggaattgatatttataaaatatttttaagaaataaggacatttggccaggcacggtggttcacacctgtaatctcagcactttggaaggctgaggcaggtgcatcataaggtcaggagttcaagacctgcccggccaatgtggtgaaacctcgtccctactaaaaatacaaaaaaacttagccaggcttggtaacaggtgcctgtaaacccagctacctgggaggctgaggcaggagaatcacttgaacctgggaggcagaggttgcagtgagctgagatcatgccactgcactccagcctgggtgacagagcaatttaaaaaaaaagaaataaacacatttaccattacagtattttttagccccccaatcttgttattattaataacaataataaaataataagcccttgacttctttactttgctgtccttttcatttattttgcatttcttcattttccttgtgcagattttatactctgctatcctcagccaccctatccgtatcatttctatggtatctctgacctcaactatgtttagatttctccgtcttcccctaattactggcatcttccttttttatgtgcttctgctttctctgattttgggcattagatccttcctaatctgccctctctaaggttaatatcctgttcttcttggttagttaggatctcttcccatttagttttaatctaatatatccttcttctcgtctctcaaactagttttgcccattgcttcaccttggttctaatccagggaaggacataagtccctaatgtctattttctgagcagacaaaataaaatatgcataaactgtatctgaacattttagtcctctaattatttgtgctgtttcactgcaactgaaatgaaaaactccagcctctgcacaggattagcatcagcagctttgcctcttaggctctattaaaagaaaatctgtagacaaattaaattcagcaaagcttgctatttgagtaaagaacaattcatgagttgggcagcacactgagcctgtagaggttcagagagctctccccagtagtagatagtatttatagacagaaagggaattgatgaaaaaaacccagcttgataggttaaagtttagcatttgctttttttgggcatggtgggacaagacatttgccttatatggacctaacctgatcagttggcagcctgtgatggctggagtttggctgctgtgattggctgagacttagctatttgttggaggaatatactattaagttagattacagtttatttgcatactaagtaaggttgcaatttgctacatatataggcagctttaagacaaatttaatttaacagctctattgccaaaatcacttctgaggaagtaactcactatttggtatctttgcaccaggctatactgtcaaaaggtatggattttcagagacagagtttgctgactgagtaatgactgagctgaaagttggcttgcatgcactttttctgtattttctacttacattgttgcatttcacttaccttgcaagagctcactgcatgtcccactgacattcattcctcccaggctattttgcacccccattcccatcagcatcactttacaaagtgggttattttacccagccagttgtccatttaatgtacagaagggtctgtataaagggtctgatcaaatcattgcacaatgcccaggcaattacaccaccaggaacaattactgctttatcgaccgtaaacatttttctgaagttaaaaataacaagaaaaccatattccagcagtttctcaaaaggtattcaatttaaaaatttaatccaatactacaaatatttatttagaaccaacttttacaagttctgagcctataatagaaaattgtgagggaaaaggattatggtgtatgtatgttcgggtggtgtatgtgtgtaaattatcataagatgcatggaaagttttgacatttctgggccagggttagggttaggtgagttaaccataggttaactatgattaactaacctgtgattaactcacctatggttagagttgccctcaattgtaggctaagttattcaggcaaccctgaaacaggctgggtagggaagagaagcctaacaccactggtttagatttgctgcttaaggcttgggacaagtgtgcctgagatcaacctatggatagtccgaggtccagggaacagccattcagaggcaatttttcttggctttccctggatttaccttcctatttaagttttatcatatgtccagaccacacttagaactagaaccaacatttaaaacccagtttatttggctaggattccaggtactctatttaacacttaccacccatccctctccagggctaggtctacaaattagatgattcattcagaaaaatgctattgcacctttcttatctttataacagcaacttgtattgtgaattttcatgagtacttcacgtagattatacccagttctcacaggaacattaggtattacagtttaagaaactgaacaaggggaagagctgaaatccaaacacacatcagtctttgactaaattttggttatcataagttcctgagaactactgctgtcccctgcctaccacactggacatctttggttagtaggtcatccttatgcagttacttgagcttcaaattctggagtctgccttgatattttctctccccccacctacccttatattcagtcattatcagtcattgttcttaattgcaatcaacagatgcaaacacttaagtatcaaatgtgttcattataatatgcttattagaatacagaattgacaagagttctgggaagccaagtttgaggctacatcttcaagagatatgcttagaagcatatcacaaggctggccttatatgaacatgagcctagtaactaccatgcaatgagatggaggaatcacccatcaccttaatgaggttaggcctgagccaagaacttgaccttgcatcattttggtcatcattgtctctgctgctgtcaccaagtatatccagacaccactgcacaactcccaatcccccagcaaaaatataaacaacttcttcccattactcccatttgaatacaagtgtctcttgatttttgcatttgatttctggagcctaggtcatatgtctgtatcacaacagcaaaggaatctgcttatttcaagttgagcttctgaactggaaaggtagaattcacagtttgaaaatatattcaggtaccaaatggcttttcgtaagacactgggcagccccatgtatgaccaatatccaccacagttggctaggcctatagctttattcccccacataccctgacactcccaatatcttctgcagtcaaccagttcacagggatctaaaatgcacatcaggctccaaatgtgaatgcttataacagtttgctatactgcaaaactgcagaaatagttgctgttgagtgctgtttttcaagtgtttttgtaaaatgaagaatttttttaaatatttgcctatgaatttagtttgctttatttttcttgttttataatgttcatttgaaatctgtattgtccctggtcgagacagtactacactggtctgcttgtgggttccagaatgaaataaataagtctgtaagaaaataagcaactaagtaaattagtaagtaaaaacaagccatgcatgtattacctcagaaccagggcactagtaaacttcacaaagccacgttaatcagagtgctacaccatttacagtgacaagaggccccttctcattattattgggacaatactgccaaataagcaaaacacaaataaaactgtccagtggaaattggctaagagtaattaggggcaagtagttttatgtagactaaaatactataattagaagggaggatttggagcactatttgaaggagagaaatcaatagaagagttgctttctatgctccgaagagctttgccagctatctttgttcagtggtaaaatagaattattttacagtaggaaataaacctgggcactaaggatctctgttggggagatacctgggactgccttggataaggagggggtgagcggattgtggcatgacattgtttttcataacatgttaatagcaaaacaaaataccaaaaataataatgatgaataatttattcctgtttgttctcggttaactcttctttagaactttaaatatcaatatcgaacagtgttacattaaagtaaaatgtttatttataacagacaaaaccagttctatactaaataataacttaatgtcatcttgaatctgattaagtagttattttgttaagaatgttctaaactgatcaataagaggaaaactttaagtattctcatatattacttttctgaaactgtcatgatattaatattatgtacttatagttgtggtttgttcctcaaactattacttaatgtgatttattttaaatgtgaattttgcctttagacattcattttaaaaaatagcctattctttattatttttacttagaatttacagaatcctgtggtacagagggacttttccagctcccaggggtgcataaatttcctttttctgtattactggctagttgatgattgacttgcctctgaattatccctaccatgtggccaactagatacccttcaatatggcccattttatctttggacagttctgatagtctcccatattgttaattcgattttttttctcttggcagcttcattttatttgtccttgttaggtctcttaagactaccttgttttttatttttatttgttttgcaaggatggggtgcacaatcagtggtacagtatggttgttccataactttattaaaaggcatataaagtacttgatgctacagagtatctagaaatatgcgttgtgcttattcatttgtgacaataggtattttggcatttttaatacattcattacatttgcaatttaagaagcaaatgaattaagttcatgatgactgaatgggatgggagttagagtttgtaaggtgacctggagaggttaatttcacagcgtgcagtaattgtgaatttttagatggaaatatatgtgtgtaaacctgaatcttaccccacattggagacgaagctgcagagaaagttgttcttttgaccttaaagcaagttaaatttggagagctgcccaattaagaaatttttatccacaatatatttttaatttaattcttactttgtggggatattaaagactttttttcccctccaatttgctatttcagtgctagtaatataaatccattgctaaatccagaggaaaagatttcccatgctttggattttacccggttagttctccagttatactcttaagtaatttagaacctctgaaaaaactgaggttaataaggaataagaaattaataatggaaactaataaacaagagatatggaaattaaaaatactcaaaagaaacaaatccttgaaaatcccaacatacagggttcaaataaaattaggatatttgaagggccatttaggatatttgttatgcttttgtaatattcctgagagtgtataccacttttgttcctattttacaaatgaggaaactgaatgtcagacaacttaataactttcccaaagccacacaactaacaggaggtcaagactgaatagtcagactaaatctggaattaggccgtttttagaaactattaatgaaatggaaggggaactgagatccatcaaatgcaaaaatgaaaactatatcataagtaatctgctggcatttgatgcttatttatttctcattacaatcctgtgggttagctattgttatcttcctttttcacataatgaaacacacgtttggaaaggttaaactatttccccatgttggccatggggaactgatagtcagtagacctagcatttgaacattgagctctggactgcaaatcttatgtcgtttttttactctgcaaaaaattgtaaactctttttagtaagaaaatactgtatttgaataatctatttcatagaaacccaagttaggtaaggtgccaattgccgcgacccctgttggaccacccctagacgtttccaggacacctgcggacttgaaagtgcccatgctaccatgctgcctaaagtcattctagttttttgaaactataattacaaataatttcccagatacaatcatattaacatatacatacacagtccctcccatgttactgtcattgattcaacatatgtttattgagcaccctctatgtcccggactgtttcgaggtgctggggaatataaagatcaaattctggcccttcatagaacttgcatggtttttactcccatcgtttagcccactccagtgagtcattcactgtactgtcttggtgatatctgtaaactttccatctcctactagcttttaagcccccgtggtacagaaagtgttttattcatttttgtgtctcccacagatcacctgccacagcaatattcccagtgcatctcttcttttacactattttcaatcacaagactataacatgcagcttcgtaaaattcatcccttcacctaaatagattccagctgtgacaatgtttataatttccctgtagcttgaaattttcatcaaatttctacttttagatatgcaaatttacgattaatcaatgagtcactgagaaagtatgaatcattttttgttcacagcacgtcaagatatgttacaaggtgcaagacttaacattaactgcctttctaacttatgaaaaaaacattttaaccacctaaaaagggtgttttggtgagcatttgttagaggactgggagttgtttctctgagcagggttaatagagctgagtaattttttacttataaagtcctctaaaaatataaatatttttgtctttatttgatagtgtcataaatgtctttgttcctctttgaaagccattatataacaaaaggatcattttgagtaagagatttttgactttaaagcatatagttatttgttattggatatcccaggatatcttttgaaagtctggagttgttgtcaatgactcacagtgacaaagtgcttttgtgtgtctttatttgcatgcctgagggaatcactatttttaaaaaatagattttttttttttcacacagccctttaaaagaaagtgtattgtggctactgaagaaattcccagagcaatgttaagaattacaatttgcataataataatttttcctttgcctcaactcagtgaaagccaccctgattaaaaacagtttgctggaagttgctagttactagaaggcacttgaactaaatgtatttggcaaatttgtaacccaattctgggatgcaactctttttttccctaaggcccatctcagcataattctcccttaaagtaaaatataaaatcaactctagacagctcttaggagtttttactggatgcttttggtgtgtgatgggattgggattagacaccatacaccacaaagtaaaacttctgaagaaattctcttccagctttatctggagtcagatccttcaagacaactctccacagctctatttccctgatttctcctcagtcactttttgaaaattctagctgtagcttcaggactttctcattccaagttggcccccttctcctacattctgaattattctttttctatggcatgtgattcattcttatataatttaagttaacctcttaagacttctagtgtttctctacattaaatatctaagtcaatacaacggaatcctgggagccaagctgagcaaaggaagagtcctccttagaagacaggggtagctaaaagcttatgtctatttatactttgggatttttatgtttattacactgagagcttaaggtttcagttttcttttggttaatggttctttagaaaagccgcacaattaggacctcacaaaatagctctacctgggtaaatgtaccaccttcctgcgagaaaccctcagctttgtaatgaatcctgcatttttgtcagcataccaagagtgcttctatctcatgcgcatcacaaatatacaaccaggatgtaaaatcacagtaataatttactttggaaattatgacttttgagaggacaagactctgtgtttgatatgtctacttcatttcctccatgaagaagacgtaaggagagagccaaattttactctaggaaagttatttgatatatctagaatcataccaaggggtcttaaaagttcattcttccattgtttctatcactgcaaattcagtacttaatctgagacaaggactctgccgggaactaggactataatgatgaatatgtcacatcagctgccccatatcgcatagtttagtggcagaaacagtattaaattaagaactcaaactaattcagaaggaagaacagtgttcagtaagagtggataacttgtggctttccaaatatatgggttaggaaaagcttttccaaggaagtggaaagtgagtttgtatgtagtttgtatgtaggaatggagacaacatagctcatgcatagatcatgggattgatcttatgtaccagcataagagtttaaaattttgtttttgagcaaaaggaatttatctttttctaagaggaccaatatggtcaaatttgtattttaaaatggtaagtatgcgatataaagagaatgtggtagagggtgaaggagattcagtaccattaggagatgatagcaggaagtgcagatagcatgggatggtcactaggcttatgaggatggaagtggaaagtgagaaatctagatggatttcttcatttatgtgcagtcaaatcaagagcacttagtatctgattagaagttggaggtgaagaggtagtgataaaggtgactctgaggtttttggcattaacagctaggtgaatggtggtatgaaatatagaatgatatggtttggatttgtgtccctgcccaaattgcatgttgaattggaggaggggcctaatgggaggtgattggatcatgggggtggatttccctgcctgctgttctcatgatagtgagtgagttcttgggagatctgatggtttaaaagtgtgtggcacttccccccttcactctgtctctctcctgccaccttgtgaagaaggtgcttccttccctttcatcttctgccataactgtaagtttcctgaggtctcccagtcatgcttcctgttaagtctgtgtaaatgtgagtcaattaaacctcttttcttcataaattacccagtcttgggtggttctttatagcaatgtgagaactgactaatacataggtaataaccaggtttgaaggtaggatattaaattcagttttgtatcagttgcaattgatttaggctgcataaacttaaaacagtaatagttgttgaaaccatacaaactccccttctttcacatatcaagaagatcaagagggtagttccaagacgatacactggttcaggcccttttattccatgcctattgcctcattgctacattgctacaaaatggctacaacagacatcatgttatcattaaaggcagaaggatggaacaggaaagtattaacatgctctcctcttgttcttatcccttttataataagcaaattttttacctccaagactccagaagattcatttataggtctacccagccatggcctctctaaactgcaaaggatgtggactgtttagaaaaggggaaagagatcatcacaattagcttagaacagttgttctcaactctattagacaccaactcttttgattagtaatctgaaatgaaatttacagatgtaatttacctacacacataacctaacaagaaaaaatgttatgctctctttgtcataacacagtaaaataaaagaatatgtaaacatttgggccagattcaaattgaggtaattggattcttgcaaatatatatatagaataatagagtaaatagtgtttgcagcaatatatggaatcacaacaaacacagcagcagtgatgcagactgatatatttttgctgtaagggcgtcacaaacataatgagtccagttactgttgctttctctaaaatactggacaactcttggtaacattccgattaagacaatgtataatgtttcctgattaatattttacttgcaatcctgctgcacattggaaagtggtaggaaatgcagaacaattatttgataacacacttatgtcccttcacattgtaggatgacacttcttagacctcgctaacaaatgccagtaatatccccaatcattgtgacaagcaaatttccaggaaaaaaaggtataatttacatactatacatcagaatagaaatgtaagatcaactgaaagcaaagaaagattgatttccttgattttgagtggcatctcatgcattcccacttactgcctatagctgttacagacattcattacaaagttaaattaaaggttactctgtaataatttctcattatatgccaagccctaaaagaatctaatgaattctgtctaggataacactaattgtaaggttaaagtttcctggggaaatcttgcctggtaccttaggcactggggaaatgtatgctagtgatttcaaagtgaattaagaaacaagtttttaatccgtcttttcaagaattttaatgaaatacctagtttgtatctttagaattctagaaaagtacctcatcattttagactgtttccttttaaatcattggcatctataggctaccatcctcttgaactagatagattttaacctttttccttattcattctaatttagcttgtcgtatatatataaatatatatatttatatatttatatatattttgatagtggctatttgctcattaaaaatcaaaagttaaaagtaattaatctcaaaaaatggttaactggcttacctgagaaaaaataaatttagttggtaaaggctgatttaattaaagtttatatgttttacatttcctttgctccatgatggaaataagtatttttctttatgatgtggttcgccatctacatgaacattttaataagagaaagcaaaataattttgaagaatacattagtatttgtaggagccattcatactgctttctgcatttaaggtaaattagaattattcactaagtcaaataatgtcaagtagaaaacagaaatagatgttgatgaatgaattaaatatgattaggcatattttattcattgtttttttcattttgaactttttaatgaagtcattgaaataccaagtcatggtcataaaatttcttaattcctcttaaaaaattaatttaataataaacagtcatttaattagtttataaagcaaaattgaaacactttgagtataggacttaatagtggaatttagagagttccccagaactcttcttagcttttaggctcttagaagataaaattgtgtgtctgtgtgtgtgcacatgcaataaaacaataaaatggcctactaggaatacatgaaacgatgttgtttattgttgtgatgtttcagataagggaatataaagtaagattgattagtaaaagatgaaagaagagattagtgaatgatggattagtaaatgatgagcgtggttttgagcaggggcttgaagaaatgatgggtatgtgaagcctagaatactgatatgaaattacatgctgagaagaatatggagaaaataaggcactcctgaagtgcatatgtgagaagaatggcttaactgcactggtgaaactgtgttaatgaggaattgaaaattgcttagttagaaatagaaatgttgagagaatgaagaggttgttgatttaatgtcttagatgtggataacaaaaatgaaagactcttgcagagattctttaggccctagcattataagaactatatgtgaggtagtatttgtagtagcttattggagaagtgcagagttggaaggatccagaacatatgtaaaattgctgagtactttacgcattaggtgatgaagaactagatgattaaattgatggcaaatacttaaatataaatatgtatacataaatatagaaatatatttatgaacctggtaatgacaaattgaaaagtatacacacatgcaccacaaagtatttaaccatatgaatccattttactaaaattgaattaaagaaaatattatttctccccattatttcacagtatgtaaccctaattttattttctttgggaacagggtgggggtttggagggactttgaactataggtatttaaattattttgagagcttttttttttttaaagaacaaacaaaaattttcattattgaatgctattatcttttaggtttctactgaattagcataaaccacttttgttaagttaaccatctatccttgtgaagtgactagaatgaagggttaatgatatacttgcagggtcaaagataaatttgttgtaagaaagtaagacaatattctgtttataatatatttgtatatatagatttaatatttaaaccattaatatccttagctatcttcagtaatgctttctttcacttttaaaaaagaagtattttagtcatgtctaataatcatatctgtacatgttctttgtctaatcactttgaaaatacctatttaactaaaatcactgtagaataaaacaaagatcagactttcctcgtttgtatataataaattaatgcttttaaaatctgaattaactcctgcagtaacaaggcatgctctgagaggaaaatgaaaagtccttaattctaaatttaataatttgcaaatataatctctactaaacaattttgcatgtatacctactagacctgccctgtgttattcaatagccactagccacacatggctttttatatttaaattaatgaaaatgaaatacaattaaaaatatcatgttttttttttttttcttttaactttttttcttttgagacagaatctcactctgttgcccaggctggagtgcagtggtgtaatcttggctcactacaaatctcatgcctcagcctcccaagtagctagaactacaggcatgcaccagcacgcctggctaatttttgtatttttagtaaagatggggttttgccatgttgcccaggctggtcttgaattcatggccttaagtcatccgcccacattggccttccaaagtgctgggattacaggcatgagccaccatacctggccatgcgttcatttcttgctgtggagcacaaagtgttacttgagtatcctttgaactttttagagattactttttgcagctaatgctagaattttgaaaccccagacctttgtcaaccatcaagaaatatagttgatgctaagtaagcacttgtgctggacaataaatgtgaacattttgtattaacccaataaatgttgtcttgaatcttacaagagatgtatccacttacaaacttcttacttataaatgacattgaagtgtttaagaactttacttctagtgagaaagacactgaaaagttcaagaaagttctaatgtgttattcattccaatgaatatcgaagattaatgaataaggcaattaagtaagcattccttcttaatcttgactacaggtaagacaagaggaagcagggggcacaaggatactgtagaaaaggaaattttacttagatatgaagaaatgtttcctggtgtggaaaggaattgcacattggaaggatttattgagtgaggttgtaggatttggggaaatccttaaaaatagaatacatttcaatctctctagggaggtatgtgatatgcctgcaggcattgagtgtggggatgaattagattcattgtcatggttttctcacaccaacaattctatgaatctatagaggacaataaaattggataattctcactgtgttcttcagggagtcaggtttccagactgatttttctagcagtgaatcaggcccaaaatattaccttacattcaacaacttttcaaatgcagtaaagaaaaaaaaaaaaaaagaaaaataagaaatgccagcactttgccattttaagaatcagtgtttcttgagatggattagtatttcctcttctttagtaagaatgaaatgatttgggtctgagtgtaagcactactattggaaggaaaatcttaaattcctattatatagctgagtttaagggaaaatgaatttagtgtgatttgaaaatacatatgaaataatgaattttgcctttaatctgaacagtaaaattagtttcacatgtgataagctctagttgccattttgagaatgttccattagaattacacaagtttggtgtttcagcctcctggaatttgttccagcactccaatattcaagcccttggctgtgctggaaatgaggcagcaggcactcaggtcagagctgcaggcaaccagggatttgggaagtggcccaaatgcactcactggagaggcattggaagaaattgtacagagaagaaactgggacaacagacctgagcatgctgctgtggaggatggggtggctacatcagagttgcagtgaatctagtcacatattatttacatcaaagaagaaatcctaagccataattcatctgaaaagccaatggctgaagtttttgtttttaatctagtgatgtaattcttcgccaggtttaaaatggaaagcagaagcaggtcaagctgagtcatacacacaaggccaaatgtggggaaagcaggaatcaaaggctggaggtaggggaaattctaaatctgcagagcaccatctttgagaaaaagaaaaagaataaaaacctatactggaaggagaacaatcacgaagagaactggtgggtgaagaagttgagataaattgtgcaagccttcactagagataatgtccttttgataggccggttggtgtagtagaagaagcccctgttttagagtgagaagtttattttcacatgctggctgtgagactttgagcaaaatactgaatctctgctccttcatctgtaaaattcccataataattcttattttccaggttgctgtatttcaaaactgagcagccactgtacctgatatgcagtagaaaattaataactagtagtcactgttattttgttgacttttcagtgggtagtggagtgttcttagcatttattcattcttcattcattcagtaaacatttattaaatatacacagaataccagagagtactagaaacagaccacaatcaggagtagttcattagttcttaaattgccttaccatggttaaactatctttagaatatggatcactagcagcagagtatcagcattatactagcaatagagagggaggcaccaagattgaagtgaattgaagagaggaattgcatctgagttgggcaatttttcttatgggatcataggggtttcagatatctcagcatctgatgtgtccctctagagcaggggtcctcaacctctgggctgcagacccatatcagttcctggcctgttaggaactgggtggcacagcaggaggcaagcgagcattacccactgagctctgcctcgtgtgagatcagtggcattagattctcacagaagcgtgaaccctgttgtgaactgcacatgcgagggatccaggttgcacactccttatgagaatctaactaatgcctgattagttaatgatcatctgaggtgaaacacttttatcccaaaaatcatctccccaacccctagtccatagaaaaattgtctttcaggaaaccagtccctggtgtaaaaaatttggagaccactgctctggagggatttctttatctttgggaacagcaccttggctagtcccacaggatttgagaatatattgaaggctttcttatttaaaaaaattataatttgagtagaaaaatagaagaaccacaatgtgtggtttagactaagggatttatgattgggattaaaccttatacaattgcaggacacagtggggaaataagtgtctgaaagggggagattgaaggatcagaaacacacacacacacatacacacatgaacttaaggatcatgaagaggaacttatgaagaattatggaaagctgtcaccacgcttttggtgatgggcatgaagttattgtaggtgctctgggcagctggatataagacaaggcaaagacaaacttggacccatgaggacaaactgggactgatgagcacaaacaagaaaccttgagaaaatactcaaagcccctacaacaaactggaagccatgtctgtgtctcatttcttctaatcgcagtgatgttggccacctgcagaaaaatctggtctcttcatcagggatctgcataggcacatgacccaggactcagaaacagaagggagatggggaaaaggggagtttggattaactaccagtttggctgctttgtcacaccaatgaggtaaaccttcagatgagtgacaatgtgagtgatgtgcgatgggtaatgccttatctctgccttccataaacagtgcatatttctttatgatcaacaacctaataccacacaggaaagggagttctggagaatttgcctaatttactttttagcttagctatgttgacactgcaaaatcactcccaagaagagagaagagatttgatattattcttataagggagcattggcctttgatctaactctttctgctttggcaattctcagagaggtatgaggaggggttgggaagcgtaaaaacggatgaataaggaaggcatcccaggatcatgctggggacattttccagctgatcacctctattctgttgcttcatctccctgaaccctgcaattttgattacagtttctttagaggatgaatacacaccccgctgctgctgaagaatcatagcatagcaagtcaccaatactggtgtaaaagcagtcattcccttaggtgtatctatgtgcaataaagctgagaaccactgatttatatactgtagtagcttttgtatgtttgtttttaccaatgtattcttgactccttaaagacaggcatgcctacctattgttctacaactcaagttacctatagtcttgttatgcagtatctctcagtttgcaaacttaggtatccccaagggccagacataaaccacaaatgttagaccaaaaaagatggtgggattgaggattacatctggagcatgcattgcctaacctaatgccattcaaatgagagaagagaggcatcaaccatcgcttctgacaaaatgagggaggctgccattttcatataaatagctcgcttttcttactagtaatataagattcacttggtataattctattaaggaatcaattataaattatactgtgaccggcaaatggtgttcataaacaatgcagatatttatctgctttgacaataaccctctgatagaaactaaaaacattttaatatttcaatgaagtagcaaatgacctactaaaaatgttctttattgaaatttattggcataagttggaagaaagaaaagaggtatattagcttattcttattcttagcttattctttcacctaaaattataaaatataaaaagtttaataacatgaaaagtatgaccatgatttaatataaaacatctactgctatgattgaattactgaaagagaaaataatactgaattatgtgtgtaaaagttgtgtatattatgataaaaactcatgattcattaacactaagttataaatcatcacatagcattttttaaaattttacaaacagtactgtttaggagagtatattctacactagtttttcagttcaacatcttttcataattgttcagcttaagcttttcaattgttgctaatgtgttacatcacaaaattagttgaacacattttaagagaaaggaatatatgatttagaaaagtttaccttcaatgaggtatagaagtttagagatagttattttcagcttcaaataaatagttttgaatttttttttacttgctaaacatcccttccatgcattttgttgcataaatatcctatgggaatgatagacgctattaaatagtcaacaaagcaagaatgacaactggtacatggttggttctttgaactgtttattaaatgagcaaatcaatgaatgaataataaatgaaaaattttcactcttggactatttacctggttttcttaatagtaaattactagtcagttatgtaaaataaataggtgtttgggcactcttgggcatacatgtatgatacattttatattttctagaaggttccaccagtcttctcttacatattgaagacacaaatatttcactcatatattcacccagtatctttctcatttccagctaaacatgtttttccttttcaaattgtgttaatgacctataagtgagtcctcatctataggatgaaccaaatttacagtgttgcaaaactaatgttggccataaaaatcaatacattgactacaatctataaactatttataaaagaattgatgttcgtaattataactcaatttatataataaaaggataaaaatgaacaactaaaaggaaattactggcagcactgccactgatatctagcactaccactgatagtgtctagaaaattgaagcaaatgtattttatgaaagcagtgagttacttagaatggaagaagaataaagttttaaggtttggtgaatctatgtgctaactcaatactgatatcatattaatcaaggttcttggatacagacaacagaaggcagttatgggttttactcagaaaatgaattttttagaaggaaatggttagtacatagaattgaaggaaatgctggaagattggcagaaaccacagaattagaaatggttaagaacctaaagcatctacttagccaaattgtgctcttggaatagtagctaggaggtccctgctgctggtactagaccacacactgaccgcatggacacgttggcattggctgccactcatagatgcttcactgtagcttctgttgtaatcagttctgaactgttcttaattctttgtatcacttgctctagattcatggtcccagatgatatcatccagttgtttaactgggtcacatgtttatgctctgttgtctggtgccagagagagagagagcaattaactgtaattttcagattctgctgtggaagggaggaccctacctctaataaaaacatgtaagaagatgatctcccaaaattggaagggaatatgtatgcatcaaaatgactaatgagcactaacgccattaaaacgttgtatgacctaagagggcaaattattcaacctttctagatatcagtttttaaatgtgcaaaacaaagattgagaaatggataagatctacctctaaaataactaatttgcagtttagttagaaagataatataagcactctgtaaacaacagctacaactaccaaagatctgcagtagtgggagtgaaaatgaaatatcagagatggaaaaggatgtttaaaaggtggctggaggccgagtgcggtggccacgcctatgatcccagccctttgggaggctgaggagggcagatcatgaggtcaggggatcgagaccatcctggccaacatggtcaaacctcgtctctgctaaaaatacaaaatttagttggatgtggtggcttgtgcaggtaatcccagctacttgggaggctgaggcaagagaatcgcttgaacccaaggagttgagccaagatcacaccactgcactccagcctggaggcagagtgagatttttgtctcaaaaaaaaaaaaaaaaaaaaaaaaaaaagggtatcctgggagtttgtcagtctgcatctgtacaacatgtgctgttcacacaatatacaaacacatgataacagctggatactattcctgtcaaatcagattttcacaacagtggcaaaggattaagatgattggagaatagtaggaaatagcctctatatgacctaacatactaatatcttaggttatttaagacagatgagaggacaaactgtaccgtggtgttcggggaaaaaaaacactccgtagaaattctcttgaaaacaaagccacctacatactacatagcaattttagagaaatatgtctcattttcattttcttttttcttttgttttcttttttcttttttttttttttgagatggaatctcactctgtcacccaggctggagtgcagtggcacaatctccgctcactgcaacctctgcctcccaggctcaagcgattctcctgcctcagcctcccgagtaactgggatgctgggattacaagtgcctgccatcctgcccaactaatttttgtatttttttttttttttttttttttttttttttttttttttttttttttttttagtagaggcagggtttcaccatgctggctaggctggtttcaaactcttgacctcaagtgatctgcctgccttagcctcccaaagtgctagaattaacaggcatgagccactagcgcagcctcattttcttataataccattatatgttgtttgataatttttcatatctttcaataaggtttatatctgtcaggaaaaatcactattttttcaggtgcctcacaaaattcaaaggctaggaaaagcatagaccttttctataatttttgagaatatattgatttctgtgaattgtgtcacaagacatagcaatctctcccatacttttcttccattaagaaataacacttttatagtatctttcatcccagaccacttgagtgttattagaatttcaccctgtccttttgctttatctcattattataggtaagatatcctagcaaataagtaatattaaaaggcctcaaatcacagtggactggaattttaaaaagctatatcccattgatttaaagtttagaaaaatgattccagatctatgctgtcacttattctctgagcttaaaaaaagtcaccttttccttcctttttaaattttctcatgtggtaatgagggaatgtcttaaatggttctaagatcactctgatttctaaaactatgtgattctatcataccactgtacttcaacaagtctccaactcgtgatacacgcagaagtttcattgagttgatgtttcttgatgtatttcactcttctgctgagaatttgtaactgaaaaacgaaataagtcaaatatataagaaacataaaaagtacatgtatctatttagatatgtgcaagcgctattctctccctctttctcaaagagaaagaagtctagatacagaaagatgtgtatattacaaacgtagtttaaaattttacatataatttatttgtagggatacttagttatgtgataatgtactattataattttgatgcacaaaattatatctaaaatgcttagacatatgttttggaatttataattagaaaaataatatagtgcatataccatgttttacgcaacactcccagtagcatttggtcagtgtattagtctgctttcaggctgctgataaagatatacctgagactggccaatttacaaaagaaagaggtttaatggactcacagttccacgtagctggggaggcctcacaatcatggtggaaggtgaaaggcacgtctcacgtggcagcagacaagataagagaacttgtgcagggaaatttactcccccttataaagccatcagatcttctgagacttattcattatcatgagaatagcatgggaaagacccaccaccatgattcagttatctcccaccaggtccctcccacaacatgtgggaattatgggagctacaattcaagatgagatatgggtggggacacaaccaaaccatatcagtcagcaacccataatcaaagaaattaacagttatacactgaaataaacttagtattcataaataaacaaaactacaataattccccatcaacttcatggcaagtttgtctggcacgttagtttagatcaggtcaagtttttccatcgcatgaattaggaaacaaagcttttaactttaaaaaggttttaggcttgagctatatgcataagggattttgaacctatgaatacatgatttgtctgaccagaaactagtcttttgggaaagagtttttgagcttgcttctgttctagacatgtattttgtactgaagtttatcgctgtcctcaggccacaccctcccctggacacagtggagagcagccctgattatttactgagcagtgctcacactgtcctcttgaaatccaataaattcttgacaagaaaactggcatcaaacttaacaattacagtggaaaaaactagtatttatttatttatttatttatttatttatttaacttgataaaggtcaaaagaaagagatatagacaagcctctgcaggaaactgtggtaattttctgtcaataaatacctcagactgaaagtcttggttctgcagattgtttctcctctctgactgtgaattctctcttcaacccagttaagttgtttcctacttctgagctgaatttaaaggagacatgaaggacattcaaagagcttcaggggggtaggttgtggaagacattactaggaggatttcttccccctttaatcattggctttacttttcattgaaacatgttacttttaaacttaaaaacaacccagcattttaatgctgcaaatgaactagctgaattacttattctgaaagaataaggaaaataaatgatactagtgaataaagaatacctagctctcacagaatgctttagtttaagtagttataggaaagtgctctccaattgcagtatattagcctatagcaaaccattaaaaattcttacgaatttttttcttcccaaagaaaactatttaggcatcaaatcagttaatataatgaattaaaacagaacatcactttggtggcacagtttcaaaacagacggattagagacattcagatactgaacatgcaacaccagctatgatttcagcagggagtcttatttggcctttgttcatcttaattccatcaatttcaaatgttattaacaacaatgggacacaattccaacagtgatgctttacacagccacgtaaattttgaataattttagtccttgcaccattttgtttctaagggcaggtatacaatttttgttctaggatgtattaaaataaccagtatttcttccagtgagcattgaagaattaagctgtaaaagacaataaatatttagttttagtgtttacaggggaactactactacttacctgatttaacttagttatgagtaaaaatttggataggaagactaagatgagcatcctaacctactgaacctgctgctaaagtaacaggattgtcaagaataagaagttattaattttaacgtaaatgaaaagtagttttagagtagttagaacatgggaaattttacatacaaccacacacacacacacacacacatatacacaaccatacacacataaagtgttttgtgcttgggtgtaaactaatcatgagtctgttaaacggggaaccatatgatatgttcagtaaaattagtatgttagaatggtaagagtcagaaacaggaacaaagaaaaggaaaatacgagagcagcagaaaaaggcagtgtgcagcaagtgaatggcaatgtaaaatctgcagtaaagctaggtggaagtgtttagaatctgagtaattacacaaactacagatgtttaggtggtcagaaatattttcaggtcgtataaatgtgcaagtttgtagaagcctggaaacagaatgagggtatttcaatttattcactttgtggaagcaggaggtgagggtcactatgtgggcagtatatatagctgccttagattgtcagaggttgcaaaattgcattgttccagaaaagtgagacaaagacagtttcattaataagattattatgataataataatgttacccataataatttttacccatctctgggtaaaaatcctcaaagagtggtagtgctgaaattaaagaactgagcaaacacagcctggcctatgatgtgagcgagagtaagaattaattgtgctacttccttatccttataaccccatcctcttgctcctcctcacggaagccccaatgacaacccctgtagaagcagattcattacatccacattcactcagtatttactctgtcaagacctgagctaagcacattcatatatttaatattatctgaggaaattaatttgtgataacaggcattgctattattttacttttcactatgaaacagatatacagcaatatccgaggaagattttaaaagatttttagtataacgtatttcgtgatgcacggtgacattctgcgtctctcactctttctccgtcacaaaaaaagccacaacaaaaaactacttggaacttacttcctccttgtatttctgcattgaattccttatgattgtgagagtaacatcatagataaaatgaaataatgtttaacctatggagcacaagtttattaaaaatagggaataaatttatgattatcacacacacacacacacacacacacacacacacagaaagagagagagagagaagggggcaggaaaattttacgtattacttaactgagtagactgaatacaaaattcaaagttcctaagggggctgctttgtgaaatactgtgctgtgatatacacatcattagagatgagaaaactttagattcatcaacaatttagagaactatttctaaagataaatcctttgaagataatgtctttatgaacaggtttcttgggaaaaaaataaagttgtcaaatgccagtgtagcttttattatacatatatagagagacagcactgatgatttcaggaaataacacaaacacacatgcagtcagtgagaattctgtcttgtggaagatgatattgatgctgtgtgcagcccgctaataaaacactcagttgtgattagcagaagagctgaccagagtataaagtttcttacatgaatttttgtaaaaaactaaaaacaaaacaaaacaaaaaatgctttagagtgcttggcaacaaatgaagtcattcatataaaaaccatactaggggcttcaaaatgtaaagaaagagggataaatgttagagaggtggtacttcttggctgctaatggagaaagtctagtatgactttacaagtcaataacagcaaataaaaattactgggctaattttagtgaacatctgtgactggagtccactattttggcagaaaaaagggcaggtatttgccttctgagaactctggcacgtgagcggcacacattcacctacattcagccaatcaaaagcgttctcctagcattgctttagtctgaatgtatcataaagcaacaagaatagttcaaaatctattctgcatgtggtagcagcagcagtagcctgcatacagtaatagaggtgggaacaatggggccagtagcaatttaaaaactgtctgctcaggaggccaaggttggaggatcacttgaggctgggagtttgataccagccctcacagcatagggataccttgtctcttaaaaaataaaaataaaataagctagtcaggtgtgctggcatgagattgtagtcccaggaggatgactgggagaaccacttgagttgatgagttccagccaacaaagtcagaccttgtctctaaaaaataaataaatagtagtaatattcctttgggtatatacccagttatgggattgctgagttaaatggtaattctgattttaggtctttgaggaatcaccacactgcttttcacaaggattgaactaatttacactcccaccaacagtgtgtaagtgttccctttttctccacaaccatgccagcatctgtttttttttttttttttttttttttttttactttttaataatatccattctgattattgtgagatggtatctcattgtggttttgatttgtatttccgtactgatcagttatattgagctttttttcatatgcttgttagccttatgtgtgtcttcttttcagaagtatctgttcatgtcctttgcccactttttaatggggttatttttttttcttatgaatttaagtttcttatagatgatggatattagacctttgtcagaggcatagtttgcaaaaatgtcctcccattctgtaggttgtctgtttactctgttgatagtttattttactgtgccaagctctttagtcaatttttgcttttgttaaaattgctttcggcatcttcatcatgaaatctttgcttgttcctatgtccagaatggtgttacctaggtcatcattgagggtttttatagtttcaggttttacatttaaatctccaatccaccttgagttgatttttgtttatgatatatggaaggagtccagtttcaattttctgcacatggctagtgagttatctcagcatcatttagtgaacagggaattatttccctattgcttgtttttgtcagctttgttgaagagcagatagttctaagtgtgtggcctcatcttcgggtctctattctgttccattggtcaatgtgtctgtttttgtacaaatactatgctgcttcggttattgtgtcccttcaatatagtttgacgtcaggtagcgtgatgcctccgggtttgtcctttttgcataggattgccttggcaattcaggctcttttatggattcatattaattttaaaatactgtttctctagttctgtgaagaatgtcattggtagtttgataggaataatattgaatctttgggtggtatggccatttttatgatactgattcttcctatccatgagcgtggaatgcttttccatttgtttgtttcatctctgatttcttcaagctgtgttttgtatttctccttttagggatctttcacctcctagttagctgtatcctagctgttttattctttttgtggtaattttgaatgggattgtgtttgtgatttggatatgagcttggttgttgttagtctataggaatgctagtaatttttgtacactcattttgtatcctgaaactttgttgaagttgtttatcagctgaaggagcttttgtgctgagactatagggttttctagatataggaacatgtcatctgcaaagagtgatggtttgacttcctcttttcctatttggatgctctttatttcttcttttgcctgattactctggtcaggacttccaatactatcatgaataggagtgatgacaaagggcatccttgtcttgtgctggttttcaaagggaatgcttccagcttttccccatttggtatgatattgtctgtgagtttgtcataggtacctcttattattttgaaatatgttccatcaataactattttactgatcattctaccttaaacacatatcaatgttcattgcagcactatttacaatagcaaagacatggaatcagcctaattctcaccaacgacagattggataaagaatatgtggtacatatacacaatggaatactatgcagccataaaaataaatgagatcatgtcttttgtgggaacatggatggagctggaggcaaactaatgcaggaacagaaaaccaagtattgcatgttctcactcataagtgggacctaatgataagaactcatgcacacaaaaagggaaacaacacccactatggcctacttgagggtggagggtgcaaggagggataggatcggaaaaagtaactgttgggtactaagcttagtatctgagggacaaaataatctgtacaacaaacctccttgacatgagtttacctgtataacaaacctacacatgtactcctgaacctaaaagacaaaatttaattaattaatgaaaatgaaaatgaaaataaatagaacactaaaaacacagtcagtggaatcattttgcttgtggttctaaccaaccaacttcctttgatttctgaacattttcaagcctgaatcacctttattctcattgattccttttttgaaaatttttacatttttaatttttgcaggtacatagtaggtgtatatatttaggggatacataagatattttgatacagacacataatgtgtaataatcacagcagagtaaatggggcagccatcacctcaagcatttatgctttctttatgttctgtgaaccacacatcacttatatatttaggttattttctgctcaagatattcagagtcattttctattatttgccattcagtatcttgactgcaacccacaaacaatacccaatactgtggtggatacaaactgtcctagtttccagtatgagccaagtccctaaagaaccatatgattctttattattctgagcttcttaaagtttagagttatcacttaccataatttttgctttttacagtctgagagcacattctgatgtttaataaatacatcttgaatgaaagaataaagtaggtattttatacctaatttaatagaagttttattctcacagagttaaagaacaaaagctattttatggaacacgctaatcccactatcaggaacctataggaagaattatttgatcccatttgtaagaattgaacacatgaatgttaatggtacaaaagtggtacgcaaattcatgcttttttgaggactgtcctttctaatgattttgattccttttgctaatattataataagtaataataagcattcaacttatttgccaaagtagatataaatactttattagaatatgtcatccaacgaagattttgaaatatgtaagagtgaaatgagaagtccttggccaaaataaatcgactagtctttataaattctcaatctaccagagccttggctgattgagaaacacaactgccattgtaaaaatctccaaaaaagactgtgatttccattttctttccttgcaaactggtggactcaaataagcagaatagaatgaagcaaggtaacattttccgaaagtgaaaagcttctagagttatttgaagaataagtaagtctgtttacaagaaaaatgtaccatacataatgtgtttgctttaaaaagccctttgtaaaggtgacacaccaaagaccatttaaaatctaagtcattgtaagatagcttatgttgtcatgaatagaaaattgacttatactcaaggaacaagggcaggcacttctttgaaagaaaaaatttgaactaaggctcagtacttggaatagttttattttacatttttacaaaacatctgacagtgcttgaccagtaaaatttgtaatttagcagataatactaaggatttccaggtatgtcagaaatatttcaagtggatctgagtgaagaaataaaattgtatagaagttttattgtcagcaaatacaagataatgctttagaagaaggttatatgtatgagcccagaaaggttaccacttacctgcctgtagcagaggcaattactagcaccagaaagaatgggtaagagaaagacagaaatctgtgttatgggaggctagcaagtataaggcatgacatctcccattgaggaagcagggtacttggcaagttgtcaaaactgagcctcaaattactggaataaaagaaatttgattactagatggaacagggattagaagagtagtcaaatcagaggagaaataggccaagtcaaagcaggactccctgcagattctcttgaccctgatgttcatgagtttcttaatttcttctacattgagggtattttcctgtctttctgattaaagttcatattagtttctgaccttgggggtcagctggattctgcagttccacatcattcactccggcaaaggagagaacttgtaacaaagatgagtgccaagtttagtcaatttaccctacctggaatactatatacaactctgggtctcatgtgtgttaaaatacatacagtgaagctgaggaagagccactgaagtaaaaagtattgtttacaagttggaaaggatgtaaaaataatctaaagtatactaagtcaggaataaaaggcagagttaataaaattgtggctggtactgatagactaaacagatatattttctaaatcctggaataattattaaaaaattttacatgtatcaatggattccagactccatattttaagtatcacaactagtgtaatttaaaagtatagtttattgaaggtctggagtctgaataaagtaccccaagtgagtcttgtgagaaggtaagtttggaacacactgacttacaaattttgtgcttaatttatggattttgtggccctcaaaatatcatgtgggctaaacaaaagaatcttgaagaatttaaaataaatcatgtccaaaatgagttgtcaagagaaactgaatatattcttttggtaacagccttaacattttgaggagatatcatcaaaggttaactgttttttttttttttttttttttttcttaaactgatcccatgagatcagttttcttttagatgataccactttcatagcctgaggcaattaaaaatgtatgcttatttgttctctagtaggtagaaagttaagtccttaggaataggttgtgctttagtgttcttgaacatgtgagagtgtccttttctatactaatatttcccaaagaagactcagtattttatccacccactctgctcaaatacaccccatgcatcttaggaactaggaaaatagagtgattttcatgtaaaccattgaaaattcagaatgaatacctccaaacaaatgtcagaattacacatccataaaaccagtgttcactgaccttaggcttagcttagagttctgcaaagttttcaagatacaaataaattataattatcaatattaatagagttgtcaatgttcaccatcatgaagaagtaaataatagattgtgagaatgatatgtgaaattttcctatgatttatttaaagaatttaacaaagcaatgagattactggctagcgctcttgaagtcatgtttaatatagttgcctctttctagaacacatgctcttcaatgtttccttggatagataaactacgttttattctttgattttccttaaacaactacaatcaaaaacagatatccacttaattgttttaccttcaaggtaacatttatgcttatatccgtttatgccttcttaattctctgcaaactataacacattttaatgtgtgccaataaagttataaggtcagccatttggagctatctctggtgctttgaactcacagtatcgaagtaagattgggcatggcttgctatatttaatcttttcaatatatatagcttttgagttagacaaactcttatttccaaagataaatgtgcatttgagagtttaattatgtatttcttaacatttcatgtattttaggcatatatgaataatacatttcatgtattttaggcatatatgaataaataatatatgtacatttaaagttcaatttcatagaaactagtatacccctgaaaacaatagatgtgtctaggagacagaagaattgtcctttgtaaaatttcgctacagttgcagcaaagttatttgttgataaatgagagaaacagactactcataaactatggcctttgtaatactgaacagagtctagaattatgataatcatatggtttccgcgagatctagctgatatgcctttttgagatgataacttctgtccttgagacacttcactttttttttcacttatctccagcattgaataaagcccctcttttccctgttttgagtttgttatcatatgtgtcacatgattactatcatagtttactgcttcacaagaattcatacagttttcctatattttgggtgcttaccacatcccagaccaggtgttctagttccgtatttctatattttctcctttacagtgaaccatacttggctttcaagttccattttgctcttggaacctgcctgttctcagtccctgctttgcttttggttgctgccacctgtttctcagatgcagctccatgttcgacagcctgtggatatatcccaactacttccttatttagatcaggcttcagcctaggagaaggaaatttagatttgagcagaacatttaaataaagttcaaattgtctccaagggttataattataaagaaatcttactgtaggaggcattgggaagatacaattttagtaatcttccaatggattggttcatcttaattatttaattgtatttctatcaataatagcagtggcaagaaaagtaataaaattaggcctagatcgtttttcacaggtttaaatgcagtggtttatgttcccttgactgattgtacaacttcagtcacatatggtgaggtcaatatttattaaactatgcatccaagtgtttgtgagtaaaaatgtagtactttctagcattcatattactatgatagtatgcttggagatatttttgatatcagctttgataataaattttatctggaataaacctagcgaaactttttaaatccctaaagatgatagcatataaaacaacaaataatatttaaactgcactctcatttccactaatagggtggaccaagtttcttgactgcttcttccactaaaaaacaaacaaacaaacaaaaaacaaaaacaaaaacaaaaaactaaaagaagagataaaatgtaaaagcatccaaacatatagaagtgcaaacaagagaataatcatctaggccaaaatataaatgcgggcaggaattgagtgagaaaaaattgcttttatcctaaggacatatgccaaatctggaaacatcttagctttggtttctctcaagctcaaaaaaaaaaaagaaaaaaactgtactcctttaagatctataaaaatatgctgttttaatactgtttcattaaacatcataatagttagactattatgatgactaacctgatttcacagatgtttggctattgtgttttatcacccatcaggtgataagaaactttaatggtggtagactatatgcttctcaaaattgtgtgtgtgtgtgtgtgtgtgtgtggtgtacacattttcttaaactgtagaaagagcatgcgttttggtttcagacctgtgttggaattctgactttccttcatttgatgtgatgcagattatttaattcctccgaagacttggtttattcatctgcaaaatggggagaaagatacctatgtcccaggttccctcactcctcacatccaatccattattgaggcctgtcatttcttctttgaaaaaatatataataggcataatatttctgagatgtaagccaaccaatgtattttctttcttggaaatttctggtccctagttgtctcatcagtctatatcaagagccacccctggtagaccttcattggagagttagttttatattatggagaggatactgtttccacctgagtttactaggtcatgaggctcctggcctataagaataatggccaaatgatgtaagataaattcagattcgatggaaagagaaacgggaaagcttactctttctggtcctttagaatgtaggaaaaaaagaagcaagtagttaaccacatgtctgttcctgtttgaaatcgtagaagtggagaacgaaaaggagcagatgcttgtgtctcttcttattgaaaggctacttaaaataggccagcatcagtggtgggggtccagtaagagttaaaaagtgtttcagaaaatgtttaagcaccgaaaggatttaaattagtcatcacaggtgtccttaacagatgcagaagtttctacctgccttgtggtgggcagcatgatctatgcattgagaagtaggttacctgcagcaagggctccgtaactgagaatgagtgtcttcccccacagaatctgaggtctggcagctcagacagaagctgggtggagggtgtgattgtgttcagaaggtccaccagtgcaccaagagtcaagatgagaccaagtcagcaaaaagaggaccccaaacatttatcatacaagagaacaaaatttcatcaagtacaatcccagtaagagaagccagggaaactctcagtgaccaggtagtaaagggaaattctccaaagggaagagatgaccccaacgacagccacgaccctgtttccaacctcactaaggacatttaagcctgcttgttctccacagaagtcacatgctcctatattaaattctacgattttaaagttttaatatttatatttagatctttaagactctgtgaattgtgtatgtgtgtatatctgtatgaaatgtagtcaggatctgattttaccatttcccatgtggataacttgttccagcattccttcttatctcagagaaaaaggggtccttcttaacactaactcttccacctgttctttcagtttctccatctttccacctttcaaaatcctactccattacttaacctatttcatttctcatcttaatttctttttttctaccattttcatattttctgtttacaaatgggcttatgttccctctatttccttcaacccacatttatacatcagttaaggccactatttttaatttctatcaagttctttgaaatgataacaaatgtttggtgtgcatgctcttaaccttctcccaatcatactcagactgcagtatttacctataacctagttactaagtcagttaacctgtttttgtccctcatcaaatgtattatttttgctgcatctaatatggcctgtttacttcttgatagtgttctcacttttagttctgtgacattatttttctttggttttctttccatctacctggtcactgtttctgtggcatttttccttgttgttcctttctctcagtataatgaatctgtccatagggaaaaatagaaataatctttgaaacattaaagttctgttgataatataaattttattgatgattggaaatatagcctatctctaatatagttatttgatccctccaagttataaataaattatataatcaaattaatatcataaaaatttatttggttttctattgcagatgttttctttctccttttatttcctctatgattgagaaaatcatacttaacattgtcaaaaaatgaacacatgctagttaaaatacatttgggatggaagttaaatatgtgttatttatcagcatcaagccagcattagaattaaaaaaaaaaaaaaaactgcagtgaggttctttttattaaaatgtaaccaaaataactcctttgaaatagttatctttaagattgtcactggttattttttatggtttaacactctcaaataaatgttcatcttgcaaaaatctgcatgtaatacatactgatgcataaagaaaatgcatcaactaagcagattgttctgtgatgacttggattatcaaacatttgcaagttaaattcaatattactgtataaatttgaagaattaactaaaattaacataatttatttattctgttagtgaataaccaaaattttaaagttcctcaagctattttaaatgcttattaggataattataattattcatttctatttaaaaattaaatgatgttagccctacagtgtttggtgaatataaaaatatatatcattgaattataaatcattttgtctccagctgccaacttgaaatgccaggcatttcacttatcttcatatttcatataatgttgaactatttatggtccctgtgctgccatatgtaaaagagcaatattcattaactcttcatgcttcatgaagcaaaaagggttatttcatttgtgagcttctttcgtaataaagactcgtcaaattttctacgttatttatctttgccaccttacgtgattgtaggcatccagaattttcccactgagagtgtttattaatttgttttcttcatagtaataaaccataagcccagtgagggtaggcaacaggttaatcttatagtcattatattctcagtgtttaacaaattgcctgattgagatgaataagtgcatttattttcaagcattttgtttttatttttgatatagttattcactaaaacgatccactcacatcacttattcatgcctgatgttgtcaaaacaatattaaaatatatcgcttcatgtcagagaccttcagtattatatctgaagacacaggttaatacatgtggatcactttcagtgtaaaacattgtcctattaatactacttgaatatcaaagagtacaaatcaaataggtattcagaaaagagggtcttttatggggaatcagactcctggaagtgacagttgagtaaagcttacaaaaagaaatatttgcaacaaataagaggaaactttcctttccacataaatggagcaagacattgagggcttgagaaaggaaagatcataaactattggagggtataggaggctccagagcttattaaaaaagaaaagagtatgtttggaaattttgtgttattttatctagatataaaggattctgaaaggcagtgaaagtactttttactccagagagttaaaaaaaatatgggtctaatgaatgactgtgaagaaaagattgcacccagtgatgtgttgagggaggttgaaggtagattgaaaagtagataaactgaagtggagtgtagaattgagtcagtgaagatctgggttaaggttgggacaacagctgtgaaaggaagaaaaaagaggatggggtgattgatttgagacagttacattaaaaaaaaaaaaaaagtggccaaactgaaacaaaggtgtcaagtctggataaataaatgagcaaaggtgttataccaagattgaagaattgagagatgtgggtaagtttctgatgtatgaaatttgagatgatagccagccagatacttatatgaaaatatctaaaaggataaagaaacaacttaaactatgttatgcaaaataatttccatgtcccacttaccatatcaaatgcatatacatgttcacacagttttcgcctctttaattgcctactttttccaggaaattttctttacttattctcatttttacaaaatattttataatgcctttgtatcaagaagagtaagatattacacaatcactttaaacataaaattacctatttgaaaaagatataaagtttcctttcctttaaaatggggataacacttgccctacccagctcacagggttgttgaaaggatcagaagaaatgatgggtatgaaagcactttgaaaacgaaaatcctttacaaatgcaagctatcatcattatgattatactgtctcctccatatgaacctgaagcaatttcaatttccatttatcacgttactcccctaattcctgtagagcatgtcccacaagatttttatcatgtgactctattttaatcaacgacaaatgcattttcatgaaagcataatattatttctattatagatattctttgaactctggataaagaataatacacatttcaaggaccattatacttctgagagttttttcctatctctttcatttcatagcttcctttctcccatattacatgggtgcaatgaaattttcattgagtgaagtaccttataaaaacttgactgtatgtcccatcctcctttcccctgattttatctttttcttactctgtgaattcaaattctctgataagcaccatccttcgctctgtggattgacaccagtccgtcctaggtaccaaattaaacactgaagatgttttaaggagatgatagcaatatcatgctcattatgtagtggagcttaaaattagagcttggtaccaaccacatccaaaagttgacatgttaaagagagttctagttatttttaaggctacctatgcctctactccattccttctccaattaatactaccccaattcttgcaacatttgttttgtgccctgggcataataatggcaataagataaagagaacctattggtacacataggttgtacgaggacctaaatattcttccacccccacaaagtccaggaaagtaaagcaaaagttaatcctttagtcagcttttctagatgtgcagtatattttcaagcattttgcgtgtatatgagtaatcagatgatccatttacatatcttaaaattgttattttggaaaaaatagcaaatctgttacaaactaaactacttttacattccaaacttgttaaagaaaaaaaatgctgattataatattaaatggaggaagttaaattcaatcaatttctaagagctatataaattagttttagagcaacccaaatttcagttatataacattatttttcaaaagaagttcttaaaaaccatctaattatataagacaaaagattagaatagaaatgaaccttaaatatgatacttacttcatctaatgtgtgagggatagttttagaacaaaagggacaaggatgagtacaccttatccatctactctcagtggttagttctgaagggcttcttcctagcttcctgtcttgggtgtaaaagccacattgctgtagaccattgaacaatgtctgtcttcattctgttactcctttcctggaatcttccacatgccttctcctcaagattgactctctttgtctcagaacttgattgaacagttcataggtttacgaattacctttgccactgtatggctttcctagctgcacctgacagggctagctagcctttgatgttatgcacaattcaggcatctcacagaccacacttagtaaactgatctgtggctggcccttaacttggccattcaccttcatcatctaagatagttgccaaggttcaccatgcttcatctccaggatggcatggtaaggaactgattttaggaccaagtagccactccctcctttctgtatcattctactgcctgtcaaggtggctttattatatttcaccctgacaactttcactctgtctctctcctctcttggcatttatgcaaagcagtgtaagcattcacttgggaaagagaggcatcttggcaaagctgggtcttttctgatacttgaattagatcaccaggtcactgcagagttatagaggaaatagactacatttaagaattttctataattgccagaagtccaaacctgtaattactattgccactctgggagcttcaagtgaagcctctgtagttagcctttgcccttatccatcctgactttcctaccatattttgctactttctcctttgttagaatttatattagaaatagatattttaaaattcagctcaaagtttttagactagtacaaagaatattgtttaatttacttgttacataacatgtatcaacaagcagaggggaaatttaattggtggtaatataattgttaattttaacaaaaattgggaacgtttgactttgaaattttcagtttttgagctcataatagaagacccatgaccactttgtaacttatcatttcaatatagttccattgggtagtagtacctttattctgttttgaagataaggacactgaagggcattacagatgaggatactggaggttcaagagttcacagattttcctggttcagcaactgagagctttcagacccaagtgctatatattggttaccacactggcctgcctcttcctcacttaaattcatccattgactacatatcatcttcaggataaactaccaaggaatgttgcaaggcctttcataatatcactctttcctacctcctctgtcctgttcttgctagttcacttcctatacttcagcattctaaacctcacggagagcccttcctctgaaaatgttgcctgtccttttcacctcaataactgacacctatttgttgggcccaatcctctggggaagccagtgtcatcagagttggcttcagatggtgtcttgtgaaatctcttttagccgttagtgctgttaaattattggttcccttagataaggcttgtgagggtagagagtgtctccttcacttttgtttcctcttttccattgtctataaaataaatataataatagctaccttgtagatttattggaaggattagaggtaatgtatgtaagtaacgtaactagcagtgccagggacatggtaataaaaccaacaataactcatatttattaaaatcattttctgtgtgccaggtactatatggtaggcacttaacatgtattatctgtaatccgtatgtaatgattactgaatggcctgaactcaccgccaaaaagcacttttactttttttcttcaagcatgttatcaaatcttctcatcttgtggtttgattcaacttaggcagagaccatagcttttctgattttgtcataaacacaatgtaatttcaataattaaaacttatttttatttattaaaatttccaggctgtacttaattcaggtaaacttcaaaatcactcctctccccttaattcagtcctgactcctgcctccagctctgcattgcagagtttgttgactgtattttttaagtatctctcagtaatcagtgcctctgtcaatggcagggattgactgccatgtagaatatatgtgtaaactattcagagaaccactctctcccctacaccacactatttgggatcccatctttctgacaaaggacatattcgctttagctaccactcagctccagctctcagcagcaattccagaatctccttctgcagttcccttacttatttgggaaggtggttcttttctttctttctttctttttttttttttttgattgtaagatagctacattttatttttaaaatttattattatacttcaagttttagggtacatgtgcacaatgtgcaggttagttacatatgtatacatgtgccatgctggtgcactgcacccactaactcgtcatctagcattaggtatatctcccaatgctatccctccccctacaccacgccacaccagtccccagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatccttttttatggctgcatagtattccatgctgtatatgtgccacattttcttaatccagtctatcattgttggacatttgggttggttccaagtctttgctattgtgattagtgccgcaataaacatatgtgtgcatgtgtctttatagcagcatgatttatagtcctttgggtatatacgcagtaatgggatggctgggtcaaatggtatttgtagttctagatccctgaggaatcgccacactgacttccacaatggttgaacagtttatagtcccaccaacagtgtaaaagtgtttctatttctccacatcctctccagcacctgttgtttcctgactttttaatgactgccatttaattggtgtgagatgatatctcattgtagttttgatttgcatttctctgatggccagtgatggtgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgtgaagattttctcccattttgtgggttgcctgttcactctgatggtagtttcttttgctgtgcagaagctctttagtttaattagatcccatttgtcaattttggcttttgttgccattgcttttggtgttttagacatgaagtccttgctcatgcctatgtcctgaatggtgttgcctaggttttcttctagggtttttatggttttaggtctaacatgtaagtctttaatccatcttgaattgatttttgtataagatgtaatgaagggatccagtttcagctttctatatgtggctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtatcagtaccatgctgttttggttactgtagccttgtagtatagtttgaagtcaggtagcatgatgcttccagctgtgttcttttggcttaggattgacttggcaatgcgggctcttttttggttccacatgaactttaaagtagttttttccaattctgtgaagaaagtcattggtagcttgatggatatggcattaaatctataaattaccttgggcagtatggccactttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcacgatttggctctctgtttgtgtgttactggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctcatttattgacagttttttgcatgaagggctgttgaattttgtcaaaggccttttctgcatcaattgagataatcatggtttttgtctttggttctgtttatatgctggattacatttattgatttgcatatattgaaccagccttgcatccctgggatgaagcccacttgatcatggtggataagctttttgatgtgctgctggattcagtttgccagtattttattgaggatttttgcatcaatgttcatcaaggatattggtccaaaattctcttttttggttgtgtctctgcctgactttggtatcaggatgatgctggcctcataaaatgagttagggaggattccctctttttctattgattggaatagtttcagaaggaatggtaccaattcctccttgtacctctggtggaattcggctgtgaatccatctggtcctggactcttttttgttggtaaggtattgattattgccacaatttcagagcctgttattggtctattcagagattcaacttcttcctggtttagtcttgggagactgtatgtgtcgaggaatttatccatttcttctagattttctagtttatttgtgtagaggtgtttgtagtaatctctgatggtagtttctatttctgtgggatcagtggtgatatcccctttatcattttttactggaaggtggttcttttcactgggatctcataaagctagcaaattactttctgtgggatgactgagcccatggaaacgcaggcattcttgtcatgtctaataatgggatgtagttcctcccagtccactgtctcctctccttgttttctgctgttatagactgcatcagccaacattatgcattctgaattctccaggagggactgaagcagtcatctcaatgttcacacgttcctccaaactttaggggccacatgtcagtttgtttcagaatcttctcatcccagggttatgtggagatttggctgcacatctctgcagctcagcaagcctgaggtgagaattgagacactgctttctttgccttgcaaaatgcaccactcacttaacatatgggagcacttgtgaaaagaagacaagtcagaagcccttctcttcccttggataacatctcattgcgtggacgactctttctctctcaaaatactccataattctgcatttgagaggccagaggtggtaggttggtagccggtttggctgcttattaggaagccctaggaaaggtgcctagtgagtgctctttagaatcccttctgttaactattctcaatatttagggtttagctgaaatgtttgaaacaaagaaaagtcctatttcacatcttgtacttttaaagcactcatttacatctaaagaaatgtgactgtagaagttaggttatattccctaaggccacaaaatttacttattaaaagtcaaaatctgatttgtctgtaggttattctcaccccaaacctccttttcagttcattgtactatttacctccaaatatgattgttcaattataagtggttactgtagggcatgtgtaagttgagataaacagcaacagaactcttcagtatttatttagatacagcataaaattgggttttgatattgtaggcatattaaggctagccagcttaattggctcctgcatttgtgctaacaactattagtctttaccccccagtaagtgaagaaaatacttgatatagctaaagtagtacctagctcattctgagacttcagtaaatattggttaaatgagagactgcaggaattcaaagtgagctgatgctgccactcccaacaaacagtgacttctgctgagttttttctgatacttttactgtgaaggtctcacttttgttcatgcatctgtcatcaacccttatattcaaggaaatgtctccagaatttttattggatgactgcattttccttacatgcaagtaaaagaaataccaggctttgaaagcgggctgattgagtgagagttgaacatttaatcagcaagaacgcacttaaaagtgccaagttgtagcaaaatctagggaattttaactttacatatgaaatccttttctgctccactatagcctcaactttctttcagtttttaaatttagaacattctggtaaatggccactgcagaagagtttaatatggtacaataataattcttatttttctcttactgctcaaaggaaaaaaaatctggataaatcccagggacctttaaggagttttagaaactgtcctcttcattaggttaatccactaaagatcaattagttaaaatgctatttgaaatatttagttcttttcttagagataaagtattcatttgtaaattgaatctattgaagatatttccatataaaataaagagtgaaaaacaaaaaaaaaaattgaatcacagctgctttatgtggactgatagataccttagtgcatttgcagcacaaatccaacatttaaaatatttaaaaatacatctctgtatgtggaattttagaaagtattaagctatagtgagagaaagctgatcagcctgaaggagttggggaggggcttgactgtaaagagacatcaggaaacattttcaggagttagaaatgctgtctatctcgactgtgatagtggttacaggaatatttcctagttgcccaaatttacccaatggtatacttacacaatgggtgaatcttttgtatgtacattaaagctggcgggtggggagaagaggaaaaaaaatcttattgaatttgggctattttacttgtaatatcttttatcctgataaaacagatagtactgtggtagacaaagtgttttatcatctacatagaataataaaatctcaaatttcaaatgttattcattcactgttagtcaattggcattaaagtgttgctttctgtgtttcaggaacagtgcaatttgtgaggtacagaaagccaaataaaacagtctttgcctaaaggaagtgtaattcattatccattgctatgtaacaaattaccgcaaagtttaatggcttaaaacaccacacatttctcatctcagttatcatctgtgagtcaggtgtccaggtgttgcttagttggtatctctgtctctactttggggtatctcacaagactgcaatcaagaagtcactcaggcctgggatctcatctgaaagctagactggtaaaggatccgctcccacgctcacttacatagtcgttggcagaattcagtacttcaagtgctgttggactgagggcctcagtttcttactggctgttgaccagaagctgccctcagttccttgacaggtgaccctctccatgtgactccttcatcaaagagtgcaggctgaaaaggcaatagatggtcagttaggaaagggaagtcacaattttttataacccagtcacagaagtacatcccttcaatgacgctatgtactgttgcttagaaggaagctacccaagaaaagggaattaacaaggacatcaatatcaggaggaggagaccactggcggtcattctaaaggctacttaccactagaagcctagttgattcaacttactatccaggattaatacatcaagaagtcatccagcaagtgctttaatcttttctgctacacagaatagtgtataagagtggtggctttataatcagacttctcttgcttaagttgtcgctaacccttattagccatatatctgggaatttattaaaccttctaagcatcagtttctcaccataaaatggtgtatacctcataaagtgtgaaaattaaacacaataatgaatatatagttctgagtatggcacctggcaaatagtaagcatgcaaataatgataattattttttattatatatctacttactttattcctcacttgaaatccagctctctgaattttcctgttgttgaaattagtttaccaacttggaacttattaatcaccatatccactttaaaatcctcaccctgcctttaatttacatctgaagacagtgtatttgttgccttcattttctccctacttgtgcacactccagtcttccactgtttctacagatgttccttatgtaacatgatttcaagtgtcgttcacttccttctgaccacatttgttgcattataacataatgaatctgtaagtcatcacatacaactaaataaattccaggtgtagcttgttccatgcaaaaggaatcaagattattactagtgatgtaaataacctatatgtattgaacaattttaagtagtttttaactagtacaatgatattcatgaatctttttcttgaaaatgatagtagtttacaaatgatctaaggagcagcaaatattattaaacactttgcgtacttccatccagatttatcaaaattgttatgaagctgaaagcatagtgcaagaatacagtttggtgcctcatggttctttttatgtactttgtttaatataaggtgatttagcaataatatgattaggatgcttactgtaaaaactccttatctctattattgcttaggcacatagtttttttatagttgtaagacatgaaatatttatctatatgctataatgaactatttactggatataccatatatatgatgcttattcactggtgataaacccatgattgtttttaaatatagattttcatgattagattaataatggaattcacactctttgatagttcaccattatatgcaaaggttttttacaaaaatgatagaagttccaaatattttttcccaagttcacaattcttacaagctcacataaaaataggaagtgtggtttttctcaggggtggcattttctcattattctccttagaaaacataataaagtgaagttcatttactcatttatttttggctttaatattaaacacaaaatatatttttattggaaaggtcaacattgtttatttctgcttgttaaagtatacatgttcctggtaaaacatttaggaacaacaaaaacacaaagaagaaaataaatattaccataactcatagacaattgctgacccatttaatgcatattttagacaattatcataagatcactttttttctgttggaatattagtattttattaaatgattttttaaaagtccttgtatacatatatacatacatgtagtgaagatttaggcttaaagcattttttatttctgtctttgttgtcactgttaggatgctttatttctgttgcaaccacattgtgtcctcttattattccatttctaataaaaaatatagaataacaatattaaaacataaatttttccttgtatgttgtttgtgaatttttgagtgaagttgttttcaataactcagaattttgagttgaaaatacgtgaggatttctgtgatcaaatatttgttatctttttgtaaagagtgctgatttgattagttctaaaaatcatcagtgtaatctgtaaatgatgtaatccgccatcagcacttgcacttttcttcagattattatagaaattcaaatcaataacattttgttgttttctattaaataacatttggcacattacgtatgttcatatggttaccaatattccttaaaaatagcaaggttttaacatgttcatgatatccttaggtagagtctaataacagagaacatttgtgtgaggataactattttaaaatatactctcttttttgaaatagattgtgaaataatctttggtaaaatctctatctttgttaaaaattcccagaatgagaaatgtgaatgtaaaatacttagaaaacttcctttcctagggatgtaaatttcactattataatctttatttataagtcactcgttaaaatggtcttgcttctaggataagaatgcagttcttcatagaataatatctaatttgaagttttgctaatagttttggaagtgaatgtatttttttaaagttttaaatacattcattttagcatattgctttgactatatggactaatttatcaattaaaatatttctattttcatttgatagtaatttttttcaaaaacttatattgtttataaactcagcaagtcttcagaaacatgtttgagtttgttgtatgcatccagattaggtcctagatcaggatgcttttgaattaacttgaaataagaataatatctatggtctatttttatttgaaagttttaccttcccatgatgggctcattttgttaaggatttctttaaaaatttgtggcatatatttgaaatgaagctgcctaaaagataatttatatagttcttaaaagatcatcaaatctcaggtctgcatttaatatttcaaccagtaatgttattgtgctttaaaaactctggtaagataaaagtagacttttacaaaatgaaattgtttcatttattcactcattcattcattcaataaacattaaagaacccttgttcatgttccagacactgggtatataatcacctgtggactagaaggaaaaatgacagacacagaaaccattttaaagaagataatacattattgttaattatagttaattaaagaaaattaatgaaaattcctttgatataaatacttaggtcttacctatattagtaatgtccacctatttttaattaatagagattagcaactctgaaatttataaattgttaaagtttttcagtaagcttttaaggttgtgtgagatatagttttagaaaatatttgaaaaaaaaagtcacattaaaatgatcaggattgtcttttgtttctgttttataatcaagggcctaacatctaatatgtaaatattcttctagtaagcaattaatgtggttattataatcttattattcatagaatatcccccccgccccataaatatcaacttcctaatccccagaacttgtctaagttacatggcaatagggacttagctaatgtggtcaacgatcttgagaagggaagacaatcttggattacccagttgggcccaatgtaattatacagtcctagtaagaggcaagccagaggatcaaagacagaaggaaatggacaacagtggcagaggccggggtgatgtgccttgaaaatagagggagggctccagccaagggcaccttctgggatctggaaaaggccaggaaacaaaaatttctcccagaaggagtgtaccactacctataccttaattttagtcctgtaagactcctttcagacttctgacctccagaactgtagaaaataattttgtggtattttaagtaatttaaatgtatgataattagttacagaaacaataggaaattaatacaaacctacacaattataacattgtaaaatggcctctgttgtgacaatttaacaaaatgccaggttttttccccagaaaaatccctgcagagatgattagctattagagcagagtgtgaaaccttttaacaaaggtaggctagctggtaactgcccattattaccaactaagtctttgaaggtagcaaagcaatacaaaagcaggtactcgtgtaacctaggccagaaccaccacatttattgatttttcatagcttccttttaactgaatccccagataccactagaattttatgaaatgacttaagaataagacatttgaacatgaaaatttaggtgtttcttcaactgtcacacattcaaagagcccctcctggtaatctgtgtgatcatgttcttgcatcagtcgcagacaagcaaaaagctgaactcagtactgcacctcctgttttctgggagtatttaattttaagagagacccatacttccttttataaggtgaagggaaaagctgtaatagcttctttgccattagttttgaaactctagagttcattaaaactccctttggctttcttcactgccatctttctttcttcttatgaattattcaagacaaatttcacttgaggtaaatagtttgatttgaaggtttttgtatctggatttagatgcaacaagaagtgttaaatgctcagaattttaagtgtagagaatggcacagactcagctattaagatggaagacatttgctgttaatgttccagggctgctgttgcgacttcagcttggtactattattcattctgaagtaggcaggcattatgatgcctgcagtataaatcagattttacagagagcttgatccgcaagcactttgaacattccatccacttctcagttaacagaacattttttggttttacaaggtaaagtttcttttttttttatccttgccaatacattattaatctctttttttcatatattgtataccaaaccacaaaacagttttagactatacatgtctcttgaataaagcgaaattgtaagttttgaaagtttcttctttcaataaatattgtgaaagataagaggacctagaaaatatttcatttttataaaactcaacgtaagaccctttcttctttcacagtagtaatatcttttctagatattgtgtcataattttaatcttttaaacacttagctcatggagtcacacacctggaaaaatgatacatggaacatatgtctgaaaactaccttattttggaacttaagaattggttcaatgaatgtaccacatttaaaaaccaatccaggccagtgcagtggctcccacctgtaatcccatcactttggaaggccaaagcgggtcgatcacctgaggtcaggagtttgagaccagcttgaccaatatggtgaaaccccatctctactaaaaatacaaaaattagccaggtgtgttggcatgcgcccgtagtcccagctactcgggaggctgagacaggagaattgcttgaatccaggaggcagaggtggcagtgagccaagatctcaccactgcacttcagcctgggcaatagagtgagactctgtctcaaaaaaaaaaaaaaaaaaagaactatgcaaagaaatcttattatagttttgtctgctactaaaattcactttcctaatgtcagtttctattaaagttgcctagataaaattatgtttatgaaattatgcccaggtagtactgctttcaggcaaagcatttcattcccgtttcctgctctaacacaatatcacaagcagcaggagtttcattactaaagaataataaaaaacatttattaattgctatatgatagaacatgtgctaagtactttacatgcatcacctaagttaatgctcacaatgagtcttagaaatagtttctgttagtgcccccattttatagctagacagttacatggagagcacagtcttgtaatccctctgtaggacatcagaatccatgtccttaaagactaccaataagtgcaaactcaaaatgtacaggaacatagatttatgaagttgcctagtataatgcaatatgaaatggtggatactgtaacaaattgtcaacaatttacatgcatttatatttaaactacaaatccagcaaccaataatttatttgtgggctatattcaggtttcagccctctggtttttaactcaccacaaagccacactgctttcaaaaccgttcatttacatgcataattattcctttatttatttcaatcttattcagattttatcaggcaatggaaacatgcagagaacagaattacattgtaattacattgtaatcacaatgtcttataaccctttccatggtaaaggattacccattagcccagtcatgtagtttacctgttgttagaagggaagaaggaattctcttctaagtctgaaggagacacaggttgagaatcttttatccaaaatgcttgggggccgggtgtggtggctcatgccgtgggtggatcacttgaggccaggagttccagaccagcctggccaacatggcgaaaccctgtctctactaaaaatagaaaaatttgccaggcatggcggcacatgcctgtaaccacagctacttaggaggctgaggcaggagagtcactcgaacccagaggcagaggttgcagtgagtcaagatcgtgccactgcacttcagcatgggtgacagagtgagactctgtctcaaaaagaaaaaaaaaatgcttgggaccagaagtgtgtcattttttggattttggaatatttgtatatacacaatgaaatatgttagggatggaacccaattctaaacataaaatttatttatgtttcgtatacacgttatacacagagtctgagggtaatcttatacagtgttattaataattatgtgtgacctgtcacttgaggtcaggtgtggaattttccaagtgtggtgtaatgtcaacactcaaaaattttcggattttggagcatttggagtgcagattttcagacttgggatgctcagcctgtgctggaattgcaagaatgttcagactcaaaagtcaaagaaaaagttgagttctgaagagggcacattaattgaaggggccaacaaaatgtattaaaatttagcctgtagtgctcagtgtcttattgccatgaatatgagagtgatggtggctaaggaagggaactggagccatatttctaaatcgggctttatattttgtaggtgattgtgccagccatagtgtaaggcagacatgagtcatttttcaagggacttgggatgaagtgcatgtaaattttggacatgaaaatttaagggcgaaagagatgtttaaatcctctaaggaaagctatgggaaagctgtgtaggcaccattagtttatttggatcatgaagtccaggtaagagattttcatgttcatgtgtcaagtaacaaagataagtaggaaaagtgttgtcatgtgttttattatttaataaggaaatacattttgttatgaatgaatacatttttttcttggcgtgtttaattggtattccttctcaaaatgtccaatgactcatcaacttagttatggcaggcatcttaatttgttaagttgcttaagttttctggttgttcatttccatgaagctgtgtgtgggatttataagctttttcccccaatggatatgctaataaaatacaaagtttgaaaatcactgagactgattaatcatattcctgtcagctctaaaattcagcagctcaacagtcagttatgtcaagggtgtccattatctgatcattctttctactgaaatgtgctttcttttcttcttcttttttttaatcttttcttctattctgttactttctattaaaaaatgaacttcattgaatcttaactcaatgtttcagtgtggggaaggtttactcaccattatggaacatttgaaaatatgtaagaggccaggcgcgatggctcacacctgtaatcccagcactttgggaggccgaggcgggcggatcacgaggtcaggagatcgagaccatcttggcttaacacggtgaaaccccgtctctactaaaaatacaaaaaattagccgggcgcggtggcgggcgcctgtaatcccagctactcgggaggctgaggcaggagaatggcatgaacccgggaggcggagcttgcagtgagcccagatagcgccactgcagtccagcctgggcgaaagagctagactctgtctcaaaaaaaaaaaaaaaaaaaaaaaaaaaaaaagaccttactattagcatttagtaaccagttagggatattgttaaacatcatgcagtacatcagagaatattcttatgtaaaagatcaatagcactgtttttgagacatattgaaatgggttatgactctatagcctgacagacattgcagtaaaactttttttttttttctgataaggactttaatttctggatttatttggtcatgctctctgcctcaagcacctttctagttaccctgtcaaaaatcttgtttgctcttgaaggcttagttcagatctcatctcctttgtgaaatcacttgtaaccctttcactttactataaactcagaggtctccctactttttgatggcccttgtataatctcttgaacacaagcttgaataatctccaaatgcaatggcaaattgagaaaaatggtactggcttttccattctgctttccgtgtgagttgtgtaaaagggccaagacatatcacttttgttttgttttatttaaattattgttcctacagagaaatagatgataaatactgaaataatagtgagtcatccttatacacaaaaacatcaccatagcaaatatgctacctaagataaacatgctgcatagctcaacctaactttacttatttgtagttaattcactataagaactcattgagagtacagcatgaaacttgttttttaatatcctttcttgctgattgtgtctcaaatccataacttagattttaatatatagactacctgatgataataatggtgttctagaaataaaggcagctttcggagcttctcttaaaaaaattaaagaccgtctacatgatcaactacctaccagttaactgaaacaagactgggtatcactggcccactgtcctagttcaaactcaatgaaggaatcaacactattctagatcatattcttaacactatgatcttagtgttaagaaatagaaaatccttgactcctgccatatgtcagtagtgaaaatagacccttccaagaccatttccaatccttacctctagaaattacatgctgtttctgattttcagcacatctcaaagagattcatatttcccttgagttacagttgttgtagtttgtaaaaatgttcctatttctccatatcctctccagcacctgttgtttcctgactttttaatgatcgccattctaactggtgtgagatggtatctcattgtagttttgatttgcatttctctgatggccagtgatgatgaacattttttcatgtgtcttttggctgcataaatgtcttcatttgagaagtgtctgttgatatcttttgcccactttttgatggggttgtttgttttcttcttataaatttgtttaagttcctggtagattctggatattagccctttatcagatggatagattgcaaaaattttctcccattctgtgggttgcctattcattctgatagtttctttttgctgtgcagaagctctttagtttaactagatcccatttgtcaatttttgcttttgttgcaattgcttttgatgttttagttatgaagtctttgcccattcctacgtcctgaatggtattgcctaggttttcttctagggtttttatggttttacgtattacatttaatctttaatccatctcaagttaatttttggataaggtgtaaggaaagggtccagtttcagttttctacatatggctagccagtttttccaacataatttgttaaatagggaatacttaccccattgcttgttttcgtcagttttgccaaagattagatggttgtagatgagtggtgttatttctgagggctctgttctgttccattggtctatatctctgttttttttttttttttttttttttttttttaaccagtaccatgctgttttggttactgtagccttgtagtatagtttgaagtcaggtagcgtgatgcctccagctttgttctttttgcttaggatcatcttggctatatgggctcttttttggttccatatgaaatttaaagtagtttttttctaattctgtgaagaaagtcagtgatagcttgatgggaatatcattgaatctatgaattacttttggcagtatggcattttcacaatattgattcttcctatccatgagcatggaatgttttttcatttgtgtcatctcttatttccttgagcagtggtttgtagttctccttgaagaggtcctttatatccactgtaagttgtattcctaggtattttattctctttgtagcaattgtgaatgggagttcactcattatttggctctctgtctattattggtgtataggaatgcttgtgatttttgcacattgattttgtatcctgagactttgctgaagttgcttatcagcttaaggagttttgggtctgagacaatagggtttctaaatatacaaacatgtcatctccaaacagataatttgacttcctctcttcctatttgaatacgtttatttctttctcttgcctgattgccctggccagaacttacaatattatgttaaataggagtcgtgagagagggcatccttgtcttctgctggttttcaaagggaatgcttccagcttttgcccattgagtatgatattggctgtgggtttgtcataaatagctcttattattttgagatatgttccatcaatacctagtttattgagtgtttttagcatgaaggagtgttgaattttgttgaaggccttttctgcatctattgagataatcatgtggtttttgtcattggttctgtttatgtgatggattacatttattgatttgcgatgttgaaccagccttgcatcccagggatgaagcctacttgattgtggtggataagctttttgatgtgctgctggatttggtttgccagtattttattgaggaatttttccatcgatgttcatcagggatgttggcctgaaattttctttttttgttgtgtccctgccaggctttggtatcaggatgatgctagcctcataaaaagagttagggaggagtctctctttttcttttgcttggaaatttttaaaagtaatggtaccagctcctcttggtacctctggtagaattcagctgtgaatctgtctggtccagaagttttttttggctggtcagctattaattactgcttcaatttcagaacttgttattggacctaatagacatttatagaactctccaccccaaatcaacagaccatacattcttctcagcacaacataacacttattctataattgaccacataattggaaataaaacattcttcatcaaatgcaaaagagtgaagatcataacaaacagactgtcagaccacagggtaagcaaattagaactcaggattaagaaactcactgaaaaccacacaactacatggaaactgaacaacctgctcctgaatgactactgggtaaataatgaaattaaggcagaaataaagatgtttcttgaaaccaatgataataaagacacaacataccagtatctctggaacacagctaaagcagtgtttagagggaaatttatagcactaaatgcccacagtagaaagcaggagagatctaaaatccacaccataacaattgaaagaactagagaagcaagagtaaacaaattcaaaagctagcagaagacaagaaataattaagatcagagcattactgaaagatccagagacatgaaaaacccttcaaaaatcaatgaatccaggaggtgtttttttgaaaagattaacaaaatagatagaccactagccagactaataaagaagaaaagagagaagaatcatatagacacaataaaaaatgataaaggggatatcaccactgatcccacagaaatacaaactactatcagagaatactgtaaacacctctatgcaaataaagtagaaaatctagaagaaattgataaattcctggacacatataccctctcaagagttacagttttaaagatgactttgattttcaagttttaacaagagaatagaattgtttcttcaaatacactaatatatttttgtaggatattacataaaactgtagataaggatgtgtctaaataaattcatgcttaatttttaatcagtttaataatctagatattttcattcttttttttttttttttttttgagacagagtcttgctctgtcacccaggctcagtggcacgatctcggctcactgcaagctctgcctcccgggttcacgccattcgcctgcctcagcctcccaatattttcattcttaatggataattaccataatctagaaaaacaatgcaagacaattgcagacttttgttaaatatgaaaaagcaaggtaattctgtaccatttcatacctaaagtaaaaaaaaaaaaaaagaataacaaaaagttaactgtaccacctatttttattctaaatatggagcatagtattttatttaagtaaggaactgttatatgtatgcttacatttcctaagacatcttcagagcattacttttttcatgttcttaaatggctatacaagtagtgtaaatgttcaatagccagaattctgtatgtaatatatctaagtgttatatatgtatgcatatctaagtgcttattctctttccagagagattatgaattttcaggatttaggaagtccagttatattgcctcttgtgaccttgggttgtacacccactttgaaaatcagtttggcaatatgaagccatatgggagtagtgatgaaaaataaatggagaaaaaaccctatcttctgcttggtttactacctaacatttgggaatataatattaggtaaatatattcaaatatattgtggatcagaaagtgctgggtaagtggaaaataagaggtggcacttctgggcattttcttttgatataaccattttgaataaaccatttacacaaacatacgcatacaacctcttacctaggaacatcaaaactgaatatttaaattatgtagtcaggaaacatttcgactaccatgggccctaggagtctaaggcatgttgaaatgaataaaataccaatactttctggaagcattaaggaacctcatgcattcagtatttgctggaatttgtccttttggcattgaaaagagataatgggtgattacactgtcaaaacttctaattctcaaatataatcttcaaaggagtgcctgtgcagacataggcagaataattttaatggaccttgaagcatctggaaacatagaaagaaaccttgcatagcaacacaggaacattgctgatatttttgtttgttctctctctctctccctctctctctctctctctatatatatatatatatacacacacacactcacacacacacacacacacaaacacacacacacacacaagaatatattctgtgtggtcttgaatgagctattcaaagtctccatctgtcatttccatatctatggaatggaagtaattatgatgatacagcatgggtttagtttgagtgtgaaatcaggcactgcataaatggcacgcaaaagagtgcctggcaaatgataagtactcaatacttgtgttgggaagaccacaccactacatagcttcctgcctttcctcatcatggggaatagttccatatttaagagaatatgaaagcagtgaacagtatcttattttgaaaaaacttttcattatgacagatttcaaacatgcaaaagtagagacaatgagtgaatgaaggaatccccatgtgtctatcattcttattcaattatcaacaattatcagtatctacagtgttaagataaataatttgcaaaggtagtgaaaataccttggctcaaaactgaacatgttcagaaccccatatactttacatatctcttgaggtaatagatttccctatgtctctgtaacaaataaatatatttacctatattctgttgttagatagatgggtttgaggaaaacaaattcactaaatgcagaatcaacttttacaagaaaaagaaattataaatgaaaagcttttaaaattggttcagtttgcaaaactgatactaagaaaatatgtcaatacatttttcatcagaataataatattagctaaaatcatagattgcttctatgaaacaggcttagcatcatctcaattttcatagcaaccctattaattaaggaacactctaattatcattatatagatgaagaaattgaggttttgtaaatgtaaacaaattgtccaaggcaagtggcaagactagaatataaatccagggctgtctctagagattattcgtaaccactataacatatctcaaaacattttagtcattagcctaataaaccaagaataagaacgctatgaaaccttattttacttaaaaaaaagtttttttaaacttatttattttaattatatctgtaatgatacattttataaaatttataaatgtttaaaatgtcatccacatgggattaaaagaaaatcataaatctcatcagggacaaaatggaaggaattttttcagaccatttttctgttgaacacaatagaagtttagcttaaatatgcactttaattaccccatattttgattccttgatttcaacaaaaagttctgaggttacttagaaaaaaacctagcatactctaatgagattttcagtaaatagaaaaactctgtcatatatgccatacaaagacaaataaggttcaaagtaataaaatatgtcatccagcaaaatctatgctacagatttaatgatgatgacaataatttagccaaggccagctgctgtactaatagaccccaaatccttgtaatggcacaaaacaacagaagcttctttcttatttcatatagcagcatggggtggatgaataagtgtccatggacgctctctatgtagtcattcaagaacccaggtgggttggggctcttccatcttcaacagctgggttcctgaatgattgcatggaggagacaaccatggacgcttgttcatcagttcatcactagtagtcatcagtcaagaaatctaagaataagaatgccatggaggcagggttatcagataaaatgtagaacaacaatgctatatgtagaacatactagcactaaaatattattctgtatttacctgaaatttaaatttaactagattttccatattctgtttgctaaatatggcagcactacatgtaactatgtaagaaaaaaaaagaaactgtgcattaaccttttaaataaatatttttaatagtatcacccttaaatgcttagcacaatgctataattaactttagtcatcctgatatggaaaaagtagtgggataattatctcttaattatgtgacgaggaaagaaaatgtaattttgacctccccaagtgggtaaatgactaagattagaagccatgtccactcattactagatcctgcataatcttgcataaactaatatcaaatattttaacgtttgaaagtatgctaaatgtttatcagagcaggtgattttatttcattgagttctcatttactcatgtatatgttaatttatctattatgtattcaaaattactcaaatattgtattgagtgctctaggataaatattaataagtgaaaattaacactaatatatctctgattctttgcaatgtgtataattaattacctgaactggacactattgagagaaaagggatgcttttaataatcactccagaacaacaggggacagcttctggaaaacagggacaaataattattctgttggtccacctgattttaagttttccaataatagaatttcagaggagagctatcatagagctcatttaatataattgcactttatagacgaagaaatctgaggcccagtgaaaagaaataataatttctgtatattaatgtttctcacttaagtttatgacattttttaatgaagaatgattgatatgagactttttccatcgtatactcctcttgtactggaccaaagattgttgtcttctaaaacaatacgtacttcaactaagatcctaaagaccataattaaatcttaacacattaccaggtatctctatttattcttttagagcacaaatccactttttctaaacctattaagaactaagtatgtgttgcatgaagttttaaagtaatatttcatcttacaatccagaaaactcttttatattctaatggctctatgatgttgtagaacaaatgacatgtcattatttgaccgagaatggaactaaacccaaaaatggcccagccacagaatcttaaaatcttctattaatatggtctctggtaaatataatgagctgaaacacaacttctatggtatttttagagataaacattattttctcttgaaattctcacagtattcttttagtgcttacatgtcagatgtaggtttttaattgttaaacatgaaaaatactctgataatttaactactcctaaatttaagtgtatatatgctttcttttttgttcacagtaatgtaggagaagcagtgttaaatgatgctaggaatctgtactctagaaccggattgcctaggttcaaattctgatacaaaaactctatggcttttgaaacaaggcttacatttctaaccagcctattcatcactgttctcatctgtaaaatgggattcattatggtaataactacataatccagaacagataagtaaatgatttaattaatataaaacaattatcagagtgtatctgtcatgtattagacataataagcgtaagctttcatcagtatgttatttctttaaaaaaatccctcttttctctgccttataatttttggataattttttccaaatataaactggtaaattataaaccagttaaaatatcaggacattattgtttacaatatgtcgtttttaaaaactaattaagatcacattgcagtgaagaatgaccccatttaatatatattgacattatatttttgagcattttgtagattaaataaaacaaaaaaagatttaatacgaaacattttctatgtttgataaagttgcatgtatattatcactgttattttcttacctgttaaggaaaatattaccccaaatttaagttggaattttaaaaatgcatactattaagagtgaataagagtttatattctgcttgaattcctggtttatgacatacatacaaaatgagaaaggaaataaactctaggatgaatcttattttagtaagttaatggccttttcactgaaagtaggaaatatttcttctttcaaaagcacccaagatcaataaataatcttgatttaggaaatatgacaatgcaaacttttttcaaaatctgcttaaaaatgtaataaacaccatatcaatgggaatgtggtaataatcagaacaaattttctcaaaaatatatctttttttaagaatgagcaaatcaaatattttggactttattttttcccatggtattatcattaagaatatctaccccaatgtctgctttctccactttcatgcctaaactacagaacatcactggacaaaataataacatcttgctgatggggtccactacccatgacacttcagattagctctcagttggtgttttacagtattttatttccttgttttcattttctagtgactccattttacagttctttcagtgacttttctaaaatttaacagttctgagtgtcatcatactgcttctattccctctccctttaaccagatgatctcaaatccatcaatatggggaacattgaattctttttacttttttttttcctggttttgttctttagaagaacaagaagttcccttcaacagttttcaaccaaacatctgtcttcaagttacatcttcatcatctcaccatcctgaggattaaatgtgataatctatgtaaagcacttaacaaaatatcaggcacttaataataactattatctatcttttcccctagtgaatagtgggcaaagtttcaaccattgattatttgtttaaatacttttatttcagtaaaattgcttgcctttgaatatattttgccagtgctgaaaatcgtcatatgtcttctaatatccaaaaattactgaataaaatagtggttaggagcaaaggggcaggggccagacttcctaggcttaaatgtcacctttgccacttacaagctgtatgacaattgtcaaagacttaaacttgcctctgtatcctcatttggtaagttatttaaaaaaattatctctagtacagtaaagaagaagaagtatgataatatacacaaaatgcgtagaactgcctgccacatgctaagtactaacaatactagctgttattaattttcactgtgtctaaaattcattatttcagcaaatatctattgaaaccctattgaaaactaattgtgatgtgtgattttaaaggacaatgataattatattacttattgtctagacagcaaaaaaaaatacaaagatacaaatcaaagtacaaattatattaaaagctatgaggaagtgtcaggttatcagaggggatgttatcaaatttggaaaatcaggcaagctgagattcttagagtttgtaggtgctcattacaattttattttattttttctgatagtagtaataacatattttctgactatgataaaagccaaagtgttatctatgttctttacgtgaaagttcacttagattctctttctcatatggattatagattgtcccttattcaggaaagcaggacattttttggtctgaagagatttccctctgggtttcatttgtatcaaaagtgaattgtgaatcccaaaggcattcacattgtaagatgatactactagttgggatactgaggttccatttttattcctttaatagcttcctaattatagattccttttcctttaatttcagcctctatattaatgataaaactaatctgcaatctctctcaaataacttttatgctaaaagcaattaggtagatattttcttggctccttagagaggaaatagatttagatatgcagaaagagctttgtcattaaggacccaggtaactacgatcctctaacagttaatgacacaaggaactgggctcaagtagagacatatagtttaaagtgaaaacattttgacctgaaattccaaggtgcacctggtaattggtgaccttaacaagtggttatgacagcaaagtcctacagtttgtggaagatagaaagcaaattcactaaaaggaaaggtaagaggaggaagcaaagagaaagaatgcaacagagaagaagaaaaaagaataaaagttttccctaattaaatgcttactatcatccctttctcactgctattttataatattaattttatatattactaattaaaaactatataattatatacataattaatttttttctggttcttcaaaatatttgactaaataatttagaggtctcaaataaaaatggtaattttaagaccactgtgatcaagttctggaaatttttaaagatctaggaactttttaaagctttaatattttttgattatttttatattttatacaacatttttactaattccaaagaattataaatgactattatgtatttttatttggaaacattttggttatttgggaaaaagtaggtgttagtccagctatacattgtatgtttactgatggagaaaaaaaaaatccctcttgttattagacactgttattttactgatacccaaattctatatatttagatatggtttgggatgagctgtgtaacttatttggacatgtgaacatctttcactatatgttttgcatatgaaaaaaattatctcactttgccttttatttaatgattctttgaaatatattctttgtataaaccttataaagttgtcaaaattaattttcaattagaacatccataaaagtgccaagttattataactactgccttatgattcactcaaagtaaaggataaatccataacattttctattaattgaatagataatcttcattttacaaatgatttccatatagaattagtgttacgataggcagttcttagtgaaatcaatatcagcttatttcctattttgagtcatgaaccaaatcattgtcgtcatcattaaatctgtagcatagattttgctggatgatataatttattactttgaaccttatttgtctttgtatggcatataagacagggtttttctatttactgaaaatctcattagagtatgctaggtttttttctaagtaacctcagaactttttgttgaaatcaaggaatcaaaatatggggtaattaaagtgcatatttaagctaaacttctattgtgttcagcagaaaaatggtctgaaaaaattccttccattttgtccctgatgagatttatgatttttttaatcccatgttgatgacattttaaacatttataaattttcatgaaaaccattttcatatctgttaatataaattactctatcaataattattttttgtagcaaagaaaattaacaatactttgccatttttgttcactttggcctcctcctgatgtcattcttcattttatccacatttcattaatgtgcattttataaactatgctaaaaatagcctcttttgaccacatgtgactgtgactcagaaagtttacttgcatctgtgcttcaaatgactaaacatttttggtttctataatggcaggtgaagggaattaaagaagaggtaaagtaaatattttaactggtgtataatatggttagatcatcctgtttttgtgccttccactatgatttgattacttctaagataaatgatttcgagcatatttgacgtgcaaatatatttaagattcaactatcaacatttgcttagtaattaaaaatttagtttttcaaaaaatgctgagtgccattttgtagctgcagatgaaatttcctaatatcgggaaatgaattgtttttatttgtttgtgtgtctgtttgcattttcccatggcttgctggtgcttatactttatttttcctcaattataaaaatattgttctaaaagagaccttagagttctacacagcaacccacttacacagctcaggaaacatgggccaagagagatgaatgttctgcttcttcagtggttcttacccctgaatgtttgtggtaatcatcggaagcacttgagacccaaggtcagacttctaccactggcagctctaaaatccaagttcggggtgggtcctgaattgtaatttttaaagtcataggtcactggaatggtctgtcaaggctgaaaatacctactcatgcatttagtcttatagaaaggacataagggttattgtgatttcttactagtagaattgaaattagcattaaggcacttaatactcccttcactctaatattctgcctctgtttttttttttttttaatggaagttattctacttgcagacactcgtttttttttttttgtttttttgttttgttttgttttgttttgtttttttgatggaggctcattctgtcacccaggttggagtgcaacggtgcaatctcggctcggctcactgcaacctccacctcccaggttcaagcgattctcctgcctcagcctccctagtagctgggattacaggcgcctgccacgacgcttggctaatttttgtatctttagtagagatggggttttgccatgttggccatgctggtctggaactcctgaccttatgatcgacccgcctcggcctcccaaagtgctggtattacaggcgtgagccaccgcgcccggccgacactcttgttcatccagaaatctggtcaccagtttccttgccagtatctaccagcccattctgcaattctgacggaattattaaactcctctgtgccctaggggcactattgccttatgcacagataacatctaggagacactggtttttttttctggtatatgtaacaaaaaagtaacaaaagcaaattgctgaattgccgttacaatagtacttaattaatatgtatgtataactgtatatgtgtatatttatgtacttagtgtttctgtatttgtattgtttttataggaaatgcactgattctctaatattaacacaaatcctcttcattcaataggtgttaaaaatctctaacacacttgtcagtgctctcagatatgagtatcttttcattgtcaagtcgcagattcatgtctgatttcagaactttgtaaggccagtgaaagtgagtgacgaaggatcatttaaagacaaggtacaaatagcttgtagatatgtttgtatcatataaatttactgtttatgtggcattttgagatctcttacccaattgacaccctttggcaatgaaagtgaatccttcatttatccactggttttatttattcactatttttcattcattcaacatttattgagcattcactctgtaccagatgcaattctaaaagctgggaatacaaaagtagacaaaagtatacctcattctggtcctcatcacacctaatagctactggtcaagacagacattaaatatcatccaaataatcataaaatttactgtggtgagtgcaataatccagggatctaaactagtctgtgcaggagtggaggtggataaaggcccaggggcaggtaaggctctcctgagaaggtggcatttaggaagtagtaagtaggcaaagaggctgaataatagttcccatatgaagagagaagaataaatgaaaaggtgttggcactttcaaggaactgaaagaaaaagagggaaactggaaagtgacatttttacaagtatttgaaacctttttttttcatgtgtaaatgtgggattacttttacctttgcagaaataatatattggattgtaagagttgttttcctgaaggtcatcaaaaattagaatggccattttcctaatttgtcttattatggcagtctcagtattaacaacaggtccagccctctttcagaaaacaaaatattaatagtgacctttttactcctaaatgcattctagtttggatagtaaatcttatggttagcctatctagaataaaagaatatactttacccaattcttaaagttgcaaaggaaggaattctggtaaatgcatacataggaaagtgtagccttcttactttttgttttgtataatgtcttggtatagggaaaataagctaccaaataaccaaccaacattttaacttctcttattttcttccttttttccttccttttcttgttacttttcaaagtgcaagtaaccaatattatggaatgtctaccttatgcatggtgcagtgccaggcaatgggtatgtagtagttaaataggcaggaattagaacaaaaaaaaaaaaagaggaaacaagatgaatttgagggggtgctttgagagggcatgagagcagctataatatgtgctctggttaggagaagaaaaacatagtatttttaagatactgttggagactagtgaccttttcttaacgtttaaaaatataacaagagagtcagttttttctgattcttcatgtcctaagacacaagaatctcttgggcaaggtaggatcctccttggaggacagaaattagaaagtctgaatcagaatcctcagtatttggcagagggaaagaagatactggggaaaagagcatggcttattttcttttcatggtgacactacttttctattgggttgcaactaaatttgggaggttgacacagtatcataaaagcaaagaaagatatccagccctatagtctttttttttttcttttatgatgtaccttcctaggtcaactgagttttgcatattcctcattgctgggactgtagtcacctctctttttattctcactacaatgggaaataactgtcttcagatatcaacagtgtggattccttttaggctagatttcccacacttaaatatcctagtgttatatcagggacgaggagacaagacaaagagacatgccattttcatatttatatttttcccctctccaattctttattttccctccaattccagaaaactcctagcacttctcaaatgggaacatattaaaatcctagcaagtattttaaaaattctattgatagtctcaaggcttcagctttcggaaattaaaataattttgcttctctatttggttcttctttctttttcagtaaaagcacctacttgaagacatagagatcttttcccctactaagttgcccaacaggagatgatcagtttaaagaaaatgtggaaatacaaattcaatctgtaatgcatcacctggttttttccaacacacaagtaattgacctctttatattctgatttaagttcctaagtatttgtgtttgacaagatctgtagtgtctgacatagggcatcctcaaacagcacggtgccaaaaaatatggggtcagaatggttgggttttaattgtgactctgatagttactgattacggaaccttgggcacagtatttaactagtctatatatctgcttcctcatctgtaaattggaagttattataaagccttccatatagacttcttatggaaataaaatgaaataattcatacgaataccctggcacatattaggtactcagtgaatgttagctagtattacaaatgtctatgacaatttaattagcatgatgtctagaaccgccattatttgattagaattagtttagcaggaggatgaaaaaactgagaaggaccctaaaatgagtagccatgctgttttatttactcctttctttatttaagacatgaacaacactctaggtacagttttatattttaatggctatgttgtcttctcttcgtccttacatgaaataccctcaccctctcccccagaaaaaaagaaaagaatcattccattgttagaatgcagtttagagattataaactccaaactctgtacgtcattaaaatttatattcactgggaccttgaacttagtcttcaacttttacatgcaataccattagtttatttaagttcagttgattcactgtttgtctccctccacaaaccaacctcttgcatcagatgttctccttaacttgcttagaggcctgccatttctttggatttttttttccattttatcacctgaaacctcatttccatcttaagtaggcctcccatgcattgtctaagtatctccctaataattcccaacattttcttgtcccaactgcagcctagttctctctttaatagaattgttttacatccctctcttgttgcagatatgatttctctccaactccgtatgtaaaaaagataaggtgaaaagaggatattgtgagcaactcagtttcccttgccacttcccagattggtagtccaaccccttctctgtgtctattccctccagccatgctactattaatttattcttgtggtctccttgtatattcacagaggactttgcgttgtggctcatagtcttcttgttcaccataatttatgacatcatgagggctccttaagttttcttgagccttttggtattaacgtctgtcaatcccattctgctttagcaaactcactgtctgccatcacttctgggttttcttcctttgtttcctttgttctgcctggaactcactgcctttccaacattttcattgtctttatcccattctgcatctgtaccattatccctaaaacttgtcttcatctaataatttacttggctagtactatcctgagaagtctattagaactgctactacaaatttatggtcttaacttttttttttttattattatacattaagttttagggtacatgtgcacattgtgcaggttagttacatatgtatacatgtgccatgctggtgcactacacccactaactcgtcatctagcattaggtatatctcccaatgctgtccctcccccctccccccaccccacaacagtccccagagtgtgatattccccttcctgtgtccatgtgatctcattgttcaattcccacctatgagtgagaatatgcggtatttgttttttgttcttgcgatagtttactgagaatgatgatttccaatttcatccatgtccctacaaaggacattaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccagcaacagtgtaaaagtgttcctatttctccacatcctctccagcacctgttgtttcctgactttttaatgattgccattctaactggtgtgagatggtatttcatagtggttttgatttgcatttctctgatggccactgatgatgagcattttttcatgtgttttttggctgcataaatgtcttcttttgagaagtgtctgttcatgtccttcacccactttttgatggcgttgtttgtttttttcttgtacatttgtttgagttcattgtagattctggatattagccctatgtcagatgagttggttgcaaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaagggagggatccactttcagcttcctacatatggctagccagttttcccagcaccatttattaaatagggaatcctttccccattgcttgtttttctcaggtttgtcaaagatcagatagttgtagttatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaatcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgccaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctggattcggtttgccagtattttattgaggatttttgcatcaattttcatcaaggttattggtctaaaattctcttttttggttgtgtctctgcctgactttggtatcaggatgatgctggcctcataaaatgagttagggaggattccctctttttctattgattggaatagtttcagaaggaatggtaccagttcctccttgtacctctggtagaattcggctgtgaatctatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattatgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccgttattaatgtgtgggagtctaagtctctttgtaggtcactcaggacttgctttatgaatctgggtgctcctgcattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatggttttcctgaatacagcacactgatggatcttgactctttatccaatttgccagtctgtgtcttttaattggagaatttagtccatttatatttaaatttaatattgttatgtgtgaatttgatcctgtcattatgattatagctggtgattttgctcgttagttgatgcagtttcttcctagtctcgatggtctttacattttggcatggttttgcagtggctggtaccggttgttcctttccatgtttagtgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacctgacctttctctctggctgcccttaacattttttccttcatttcaactttggtgaatctgacaattatgtgtcttggagttgctcttcttgaggagtatctttgtggcgttctctctatttcctgaatctgaacattggcctgccttgctagattggggaagttctcctggataatatcatgcagagtgttttccaacttggttccattctccccatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgatcgcattggctcctgaggcttctgcattcttcacgtagttctcgagccttggtttgcagctccatcagctcctttaagcacttctctgtattggttattctagttatacattcttctaaatttttttcaaagttttcaacttctttgccttcggtttgaatgtccttccatagctcagagtaattcgatcgtctgaagccttcttctctcagctcgtcaaagtcattctccatccagctttgttctgttgctggtgaggaactgcgttcctttggaggaggagagacgctctgtgttttagagtttccagtttttctgttctgttttttccccatctttgtggttttatctacttttggtctttgatgatggtgatgtacaggtgggtttttggtgtggatgtcctttctgtttgttagttttccttgtaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcaggttctcagatctccagctgtgtgctgggagaaccactcctctcttcaaagctgtcagacagggacatttaagtctgcagaggttactgctgtctttttgtttgtctgtgccctgcccccagaggtggagcctacagaggcaggcagacctccttgagctgtggtgggctccacccagttcgagcttcctagctgctttgtttacctaagcaagcctgggcaatggcggacgcccctcccccagcctcgctgctaccttgcagtttgatctcagactgctgtgctagcaatcagcgagattccgtgggcataggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgctcacccactggcctgcgcccactgtctggcactccctagtgagatgcacccagtacctcagatggaaatgcagaaatcacccgtcttctgcgtcgctcacgctgggagctgtagactggagctgttcctattcggccatcttggctcctcctggtcttaacttttatgaactcttatacagccacttgtccaattttccaaaacagcaattctaaacttttctctccagctaattattaaacttaatatcctatcctgatgctattggaagattgtcactccagagaccctccagaaacatgatcaatccaacaatagcatgcaattgcagcatcaatttttagaaagccagtttttcttctgtgtgtgtgtgtgtgtgtgtgtgtgtgtgtgtgtgtgtgtaagttgcttgaaaggtagtcagctattgatagaacttgaggtgagaatttaactggggtttggttgctaccagtacagcatttttgcagcatcccttgggttcattggaactaggaaataaagagtatatatattatctaaaatagagaagaattgaggataaccgtttatccatttatataatgtgtagctaaaatctctctcatatctccttgaactgagaaccaaaatgtttttactaatttatttatttaatgaaatgtattatttaaataaattgtaatgtgtgtatttaaggtatacaacatgatattatgggatacatatagatagtataaaggttactgcagtgaagcaagttaatatatccatcatctcacatagttacccattagttttagtttgtttttgtggcaagagcagctaaaatctacttatttagcataaatctcatatactgcacaattttactatctacagccttcatttgtacattagatctctacactcttgcatcctacatatttgctactttgtatccactgatctacatctccccattcctcctgcctcctgccccttgtaactactcttttgcgttctctctctctctctgtgtgtgtgtgtgtgtgtgtgtgtgtgtgtgtgtgggtttagatttcacatataagtgagatcatgcaatactttcctttctatgtctgacttagttcaataagcataatgtactccaggcctatccatgttgtagcaaatgacaagatcttgtccttttttagtggcaactcaattgtggaaaaacaaataaactgatttaaaaatgggcaaaagacctgactagacattttttcaaaagaagacattgaaaatggccaacagattaatgagcaccattaatcatcagagaaatgcaaatcaaaaccactgtgagataccacctcatacctgtcaggatggctattatctataagtcaaaagataaggaatgttgaaaaggatgtgggaaaagggaactcttgcatgctgttggtggcaatgaagattggtacagccgttatggagaacagtatggaggtttctaaataaattaaaaatggaactaccatatgatcttatgggcacatacccaaaggaaatgaaatcaccacctcataaagatacctgcactcccatgtcatgttcattgtagtgttatttaaaaaagctaggatatggaaacaactcatggatgaacagataaataaattggtacatatatataattttactaatttcaaaggcttattttctaagacaaaatttaaaggggcagtttcaccccagatatgcccaatggaaactagcaagtgtgtgcatgagagatgactggtgccttgccacaatggcatgtaccatcatcgtttgcctcagctatggcaatagcttccctactagacttccagcttctcccctcaggccctccagtccattctccacactgcttccatatcctcctttttagataacaaaactgataatagcaggcctttctcattagtgattgggaatttggtaaaatgaaggtttctggactacatcctacggagttagattgtaagcttgttctattaatctgtgttttaattaagcattctgtggttttcaattgctattgctccacaagttatattttgagaaaacactgacccacagtatgatatcaaacatatgtatgcatttaaaaaaaaacctttcaagatctgttctttagtatcattttttactactggcccttaggcatcctgtgccttagccatatgtattactcatcttcccatgtcctgtctctcctctgtgcctttaattatgctctactgtttcttttgctcagaatatctcctgttctactgctatctgagacgcgttctttaagtaacctagccaggttagacacttgtcctctaccgctctagctttgtcttcataatccttgcaaactagttttcacattgtcttgtaattatctctctctcccctcctcacctgtgttgactgtggtcttcttaagcaaatatatacaggtcactgctttcatcttctgtatctgccacactgcctggatagaggaggcattcaattcattattgctaaggcaatgaatctatcttcaaatctgtatgtctcagattccttacctgtaaaataaagattgccagagagactttttcaccaaacaaggtcttattgatccggctcgcttgcgcttgctcgctgtctctctctctctctctctctctctctctcacacacacacacacacacacacacacacacacacacgtggttcaatatattttaagtttatactgaaactatttaaaataaataactctatagaatatataaactattagttatagttttcttttgctttttaaacctagtttgtttcccaaagctaatgttagataaaaagataatcaaagtagccagatggtcgttaatcatgagggctttttattctataaacataaaaattccatcacctccgaggagtttcacatgtatcttggattcatcctaatgtggggtatgaaaaattggtttcaattcagatgtacgatttagatcacttacctttttcttccttatttttcttgagtagggttgtgagaaatggctcaatgtaaaaggcataaacatagaattcttgatgtaaatggatgtagtcagcctcaatctaattaaagatttctctctttcctttaccctttgtcagtatctttgtctcttgcttctagaaattaaattggaaattttactatgtttctgtccttttctaacctttacttttatttgctcacacacatatgctaagatgcacacagatacacagagacacatacagtgtaatttgcagataaaggaattcacacagaaaacatatatagggtgaagttactttgtatagtataattaccatggtaccctctactctacatttcctaatttatctgaccaacttggcattcaatgtgaagtatattgtgtgagttatgtctattaatacattatgacttataatttataaaccacctttaatgcaaagcaaatactatttcaaggggaaaaattgcatattcaatttttctttatttatacataccctaggatttacttacacatggatgatttatagagatttccccattgttttaaagtaatttatggcaacattcctttatctaatgaaagccaagcaaagggaaacaaaaccaaaaccccttttgatagagaaatgctgagtgagaggtactaggaaggggcacgaaaaagcatattctatggcttaatgctctaggcttacaaaagcatggtgttggaatggtaattggatttctgagcattgcttttgtgaatagactgcttaaatcattgaaaaggaaatcattgcagaaaagaagcagggaagaattgcacaggctgtttgagtacttacaaactaagaataacatacgaacaatgaagaactggtttagtgctgttgagatttgacatctttaaaaacctgatattgtagctgtagttttgatcttcgttcctttgttgaatgaagtcccaatgcattttggaccagtactttcaatgagggctgaaacaaatgagatttttaaaatgctttttccagaaaaataaaattttcccccaagtccacattatatttttgtttgaaaaacacagatacagatacatatgcatctctatttttagtttgtttcacatgtttatttctgcggtggttgacttgccattcttaaaatgttaaaagtcctctatcctcccaaactttcatgttaatagagtgactgtcacactgtaagcattcaaaaattattttgatgtgctagaagaggcttgggaattggaggtggtgtctgggtgttagcctcttaaatctgcatgtaaatttcccatcagcaattataaaaggaaaacatgtcatttactagacagagttaaaggatgtccactatctgctttttcaacaatacctatccactatcactggggaatcgtgaacatggacacaatttttaccttcagataacttatacgtattgcccctctgcccagtttttgcattttactctgaaaggtgcagaaagaaacaagaaaagataggaaatagacttctaggagagtttgcttaaaaaaaaaaaaagagttccatttttcttggagataatacaacacagatttttacttgtccttgttaaatttgccacagaagataaaacatttgttgagtgtgtaattccatgctaaacaacttgctagttatattaatcatatattaaatatattggtcagaataaccctccctttattttatggtgagcaaatggaaaacatagtgataaaaatttttcagggtcaccataactagaatttcaatccagttcttttggactccaaagcatatattttcctctaccgtgcagtaatttattttaaacattagttatttgaagacaattgaagtactgtatacttttctttggggaatattcattgctttatggaatttcttttaatttttgtactctgttgttaagttcaaatacaattgtacttttctctttgttcaaatagaggaaagaaagtcactcacaaagtggcaatgtgcaaaggactacaaaaaacatctattctccatctgagacctagctttatagagacaataagaaccactgggaggaaaccagtgagtgtcagtggtttactctagtgtaaaacatttggctctggaaaaaatcatgttttttataaaattgcacagcacaagacacagaagcactttttataaaattatgaatgacaattttgaatttttaatgttttaactatttatttttaaaacatgccttactagatagcttcagaatatatgaataaaaatatgtaaattatttactaacattcaaagcagattatggtggtaaggaaaatgttcctgtaatataaccttcaatagcaggtgttaatttcactgatttctcactgcttatttagatggaacagtgccttccataccgtcaatgacagagtgtgagtcccacagtcactcagctgggcttcataatgtcctacttatttcctgtgttatgtgaggtttgtcacttaacattcctgagtaagaattcttcttctgtaaagtagggcactaataccgatctcataaaatctctgggagaattagctgactgatgtaggaatgtaataatggtagccagcttgtcctgagtacttacagtgtgcctgggatctcctcagatttacaggcattagcatctttagccctcacaacagcctataaggttttactgttaagcctccttccactggggagacaactgcaaggcaggaaggggcatcataaaaagataggagtgtcagaaccagtgctggaagccaggcattttgactccacaaattgtgcacttggccaatatactatactatcctgactcccaccactcaccacaaagttaggatttttttttcgttcatggccaacaggtctatgaaaaattgctcaatatcactatgagggaaacgcaaatgaaactacagcgagttatcaccccacacttgttaggatggctattatcaaaaaatgaaacaaaagatagtcctcctatctaactgaaattctgcatcctttggccagcattttctcaactcctactaacacaaccacccaagacctttgtaaccactattctgttctctagttgtatagtatcaaccttttttgattccatatttgagtgagatcatgcagaatttgtctttctgtcctggatgaactcacctacaataatgtcctccaggttcattcatggtgaggcaaatggcaggatttcctttttctgtggctgaatagcattccattgtgtgtctttaccacattatccattcatccatttatggacttttaagttgatttcatatcttggctaatgtgaatagtgctgcaataaacatggtagtgcagagatctctataacatactgattcatttcctttggttatatacccagtggggggattgctggataataagaaaacaagcattggtaagaatgtggagaaattagaatcctgtacactgttgggaatgtaaaattctgtagcagctatggaaaatagcatagaggttcttcaaaatgtaaatatgggactaccatatggtttaacaattctacttctggatatgtatccaaaagatttgaaaacagggtctcagagattgtttgcgctcccctgtttgtggtagcatgattcataatagctaaaacatgaggtataaatatagaatggaatattattcagcctttaaggaaaatcctgtcatatgcaacaacatggatgaatctggaagccattatgctaagtgaaataatccatgcaaagaaaaacaagtactgcagtatttcacttatatgaggagtctaaaatagtcagacttacagaggcagagaatagaatggtggttgccaggagttgaggggaggggagaaatagggagctgctattcaatacctgtacaaattatacgtggttctagaaatctactgtattaaatcatgcctaaggtcaataatactgtgttgtatacctaaaaatgtgttaagagggtagatctcatgttaaatgttctcaccacaataatctgcatgggttgaattgtgtcccccagaatgatatgttgcagcactaaccctggtacctcagaatgtgaccttatttagaaatggtgtccttgctgatataattagttaagatgaagtcatgctacagtaggctgagttctacatccaatatgcctggagttttataagacaatgtgaatttacaaaggaagatgccacgtgatgatagaggcatagattggaattataaagttgcaatccaaggaataacaaagatgaccagcctcctccagaagctaaaaaaaggcaagaaaggttcctacccagagtctcacagggagcatggccctactgacatcacaatttcagacttctatcctccagaactgtgaaacaacacatttccattgttttaagccacccagttagtggtcctttgttatggaaactcttacacacatacatatatatatgtatatttaatagatattttaagaaatattaagcaaagtattaggtacaataattgctcaaaagcgattgttcctattttatatagtctaatagtggggaagtctgtgcttatgggaaacttttaaaaacatcaaacacttcctgtgtgtaatttgctaaagttaaaaatctgtaaaaccacagtgttcttgtgtagtccttcaggagacaaatatgtgcctttcttgacatggaagtttctttccacctcagccagtagcacattcactccaaacttagcattcatcatttatggcaatcagatcagtatttaggtctatattgccttgtagtatttatttttattttaaccatcttattttctttatgtatgtagattataaattcttagagggagagaattatattttatagttttgtaacatagcacctaaaacaggacgatgtttgatatggtttggctgtgtccccacccaaatctcaacttgaattatatatccaagaattcccacatgttgcgggagagacccagcgggaggtgattgaatcatgggggctggtctttcctgtgctattcttctgatggtgaataggtctcacgagatctgttgggtttatcagggggttctgcttttgctccttcctcattttcccttgctgccaccatgtaagaagtggctttcaccttccaccatgattctgaggcctccccagccatgtggaactgtaagcccaattaaacctctttttcttcccagtttggggtatgtctttatcagcagcatgataatggactaatatatgtgtgcatgtatgtgtgcgtgtgtgtgtgtgtgtgtatgtgtgtgtgtatatatatatatatatataataccatgtgtaacatttgaaaatatatatattcaaatttcagtctctggcattcatactgaaatttgtttgtgggtacctcaattggtcagcttaatgatgtcttcccttctcaagggaaggtaggtatattagttttctagagctgccataacaaagtactacagactgggtaacttaaaacaacaaaaatgcattgcctcactgtttgggaggctacaagtccaagatcaagggttggcagggctggtttcttctgtggatatctccttggtttgttgttggctgtcttctcactgtattgtcacatggccttccctttgtgcctgtgtcctcatctctactttttaaaagaacactagtcatattagattagggcccaccctaatgacctcattttaacttaccccttttataatccatctccaaacagagtcatattttgagatatcgggggttaggactttaacatatgaatttgagggagacgcaattcagcacaaagcacaaggcataaataacttgtttttgtacagattcttagctaaggaactacctttctagaaagccctgtgaaatattcaaaagtatatgaggtgacagatacatgaattagcttgatttaaccatttcacaatgtatacaggtaccagaacatgctgcacactgagaatatatttcatttgtacgtgccagttataccttagccataaattcatgtggatagataacgtttttctttaaaagcaaacttaaagaatattaatcaaagagtattcatatcaaataattactgacagtgttgttttccaacctgataattttcttgaggtaagaaaatatagatcacggctgacttcagcctcgactacctgagctcgagtaattctcccaactcagcctcccgagtagctgagatcacaggtgcacaccaccatgtctggcaaattaaaaaaatatatacatttgtagagacaaagtcttgctatattgcccagactgaataatatgcttgatcaaactgctaatattgatttggatttgaatatagtaatccctattatttcaagtaataatatcttcaaagtaatgaatgcaaaggagataaactgatatttgaacacactaacatgaccatttcaagaatatgacatgacctcttcaattgctccattcggcttttagatggaaggagaatgcattagtctcttacaggatgtactgtctttatctgaggaactttgaagagtatgaaaaacagctactagggaaaaaagaaagcttttatattctttgatgtggaggattctgtgattctaacactgtgattatttctttctgtaccagagcttactagcctacacagatattagaattcatagctatatgtaattcaaatttatttctgtatgtgagaaggaatgtgattcccttctctaaaaatcatttactgtatagacataacataacattatccctctattattggtagaaatattacaaatcttggatgaaattttttctcaaagcacaaatttatgctgctaaatatattgattcagatcagtctccaaaaacaacactaaataattagtagttttcagaaattttagagaaaaaagggaaaaatattcagaggggactttttaatgaactctagagacatacattaatgtaagtaactgtaagtcggtgatgttccacaattactttttactacccaccatataacaagattggatcatgtgaagtgctgtgcttaaaacttaatcttaatctcaacatatcacagaactacatttgccttgtttgccagtaattgaatattcagggtaatcactaccatactcaccaaagaaactaaggccagcctctctttcctgaatcttactagattgtagttctagaattggccttttctttcactcctgaaaataaggcattgaactgtgtttcagggcaggacccagtctttcctactcaccctactgtctctagatttactcagagctgtcccctgatggagatgcaggattggatagaaaggatgctttcttctctagaaatatggttgttgtggattaaaagtgtctggaggtgagggatagaagacttcacatagggtacagtgtatactgctcaggtgatgggtgcaccaaaatctcagaagtcacctctaaagaacatattcatgtaaccaaacatcacctgtttcccaaaacctattcacgtaaaaaaattagagattcccaaatccatttccagtaagtctgaagtagttgatctaggcaatttgaagaagattaaatattattaaatactctagatgattctgatatggatgactaagagccctactccaagacaggctcagaactccagaatgctgacagctgaatgaaaagggaacatttgcttctcagtagaaaccaagcagtattgaagaggtagagggctagagaggaagccaagaataaaattccttaaaaatgaatgggtgcttctgatccaaaatgatttttcagaatttactacatatataaggcagcctatccccttttttatgagatcagttttatattgggaacttctcacattatcatgtctttaaaaaacaaacaaaaaataaaaccttcgcagaggcactaaaaagagagtgtcttttcaacaatcatgggagttttttttttttttttttttttttttttgaagttttaagctacttatttattgtttgggaagacagtggtggatgtacttcttggaacattttaacttagtttctaaaacagctttattggggtataattgatataaaaacagcatacatatttaatctatataatttgatgagtttgaacatacacatacatctgtgaaactttactgcaagattataataaacatatccatgactctcaaaagtttctatgtgccccatctcctattttgttgtaaggacatttaacataagatctaccctctaaacaatttatttatttatttattttaataatttcaagttttgttttagatttaagaggtatatctgcagatttcttacatgggtataatgagtgatgctggggttgctgcgattgaacctgtcacccaagaagatagcatagtacccaacagtttttcaacccttgctccctcctccttacccccttgtagtagtcccaatgtttattgctgccatttttatgtccatgtgtgtccaatgtttagctcttacttgtaaatgagaacatgttgtatttggttttctgtttctgaattaacttagaatgatggcctccagctgcatccatgttgctgcaaaggacgtgatttcattcctttttatagctgtgtagcatttcatggtatatatgtacaatattttcttcatgcaatccaccatcaatgggccataggttgatttcatgtctttgctatcgtgttgtgatgaacacacaagtgcatgtgtctttctagcagaacaatttactttctttcagatatctacccagtaaagggattgctaggttgaatggtagtcctaagatctttgagaaatctccaaattactttccacagtgactgagctaacttacattcccatcaacagcacataagcattcccatttctttgcagcctcaccagcatctgttgttttttgactttttaatagtagccattctgactgggatgagatggtatctcattgtggttttgatgtgcatttctctgatgattagtgatatagattggatatttgtccctgcccaaatctcatgttgaattgtaattcctagtgctggaggtggggccaggtgggaggtgtttagatcatgaagatagatccctgatgatttggtgctgtcttcatgatagtgagctcttgagagatctgattaaaagtgtgtggcacttctccttccccctttctttctctcgcttgcacctgctttcatcatgtgatgtgctccctctttgcctttcaccatgattgtaagtttccagaggcctccctagaaaccaagcagatgccagcatcatgcatctgcagaactgcaagccagttaaacctcttttcattatcaattaccttgtctcatgtatttctttatagcaatgcaagaacagcctaatgcaattagtgatgttgaacaatttttcctgtatttgttggccattgctatgtcttctcttgacaagtatctgttcatgtcttttgcctcactttttaatggggtgattgggttttgcttgttgaattaactttcttatatattctggatgttagacctttgtcggattagttgcaaatattttcttccattctgtaggttgtctgtttagtttactccgttgataatttcttttcctgtgcagaggctctttagttcaattaggtcctacttatcaatttttgtttctgttgcaattgcttttgaggatgtatccataaattacttcccaaggctgatgtccaggattgtgttttctaggttttcttctaggattattttacttatttatttatttatttatttagagacagggtctcactctgttgctcgtgctggagggcagtggcacaatctctgctcactgcaacctccacctcctgggctcaagccatcctcctgcctcagcctcataattagatgggactacaggcataggccatctcaataagctatttttttaaaaattttttgttgagccgaggttttgccatgttgcccaggctggtctcagattcctgagctcaagtgattcgcccaccttgacctcccaaagtactgggattaaaggcatgagacaccgtacccagcccttctaggattcttatagtttgcggtcttatatttaaatatttaatccatcttaagttaatttttgtatatgctaaaaggtaatggttcagtctcattcttctgcatatagctagcctgctattccagcaccattgattgaaaatgaagttctttccccattgcttgtttttgtcagtttcgtcaaagatcagatggctgtaggtgtgcagctttatttctgggttccctattatgttcccttggtctatgtatcttttttttttatcagtaccaacgtaggccttggttactagagccttatagtatagtttgaattccattaatgcaatgccttcagctttgttttgttttgcttaggattgctttcgtcatttgggctcttttatgtttccacgttaattttagattttttttttaattctgtaaaaaatgatgttggtagtttgacaggaatagtgttgaatccatagattgctttgggcagtatggttgttttagtgatattgattcttcaaatccatgaacatggaatgtttgtcgatttgtttgtgtcatctatgatttcttgtcattgtgtgttgtaattctccttatagagatctttcaactcacaggagtcatttttattccagcttgctccctttttttctgatgtgttctcctttctgcctggtaggaatgttcctgctgtgtacaatacaggggatgtgtttagaggtggcaaacttgattaaatatatactagaaataaataatacaaacaagtgcacttagatagaagacttttccaatctgtattttgtctaatataagcattcttttaatttgtcttttggatcatcatttttgagggaatcttattccaataagctacatgcatcatctgtcattttgttttcaggatttattttctgcgtcatggagattagcttaattgtgatagatattttgttgtttttttcatatatatgattttcttttgctcatcatttctattgatctatgctcctgattttagtaattaaaacacagttcagtatgctagcattttcttcagccaaatttaataacctgtcagattcttatggtcacaattaagagaaaggtgtttgtaagtgtgttaatacttagatttctttataattaaaaaattatttgattggctatgctggatttatacttaataatcctttgctcatgcatgtcggtaatcttcactggttacccaaggttcaaacccttttaactagtgtaagcataatgatatgtgcagttataattggtttcagtaacaaaatttaagtcagaattgtagtataataaaatcacagttaattcttaatatctccatattattttacatttgtaagtcattatgattaaggcagaatgttggagcttactgcaaaatttctttagaaagaaaatacttttcctaagttcatacagacaagtttagatattagagtttgaggcaggtaataattggaattcttcagttcgctgacaatattgatatttattttcataactttatgcaaatattttctttaagtactaaaaagatgtaattgataatgttcacactggtcactttcatgacatctgaaattttggcatgtccctaactttgtgagagacaaaatggtgaagtgattaacagcaaggggctaagttcaaattgtgactttttaaaacttcagtggcttctgcaaaatggagaaaaaaatcgtttgtactttgtacaggattgatttggagggattgaataagatgcaggtacatagaaatcactcaggaaatgcagcaactcttataattaatctgctatgtgtcccagcccatagtaatgactgattagttttctgtacctgtaattttaccttggcaagaatgttataaacataaacctactctcttaagtcttgcttcttctttcactaagcataatgcatttgagattcatctactttgttccttgttccacatattaatattattttcctttttatgccaagcagtattctgttatatggatatgacacagtttttttattcattcctgtttgagggatatttgagttgtttccaggtttggaggattatgaacaaagctacattaagctacataatagctacataaaagtttttaggtgaacataagttttcatttaacttgatttaatctctacaagagggatttctggtttgtatggttaagtgtatgtttaataatataaaagaaaaaaatccttattcccaaagtagttttactatttttcattcccaccagaaatgaatggaattttccattgttccacattctctttgttacttactagtttcaggattttgtttgtttatatgttttgccgatctaataggtatgtagtagtggtgtatttttttaataataaatgatactttaaagcatattaatgtataaaacagtctttaaactaacttggaattataaatttgtacattttcttttaagaagacttcacattttcttctttagatatttccaggggagaaactttttgtgtttaattttattttctgtgctaatgtgagatctctacagattcaaaagtaaataagaaacggtttctgatttcaagttgttcataatttgtcaaaggcactgaggtggagcccaaaattttggcctcggaatatattggagagaaaacagagtccagtgtagcaactgaatggataaatgttgctgattggtgaataaggattagaaaagtagttgtgatgttcataacaataaagtggaagaaagctttgaaaggtcagatttagagattgaaaaataattttatttttgagctagctacaaaaatgtttattcttttgagtttgctttaaagccctcaggcatgaacgatcatgtatttacatctgtgggaaaggtggcatagtgaactgtcggagctagaagaaccaaaaagaggaaaagagcagtgcactaaataaatccttagacctatgtcaaatcagatcggcaaattttgttcacattatgattgatttaagtatcaataatgtttataaaagtttagtagcttatctaaattcaaaataggggttttcattgttttctttagacatatacgtcaattcctcatcccactgcccatggcaattcatatctcaggactagtattggggcatttgtaagattggctttggaaattcctctctgggttataatttatacaatgctttgcccacagccacatataggtatatttattcccttgttcacatcataaaaatgagctgaaattaaacattaagtagaaaatatgagaacaatgaaatgctatttaaacaaaagggaatatcactgaacatttggataacagggagcaccaacaaaggcaaaaagaaagaaatggaggaagaaccatggaaatgcatttgggatgtttgttactctcctatgtggttttccttttctatctcctctaaaatttaaattttcttgttatactcatttttgtgtaaatatgaaaaaagattataaatatacatcactgtaataacatagctaaatttaaatggtaacaaactattttatggctgttcaggttttaaattaggatcagtttatgttagcacttgcaatttgattctaattaaatgcttccaatttaaatgccgtacatagagtctattttctctagtattaaattctttatacaacgtttattgtctgttctttttcttttcctacaaccaccatttttgcttgccttctacatgggaggaactatgaaaggctgtgaagacacaaaaccaaataagacctagttcctaacttcaaggtgcttacagtcaaagatgggatagtttccatgagagctcctctggaaggagagacagatgttgagtcaataattcctgtgctgcattgaagggtgggtaggaatgcttcttccctcacaggaaacagcaaaaggaagctgtgaactacatttttggttgcaagcttggaggcagaggatactctgcgtattgtttttgtattggaaagatcaaagcagggaataacagaaaacaggccacaaaagaactcacgtgtcatgctacagacgtaccaatctacctgccacttaccgagtgacagccagcatcttctgttggtcaagggtaaaatataatggtttgtggaaccaaaatgcctggctttcagaacttgttctcacacttctcttatatgtgacctcctgttctactcctcaattttctatctgtaaagggaagtgatgtgaaagagcctacctcatgaagctgttgtgaaggctaaatatgtcaatgtttgcaaagctaagaaggctgtggccacattgtaaggacttagtacaagtcagctatcatttttatattactacattggtcagttaattcttcctacaattttattaggtgagtgttattgcctactttacagaagaggaactcatattcagagactttacctgataaagctaatattacatgggaagtaaacggtaccacctaacaaagagctagtagagactgtctttttctgcagtaaggaaataacgtctcaaagagtattacctctgtaactgtttggattagggaatcattgaccctagttacgtaaaaaactccaaatgaagacaaggaaagtaactagcacattgcagagatttttattttcagttaatgtttggaaactcacatctcacagcccaaaatgtccatctaatttatcagcgagcattagagctgattggatgccttgtcatgcaaatatgaacaaggaatctcatcacagttgaagagcttggaatgtatgagcttaatgcatgtctactcagtctgtacatatgaaacatttagtcccttgcttggtatagagcgtgctctcacatgcagccttgtgatcacaatctcgatgcctgtaggagccaggcatgagggcgctaagtgaagcagctggcctaattctatgtaggtttcttaaatttatttttggggtacagtatcttcttctttgaatttatcttgatgcacgtaccccctgtgtttagctttaaattttccacttctgacgtaggcatggatataaaaaatgcttcacctacttcttaattacatactaataaataaaataacacaaactcgatgatagcaacctccagtggcagcaaaatggtagagaacagggcaagtaatgatgaaacagatactatgtgtccaatattgtcagttttcctaacttttacccaaagccagaggagtgaattttttgttttatcttattttcctttgtgtgaataagtattcaaataaaaaacacaaaacaggctgggttcagtggcccatgcctgtcatgtcagcactttgggatgtcaaggcaggagaatcacttgaggccaagattttgagaccagcctgggcaacatagtgagactccatctctacaaaatataaaaatgttagccgggcattgtggtgcgtgtctatagtcctagatgcttgcgaagctgaggcgggaggatcccttgagtccaggagtttgaggctgcagtgagtcctgatcatttctctgcacactagcctgagcaacagagcaagagcctgtcaaagaaaagcaaacaaacaagcaaaaaaacaacaatgaaaaaaaacaccacacacacccaaaacaagaacatcaagacaaaacattatatagatcaagggtatctgaacgagaaaaaacaacaggttgtttgatctcccagttagccttcttctgtttaggtaaggagaataccagcagagttttcagcaggaaagagaaatggttaggtatgcacgctagatacatcattctagcagatccatttgtctacctgttttatcactctagaggtggtactgaaactatggaagaagatatttctagaaaccacagatatagtggaacaaacaaggaggctatggcttaactctgggtaaagccaataataggagacaagcgtccatgcaaaaaacaataggaatgatcagagaggaaaagtaaatttaagtaatttaattgcttaacacacttcagaaggacccagtaagataaactttgaaaaatgccattttgttttggcaccttgaatttactcagaaatggatatgagaacttttggtagagtgaaagaattataatggctgatgtatgctattcttttgagaacttagattagaaagaaaccagtgatgaaaatcaatgcttagacagtgaattaagtaccaggaaagggtttatttttacaaaagggacttaaaagtgtttattattagagttatgtctctaatgtttacccaaaaggtggaaataaattgccattttttagcaatgaccaaaatccaggtactgatgctccaagtgttactagattatcacattaattctcacaaccatgttgaaagatagcttaacattctgttttagatgtagaaaacttaatttcaaagacgttaaatatctttcaggaagttccatgaagctttttaattttaatttttaaagtgacataaaatgtatgtatttatcatctacaacatgtttgaagtctatataaattacaggaagttacatgactttataatcagtattttttcttttgtttgccatccactcaatagtggttctagaaaaaatgtaagtgaatttagaaggatatctaatatataattatgaacagaagacaactcgtctcttttttcatcgcacactgccagaacaatatattttacttttaaactttagtattaaaactgtagtacgtgttttatttccttcctgcatatcatagttctatgtttgtttggaaattaaatcattaaaaagtttttctcactttccatccagataaacaaaaaaaagaatggttaatactgatacttaataataatttatattttgttatcaataatgaattatattataacatatatagcttcacattttgtcaggattaaattactttcatttcatttacttgcaatgtgtttgcattaattgaaaaacgtgggctccctcttgtgacaacatcaatgattctatatttcttttggagccacactaagtcacctgtctatgttctttaatttttcacaagtaaagttatatataattttatataataatgtaatagtattctttttttgataattcattctacttttttaaaaggaggccaatatttgataatatttgattctgattattgtttaaagatttatataatatttaaaaatattgattttcaaatttatattgaaaatatcaaggaaaacaggaaatgacaaatttagatttccttgttttatattttatatgcgatattagctgttttggttggcattccaagatatgcacataatttactttatattctacgtgttccctgtgtttgatatgtgtgcttatatttctcaaaatgcatggtgctcctctctgtttttctctgcaaactattcatgtgtattatttccacatgcctcaaggaagtagcatacatattgaactacccataatgggaatacccataatgagatcaaagaaagaaaaaaaatcatagttcttttttaaaaatgaaagcattatgtgctgtttataaatgtgattgtgtttgtgtgcttgaaagagtatagtgggtgcaaaaaaaaggaaaaatacagaatcgttatattcatggatctagctctggaagggctttttagggttatttcaatagtacgctgttaattaagagacctggatttaatctttgctgtctcatggaccatctgtatgggattgggcaagtcatgtttcttcctggtatgtcaattttatcatctgtttaataagataattgcattaaatcaacttattctctgcatgaacacatctgtaggaaataacatattttcctggctcagttgagtattgattattaagaatatgtctgtggggtgatggaatagggactttggtcgtggcaggctgtgaatataaagttgtcaagagagagggctgtccaaggtgaatatgaaatttcaggagctgagggggtgccatgcagggggcattcccattccccacttattaattataaataagcttgattctcagttctgttatccaagattctgtaaggccaaaagcattttggcaatgccatactgataggtaatatgagaaccaaaactgcaataaaaattgttaatattttttatttctataattcacacgctaccgagcattttgccagagtcaaaaaatataggctgcaaattgcgcactaatttcaaaagcttaaaatgcagttcaggagttcccctttccaccccaggtcccatcagtccacatttttttgtcacaggtctgctttagttcattatattacttgtctgattccaggagacatctgagtttgtggccctaattaacatatccgggactgttttttatgacctatgtaactgttgttggatttggttctgaggacttctgtgccacctgctccaataagactgagacacagactcttctagggagcagctgtcactttcttcacctactcaggaacacattccggttctgaatcttcgtgtctggatcccttctttcctttctttcatattcctgcattcctctctgttttgggtgatacctaaatgcgtggcctgcttggtcttggagctcacttttgtttcagcatgccatgtctcaggtcacacacaggcccacagtgtgtggcccacagcccagtctctccctttaacctctaccttatcctaggcctgatttgtttgagagagtaaatcagtctcaggctaggaatgaacaacagcaatgggtggctgtcctctcatggttaacacacttccatccattcattccttcatttacatcaaaaatatttattgaatgactacggtgtattcattacattctcgttgcttcaagaaatttgtgattgaatgaggacactttgtgggaagctcaggacagagaactggttctgattgctcaggcagatgtgacaaagtaacgtggtactttatttgggtatattagtgtgaatagtcagagctgaacttgcagttatgtgtttgttcattaaagaaaatctatggttcaccttctacatgaaaactgttttaagattctagtgagaaagactgacatggaggaagtgaacgcattataatgtataatattacaggggctaggggaagaaaatgtaaggttttgtgtattagcaacagagagagcgagagtgaggagagagagagagagcactgcctggtaatctttgagagaaagattttgtttactagatcatttgtcataacatatagttaaatttatacatgagtgaccagggaataatgtcagttttctgttaaattactggtaagggactccaaaagggaaggagtggcctctcatattatctttattagcaaccaccctccagcccacccttccacacatacctagtgtcatatcctaagtgttatgtatgtatgtatggcttgtgtttgtgtggaggtgtacaagcatgaatgagtctatgcacaaatacaagccatataacgttgtgcctgtggtgggcagagagtttaagcatgctccaattttagttgttgagacgtttgaaattatgtgcaactcatggacaatttcaatttgataactcgttaaaaataatgttagtttttaaaaagatacctattctcttgcctcaattgcatttctgcccccgcccccatatagtgcaccacttatgaagagaggtgatgaaaaaccttcatacaggattattcacttgatagaattgttgtcatttaacaaagcactgctacacgctttttcttcagtaagtaactaacttcaaggagtattgcctctattaactctctgaattgtgggatccttgactctagttaggtaaaaactgcaaaatgaagacaaggagaacaagtagctgtcttttttgactcatagagattcatacattttgtttttaggacctcacctcttatagcgtaaaaatcttgggatatatgagctttgagtatgtccattccctctatggattaaaaaccctgagtgccctgtttggtatagagtaggtgttctggtcatgctaggttcttctcctttctttttactttgcattcttcaaaaacaaaacaaagcaaaaaaccgtcagaatctgcagcctgattataggtaacttttatcctcaggtgtcatgttaatatgcgaatatccagcaagcatgtggtccaatcccattcagataatggaatgtgagtattaagcttgtagcacagggctttgttagctgttagtttttttgttttttttttttttttgctggtgtgctaattgcaaagtgatctcctctcaggacattaaaaaataagtccttaaaaaacataagtttgggtcacctaaaatctgtgtgtatttacatttcttttatttttttcttttagttaattgctattttaatacagggcagagcaggactgcaggaggtgaggtccccttagcaaatggcaacagtggggagctttgaagcacttagcacccactacagcaggaagagcagggatgtcatgttccttgattattcctggaaaagaaaaagcacaggatcctccttgagtgctgcttgcaaagctgtctcttaaaacccctttcatttatggttgtattgtgccttccaccttaagtgtccctgtatgttgtttgactaaatctaggggctgaaaaagggattttctccttttaactgtttagtgccttcatatagtggttcccaatcctggctccctggcttagcttttggaagctttgctccccctgagactttctaaatcagaatttctaaacttcagcctcttgaagctaaggttcagagccaatgcattttcatagaatggatgtttagtaaatctcaactgagaaacatggactgaattaaatttttatattttacctgaaatatactctctaccttgattgatttgttttataaattgtattcctctcatctaatcttttgaatttgttcataatatgagaaggcactaagatgaggtgacatatggtagtatgttgtatacatagagtttctctcacttgcatcattattgcatttaccacattttttgcaaatatttaaatcttcagtagactaagaaatctataattcagggaccatattgtcctcatttcatgtcccaggacacaggctcatgtctgaacgcatagaaggcgttcagaaaaaaaaatgaacaaatgagttatagcattgttgtagatttgtgtctaaaatatatatgaaaagttctataattattttaatttttacatataattaaaatttatagatattgctccagaaactactactaaaatgatacagcttatgttattggatcagaattctataaaactaataaaggaaatataatttggttttgatgcagtttacatatatattagggaatgattactaaaaagatgctttttagtaatctgggagaactgggaaacttttgacaggggaaatcaaaaatttgcagtccagtgaagaattaaactactgggagtaataatatgggctgatgcactcaatatagcagtaatgccctctgagaaggataggaaataattcagttcctccaggctgcatggaagctaaatacagtatgacaagaaatagtagcagtactcattatgtctgattgctaattacctctttgaatgattcagttatgcctgctactagataattagtttagtaatttatggctgcggcacaaactagtattttaatttttgcagcaccattttcacaatacctacagttcagataatacctttttaattcaatgttaaattgcttttttgaagacctataaaagagcaaatattcttgcatttttttctacttgtatttcatgaaaaagttaggcactttatggaattttatttaactttaaactccagaaaaataacatcttcttaagtcatgtcttattatggttaattttgccaattttgtgggcaaaggggtgaaattttcaaaaagattccatcaaattactcaatataacagttgccaaatttcatttttcaaaaagacattaaaaaattgataataaatcttttctttttacacatttctacttcatacatggggttctgcttatgtctgggtgtctgttcccaatgctcaggagctgcaaactgagtacagcttttctgcattcccaaccaatttggtgtggtccacaggcaagtcaaaagctatcagattaagtaagaatatttcaagtaagcatttccaatttctattcgggtaaataagattaactctagccaaagagaatataattgagtctctatggcttaaagtttggccttgggtcagtatcctcttgaattcacttttttgttctctaatattccaactatatttctgggttttattggtgaaataaatatgtaattatctaaaattattttgtcatctttcataaacattcatttttagttccgtatccccactactctagtgcagttagtgatataaaaataaatcagagcaagagagagaaagacggaaactgatatagtatgctccccaattctgatgactgtaatatattttcaggtcacagcccaaagacaacattgatcaattaaattcacatgacaatttcaacttactcatatatttattttcatttatatacagaatgtacatatttgccaaattgttgagtgatattgtgagttaggaattgattttaaaatatcccttgcctaggtgttggattatcaggcttgaattcttagtagctgatggaaaagttgccactttaagatcaatataattaagactagataattttcacaatgaaagagagcattgaaatgcttagaataacaaataaaattttgcattaaatactgggttttgccatccctaacagatcaaaatgaatgctttaaaattaataaggggcactgctaaacacattgccttatggctaagagtttatacctagcatcttaaaattaagaatatttggcattacttattcccatttgctttctacttggtgctttgtttttctctataactcaattacaaaatgctcatggttttatttgctatgttgttctcatactcgatatttaccagtactggatcaatgttctaaagggcagccctgatatttcagtgaacatcaggctgatgtttattacagaccaaatctgtgccctttattgccaacagtcttactggaaatatgtgttccttgacccatttaataaatggttacccacagatagggcagtgtgactctttttcttccatacatgctttttaacaaaagtttcttacccgtaaggcagtctgtctaaccatcaaaacatcatattgacctttccaactttgctcagggtgacagcttggtttgttgttgatactactttttttttttttcccctaagttgctaactagagctctcacaaagttatgtgctgtcagagtttgaggcaagtcaattgctttagattcataattcattctttttttgcttgttttaatactatttatattctaaaataaaatgtagcccttataaagtgtataaaagtatcagtattaaagtcaaaacttataggtgattacctcattgccaattatgaaagtccaataatatattttctttttgtctatattaggaaacttttttggttctcatctcactagtaaaaaataaagtaagcactggttatcaatataagggtgacacatttataaatgaattagcaaccaacaggtagtactctttagaaggaagatgctataatgcctgtgtttcccttacaagtctcagagagctgaaattttttaaagagttaaggaaatgttgccaaagctttcgtaattgcattgttcagtgaacattgttgtatttagcatagaactgtttatgtatttttgtacatttctttcattaccttcttttctaaatataaaacaggatagatcactggataaaaatatccaaaagaaagtcaaagcctttatttttgaatttgtgtatatatgtatatttatgattaagatgtttgtgggcatttctccttaaagggaaattcagccaatttcctgattttatattcttgatataaaggggctgtgtttacctcgtttgaatacactgcttaaaatagatgcagtacagtatttcctactgcgtctcatcagagcttttaaagaattaattagactatcatagaatttgatactttggagtgctaagaattctcttcataatttcttgatatgtgatattatgttatttcgtttgagcaagtagcaattttaaacacatgtgtatatgtccatacaaatataatagctctttggagtttaaacaaatgcatatatataaacatatacatatatacacacatatataattagagctcttggctatttagaagcttaatagcacatataattctatctcaagaggtgcttaacaatttcctaaactggagagccttcaatatgtctacttcagacatgatatctatgaaggtaataggatacagaaagagaaaatatgtatataatgataggagagaaagcagtattttatcatgcaattgatttatttgtccagttaagcttgttgagctacaaatcaagaacacattttagtataaacaagaccaaaccagagttcaggtccacagagtttaatatctaacgagagagagaaataaacacatataatttacaaacaactcaaaacaagagattgcaatcacagaaatatattcaaagtgccaaggcaactcagagaaaggaaaggacaattaatttaatcttgaacaattgtcttagactgatgctgatattgtctgaattcagggacacagtgtcaatgacattgaacatctcttattcagaaatgaattaaataagctgactagtttcattaatactatctcaaacaacaggttttgttggcttaaaaaataaaatcttggatgctctgagagcatgtaggtagaagcagagaaagaatattttaaagccttaagtggaagcaaaatgttgcctaccattttgcaaaattgggtactattatttttatttgtttatttataccaaatccagatgtaggctaattcaatctcaaacatgaaaggtgggcagattttatcattaaggtataaagtcatgctgaagattacatataataaatggacttcatgtacttccagaattccaatgtcagaagtaatgcatctttggtatcaagtcagtctggacacttctaaaaacaaaatgaatatactgtgatgtggggtgtgtgccacgtgggcatcagcaaggaagagatagattatctttcaggtagggcagagagcatggatggaaagctagctagagcagagtcagagtcatattttagagatgtaagatgggggaagtggtgactagcatcaggtagaaaaatacttagatttctagaagctctgtgtttgtttgaggaggtagggcaaaccttttttaaaaatctggtatcaggtcaactcttcccagaaaatagcacatacatgcacactgctatacataacttcataggcttcatagactacttgcgatctttaaggatcaatgagtttaagtggaggaagggataatggaagtagagtatttaccttcatttataaagagcctcacattttaaatcaactcgatttgtgttcgaggtggggtccttgttccaaatggatactacagttaaaactacgagctaggggccacatgcactggctgaggctttgtggccacctctttggtgctctccttcacttggcattcgccttcgcatctagttaaaaaacatttcatacatctactctttcaggaagctctcttttaacattcaatgttaggtactttctcatcccaaaagtctctcccacaatagagtcacaacttctatggaaacaaacaatgtctcactcatttctgaatccctgttcccaacacagtgcaaggcatgtgggaggaggtactcaggaaatctttattttatgaatgaataaaagctaacaattgtgtatagcaggttttgctatgtactagaaattagaagtagagaatactcttcacactgcagaaagactatatcaatgcgtaaaagattcacataatctgaagcaagttattttatatggaatgaattggggtaactatacatagtataatataaaattctttgccatgcaaaggggaataaaaatgagccaggcgctgcacagaatttgggaacattgattggggaacagttctgaagtagaggcctattgtgtaagtaaatctctggctgagttcatcggtctcctttgattgttcagctaatgtcacttcaaaacagactatgctttcttcatgttaacccttttttaaaaaaattgaaactgttcagggcttcaagactagataaggtataccttatgtctggtataaaagataaggcattcactgtggaatacaaaaccagaaaagtggcattatttttttccaaaaggaaaaatgagctcattatgagagaagaagaaacctttcatcagagcaaagaaaaataggttcaaatagaataaatctgtgatttagccattttccaaaagtactgagtttttgctgaaagaattatcccaaattgctcagattttggtgtttgtagagaaaatatagtttctataggattctgttttcttcatatcaaagaattgagccattcagggtttaaatattgaaaaatgaatttaacctagacctaatagaagacaaagtcaatcacaaacatccataataatcaaatgggcaaagctctcttacatgtatttattttcttaaacattaacaaatcaattcaattattcagtctcttgctttcaggatctctagattaactgggctgaaataatccttaagtccatttctatatacatttctgtatctgttttatcagaattcttggtatcttgggaatttatttttcctgaaaacaatttacatcagaacttaaacatgggcagttcatctagtctgattgcctagaatcttcctggtttcatctcagttccactctatcttcagccatgctatttcctctgcttagtaccccaacctcaacctcaaatctatctgataagtagcccatattgtttctttagaactcaactcaggcataccctctctcttctttcagtctattttagatgtatttttctctctgttccgagggtaaaatgtacacaattataaaatgtagtgaggaagagagaccaatggggcagagagacaagcatgtagctctctgaaacagactgggtgaggtgttgctcactggtgcctagcacagatgttggaccattgcaggatcccccaaaagtttttgaatacattaaaaaatgaccttttaagctgcaatcatatgccttttctaagcactgcacattaattaactcgtttaacacaacactcatccgaatttggtatcactgttataccaacaggaagccaagaggatactaaggttcaccaatggtgtatgacttttctgtagtcacacaactagtaagtggcacaaatgcaatactactcctgggcatccagcccaaaccaaatgttcttctttattatgctccatattctgacctgattatattattgaaggtactggataattgagcttgcttctaaagaaaaaaaaaggtgaatgaatgattcattgtctgtcatgaattccctaagtatttattaacctctctctagtcattaattcaacagataatcattgcgttcctactatggcacaggcactgggcatctacaaaagaataagatacattctgaatacaagtgactgagattcagaaggggaaagcatattatatattgtgttttgttcacattgcatcataggaagtttcagcctacattacatcatcttagaataagtacaattacatcagccagaaaatttttaaattaatattctttatcatttaggcatttaactctgacaaagatactatagtacattttgtagtgaattgatgtaattgccctccttggatactcaattttaggagtcgctttgagcatccacacatttctgcagtatacagtttatgaaacttaccagaaaataaaaggaccaatctaaaataaagaatctctattgtatttttctactgacaatgcaaatgcttatcttaaaacatctaattttttcccccttttcacaggcaagcacaactgtaacacttccagaatctcagttccttgccagttgtcattctgaagcataaatggaatgcagggtttggaagttgtatttgctctgcattaacaaaagaagtaaaagctgtttttccctcacccctaaatgatgtaccataactcatagaatagacaagtagtattacaagatatcattttcatagacactcttctaaacctagctctggataatataaataatagagttcactttaaaatttttaaatactttttgatggcagagtgtctttcatttttgttttcattgataacgttctctatccttaaattaactttaatcatgtaggccatgttgccttttaccaaatgtctttagcagttctaatgatatacaaagtgttgtttttgcagtattttgaaaaagggacatattaatgtttcacctttagaaagtttttttcacaagaattgaatcactttctgattgttctgtatgacatcattgtagatgtataacactttttggcttatttaagtttattttaagcattctctaatatcttacgccttgtcttaacctcagtattaatcctgttgattacataatttgtattctttgaagcctatttcattatttgcacgtctttctcctttctactcatcttgagctgatgaacttgaattacccttttgctctaaaccttaagtcagaccaaattagaataactcctcctttttttctataattatttttcctttcttgtattattactccttaccacattgtattgaacttgtttaggtaattatctgtcttctaaattatgctgtgtcattgacaagatatcaaactgtatcttatttacagaggatattttatgcttttagccccagtgccaagcacagcttctgacatagagcacatcctcaagaagcgttttttaaattgttgaatataaatagcctaaaagaccattggcatctgatcaaaattaatttttacagccaaataaattaacatcatgttgacctcaacttaattctttcatttgtcaggaaataaaatttgaattgtttgaaataatcaacttcatctgtactttgctctaatagttccttgcatgtgacaattgatggtttgctatttaaataatattacaaatgtcaaagatgataaatgtgtagtcctccatcttcataccctggctgagtgtagatattgtaaaaatgtccatttaagtaaaacaatgagggcataaaagtacaattcggtatttccaaccatgactcaaaattaaatcttttcaacacatgttttaaagaacacatagggttctatactgtatctagaatttttcttatattaattgttgattatatcaagtcttgagtcttgtaacagaaattcattttatttcaaatttggactcacatgatactgtgatatgctttcccctaattacagagctcctccattatctttcctttctttcttcttgaggaaaaaattcactgaaacatgttttaaggacaaaagatttcaaacttataaaaatatttcagtcttataaaaagaaaaggtaaatcaaagttggaacctaatggtcttcataatgccactaaaagttcatagctgataggaagaatgatctatcacataaaaagtagtttagttaacctaacaaaacaaaaataggttatattttgcttgtatggtattaaaatataaaattataaacattagtattgataaaggttatttctaaagccatcttatattttaagtagatgattttcagcagatcaccttctgtcttagatgaagtatgtatgtacttttttatttaaatgaaatgagataccatgagaatgaagaatgctctagggaataaaaatcattatgaattattaattttgattatattttaaaattaaagcatttgttactaaaaaatcttgaaacataatgtgacaagaagtaaaaataattaagtcaaacaaatgcaagctaatttataaatattttataacatttattgagtttctagattgtatatgaaactaatggaacagatgtcaacctaacagagaattgtatgtagtatgataaggcaatgattaaagtctacaaaagggattattaaatcatctaaaagggacagttaaccaagactgagaggtctaggaaaactttttagaaaatgttgcatctgagttgaaacttgaagaactaggaggcataacaaggcgaataggaaataaaaggaaatacatttcaaagccatgattagaagattaggacaaacatggtcaatcagggaattgtgtgggagtgtaaactgcaaataaaagtaaacaaacataaaatggggaggcaactgggtttaaatcattaaaggtgttgtaggtcatgttgaggagtttatcatgacagcaatggggagtcattgaaagaggttaaacagaagtaccaacaccagtatatgtcctttgcaatggaggaatggaggcatgggtggtaaagatgtttctaactgtgggaaatgggagccaagggagaggacagtggattgagagagtttctgttttgatggcttctattttctctataaataaaattgctgaaatcatctccagtaagtgagagagaggatagtggagtagaatgtttatggaatgtggtgaagacataaaatatcatctgttgggaaatggcactgagaactcatctgcgaagctataaggaatgattgctgggtgtgttgaacttcctcttcagttttttaggacactgcttcacatatttcttctgcttctttggaagttcataggaaaggacagaaaacacaaattcttaaactatagaaatctagataggttgatacgaaatttagattttactttatataaaaaacaggaacaaggtttaaagatgttgaagtgtagtcgaagcaatgagatgtgagattttggctaaatacagaagggagtgaaatgtatttgcaagtatacaaatatacctggaggttatacacacaggtatgaaaatcttgaaaggataaaatggtattttgaaagggtagaatataggattttaaaatgtgcaataactgaggagggtttaaataaattatggaagatctatatttgtggaagtctaaatgggtagaatgcttatggaagcaatttaaccttgtccatcaacttcaagtgcaaatatcattcaacccaaaaattccactcctacaaatttcacctccaggtatatttgtatacttgcaaagtgaaggctgtacagggtattttgttgctgcattgttcgtaagagtaaaatgcccatcatagagaattgcttaggcttattatggtgcatccataaaaatggcattatgaagctgtaaaaagaaatgcaaaaactctttatggatgtaaaatgttcttcaagatacaaggttaattaaaaaagaaaaacatcaaggttcagaacagtgtggtataatgcaatctaaaaaagggggaaaagcctatatatgtatttgcatacctgtgtataagatactttcaaataaatgtatatgaaaataatataactagttgctgatgagaagttggagggtcggggaacaaaagtggaaaaagaactttcgtggtcatttcattgtatattttttcatacagtataaattttgaattagaatgtattactatggggtaatttttaaaaatcaaactatagatataacaaatataagcatataagcttttgtaaatcttagtagcttggaaatatattcaaaataatgagcttagggcagggaagaaaaaaattacacaagaatatacctataacactgacataatgcaggcatagtaaaatgataagagagtacacccaaaatatcaacagtgtttgctaaaggtggtaggattggattgcaagcaatttttattctttgcattttgaatatatcttagtgcatatgcattatttacatttgagcaagttggcccaatatgctatgaatgttattactaaaggagaaaaatttctaaaagattactctgagataattcctgagactccattcttttaaatgtggaaaccctgtttttgatagtttgcaatgaaatataatacagagaaatgtagaatcttctatgataccttccattttaatcaaagatcaaaatgtgacagatgtgcctgctaagaacttttatctgttatcataaataaaatgcattcactcatctaaattaagagaatattgcaagaatgaggctacaagacaaatctaatgaagggtaatatagaatgtcagaaggcccacggaattcacaagtaaaatgaataaccattcacttttatgttttcagcataattgacaataaaggaataacttccattaaacattcagataaacaaccatattctctaagtacagtgtctgcaaaatcttgttttctggtacaagctaggaattttagtacagttgtaaaatcttctgaaacatgtctgttttttcagttaataattcacaagtctattaaatgtatggtcatgagagaggtcaaaaaagaatgttatacttcttcatggcaaaaaataattatttaaaagttgatgtttaatgtatttactgtaattgggattcgattttttgaaatagccttcaattgaatggtagaaatgtggaaacatctaagcagtaagattacatataagtcttcatcccccttcctcatttctccccctatcattaacatcttgcatttagagtggtacatttgttgcaattgatgagccagtatggatatgctattattaccaaaagtccataatttacattaggattcactctttatgttatactttctgtgagttttacaaatcataatgacatgtatctaccattacagtatcatacaaaatagttgcccagattgcagcagtgccattttgtatttctaccagcaatgaatgagagctcctgtagtcatacttccgtgccaccttttggtgtaatcagttttttttttatttttatttttttttattttagccattctaaggtgtgtagtgatatcttgctgttgttttaatttccaatcgcctaatgatgtatgttcattgcttatttgtcatctgtttatcttctttgatgagatgttcttcagatattttgtccatgttttaattagattgttatcatattgttgcattttaaaggttctcaatatgttttggacaccagtctcttttcggatatgtcttttgcaaatgttttcgtttcttcctaatctgacttgttccgtcctctgaattgtatttcaaagagcagtttttactctctttgtaaaaaaaaaaaaggcagtttgaccttgccaaacctaaggtcacctagattttctactaggttatcttataagagttttatacttttgcatcttatatgcaagtctataatcacttttgagttactttttgtgaaaggaataaagtatgtatctagattcatttttttttttttttgcatgtggatatccagttgttctggcatcatttgttgtaaaaggcttcattttgtaaaacttatttttcttcatttatttactgagtttctagtcccttcataaaatatatggcttcaagctcatttttctctctctactctgtttcctccaaactatcccacacttttaaaaggaatcttccatatttttctagccacttttataatggggaatgtcttccataacatcctgaagttcatcatcaaattcacactaagggataggtgatgattttataaagcaacccacctttgttttgtataacctgagttattcattcattcattcattcaacatatattaagcacccatttttaaacagatattagtccaagaaattattatactgaagctaaaagtactatatcctggttcatccttttgagaaatatacaaatatttgtactcttaaatgtcattgactttcatatttgttagagtgtctttcactctttctcatagtttagcagttttctgttcttccaaacattcctaatgtgacattgatatacttgtatctgggtgtaatttcacttgtctatgctcctctcatgacactgtttactcagttacagacaattgctctagaggtcttccattaagtgtagtgtaaaatgggtctattactttctgtgacatggacaacatcctgtattaagctttaaatcactggtatttttgctgccaaaatagcatactgcactatcatattaaattcattataaaattaacatttgcctgttggtcatattcaatatttttcaagtgtggaaaatctcaatatgaggtgccttgagggaatgtagtagtgggggactaattttaattaattttaatttaattgtgtattataccaaggtatccaaagaggcaatgtactataatagaaaaatgctgcatttggcattgtgaaattcagatttagcgtgtgtctgatacatattagctggttgtgctcagtaagttatttaacttctttaagcttatgtttattcctctgtaaaataatgatgataacaatgcttgccttttctactttctaatgtgttttgagagattaacattgaaatatatatgaaaataattctaactaaggtttactgggaaataatttacataccttaaaaaatcaccctttttagtgtaccattctattgattttaacagatgcacatagtcatgtacccacaatcatggtgtagaacaatgccatcaccccatatatttccacttgtctctttgttttttatgcctggcaaccactggtctgctttgtatccctatagtttcgccttttctagaatgtcatatcaatggaatcattctgggtgtggcttccttcacttgtcataattctctgatattcttccatgctgttgcatttatcagtagtgagttccttttttattaatatatttttaaagtttttaattttattgaagtccagatcattatttaaaaacattaaaacaagttttttttttgtttttttttttattatactttaagttttagggtacatgtgcacattgtgcaggttagttacatatgtatacatgtgccatgctggtgcgctgcatccactaactcgtcatctagcattaggtatatctcccaatgctatccctcccccgtacccctaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtgaaatggtatttccagttctagatccctaaggaatcgctacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtccattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaatagaataccctttatttccttctcctgcctaattgccctggccagaacttccaacagtatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctgtattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattagaatagtttcagaaggaatggtaccagttcctccttgtacctctggtagaattcggctgtgaatccatctggtcctggactcttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattccctgatggtagtttgtatttctgtgggatcggtggtgatatcccctttatcattttttattgcatctgtttgattcttctctctttttttctttgttagtcttgctagcggtctatcaattttgttgatcctttcaaaaaaccagctcctggattcattaattttttgaagggttttttgtgtcactatttccttcagttctgctctgattttagttatttcttgccttctgctagcttttgagtgtgtttgctcttgcttttctaattcttttaattgtgatgttagggtgtcagttttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcagattgttcagtttccatgtagttgagcagctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtccacttggtgctgagctgagttcaattcctgggtatccttgttgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgataggtcttgactctttatccaatttgccagtctgtgtcttttaattggagaatttagtgcatttacatttaaagttaatattgttatgtgtgaatttgatcctgtcattatgattatagctggtgattttgctcgttagttgatgcagtttcttcctagtctcgatggtctttacattttggcatgattttgcagcggctggtacccgttgttcctttccatgtttagtgcttctttcaggagctcttgtaaggcaggcctggtggtgacaaaatctctcagcatttgcttgtctgtaaagtattttatttctccttcacttatgaagcttagtttggctggatatgaaattctgggttcaaaattcttttctttaagaatgttgaacattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagactggggaagttctcctggataatatcctgcagagtgttttccaacttggttccattctccccatcactttcaggtacaccaatcagacgtagatttggtcttttcacatagtcccgtatttcctggaggctttgctcatttctttttattcttttttctctagacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaattttttttcaaagttttcaacttctttgccttcggtttgaatgtccttccgtagctcagagtaatttgatcgtctgaagccttcttctctcagctcgtcagtcattctccatccagttttgttccattgctggtgaggaactgtgttcctttggaggaggagaggctctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggtgtcaggggacagggacccacttgaggaggcagtctgcccgtcctgagatctccagctgcgtcctgggagaaccactgctctcttcaaagctgtcagacagggacatttaagtctgcagaggttactgctgtctttttgtttgtgccctgcccccagaggtggagcctacagaggaaagcaggcctccttgagctgtggtgggctccacccagttcgagcttcccagctgctttgtttacctaagcaagcctgggcaatggcaggcgcccctcccccagcctagctgcccccttgcagtttgatctcagactgctgtgctagcaatcagcgagactccgtgggcataggaccctccgagccaggtgcgggatataatctcgtggtgcgctgttttttaagcccgtcggaaaagcgcagtattcgggtgggagtgacccgattttccaggtgccgtctgtcagccctttctttgactcagacagggaactccctgaccccttgcgcttcccaagtgaggcaatgcctcgccctgcttcggctcgcgcacggtgcgcgcacccactgacctgcgcccactgtctggcacttcctagtgagatgcacccggtacctcagatggaaatgcagaaatcacccatcttctgcgtcgctcacgctgggagctgtagacaggagctgttcctattcggccatcttggctcctccctccaaaacaagcttttttataagttgtttttaaattacttgattaaagatgtacacatccacttgcatagaatatagaggcaataacattaagagaatgattattctcttaaggcctacactatcatttttggaaatatttttctatttatttcagatgaaaactgaattcccaagggcatgtttttcaaaaaatataactttgtaatgtttgtgatcatatagtttgaaatgaaattaaaaacaggaggtggttttcttgaaaagtgtggattgaaaggccaaggtgtgactgattgtatgggttttttttttttctgttgccaaaaaaagcctttttgagctgaacaagaaaggtataaaattaaagtaaatgcactcttcaaattttagtagcaacatgaaatcttgctggcaatttgatgttttactgacattgtgtcctgccagcctattgtgaggtacatcagatgtgaatgctgcttattttccccagtgacttctaaatggtcttgtggagtagctcttatgatatgccagcagtgtgtcagcagaataccagtttgtgttccagagcctgcctctttaaatctgaaagttatcccatgtccttttcttgtttctgccaaattctctactcatagtatataattatatgttagagggatgattacacaccaatgaattacaatcaaacttggcttgttagtatataaagctttggttgttaatcacaatcatttaaataggagctcaccctccctgaaatgcagatgtcatgttactatgggttagccttccccaaattggaacctgttatatattagaaagaacactttggagtcatatgttcatcattgcctcttttctgtaacattgagcactgcctcttggctctgagttactttgtgaaactggaatcaatataagagtttatcgaaagaatgacttctcctacaaagtaagtgttgattttctaatttcttggacagagaaagtcaaatcacaccatgtctggtagaaaatatattgaactaatatattgcaaagttattgctattaagagaaatgcaggtttttaaaattagctctttgtttaggctttttcaaaaaagatagaaaacaacaacaacaaccagccagggacagtgtctcacacctgtaatcccagtgctttgagatgccaaagtgggaggatcgcttgaggccaggagttctagaccagcctggacaacatagcaagaccacatctgtacacaaattaaaaaaaaaaaaaaaaacttagctgagtgtggtgttgtacacatgtagtcctagctactctgggggctgaggtgagaagatggcttgagcccaggagtttgacagcctgggtgacagagaaagactctgtctccaaaataacaataacagcaacaacaagaagactggtttctcagtctcacacaggacacacagaattgtataacagtcaacattgtatgaaaataaacaaataagcattatctaatgcaaacttcattagatagatgcagcataggcctcatttatcataacactgtgaccttgacaaatttcttaaacattgggtatgtcatgttctgcatctgtaaaatggcaatactaataaaacatttcccaatggattttgtgagcaggaaataagttaatattgctaaagttcttaggacacttacttggtacataaaaaataccatgaagtgtttgttatataaataaacttggtaatcctaacattatattgaattacaatactttggacaatacttacacatagaaattagaggctcagtgtttgtctagtaaacagaactgcaaaattctcagtaggaacactttcattactttattcataaaatagtatgaatagtactttatttttttatcgtttaatctaaacattctaattctttgttcaggatgggctaatttctcatctgctgcttatctactgaccattcaaataccatttgtaaaataatgcttttcattcctttatttgaccattcattcatttattcattattcagaacttcctgtatccctggctatgcaaatttgtgtgtataaggtatgcttcctcttatttcctcttttaagggagataggtatatgaatttttataatacaggacaaaaagaggatgttggaaaacagatggagagcaaaatccctagtgagttcaaaaggctgggactgttaattctctctgagagatggaggaagactctaaatagcgcctgaagaaatgataggatttggacacgcaaagagaaaattctagagaaaaagaactatgaaatctcagaggtcaagaaatgtaccttagtatctttgtgtttagagaaactagtccatttcactggaatacataaagtacagctgggggatatgagattgggaataaaatttagaccagatcatagggaactttgaatgcaagtgaaggtttttactttattcattggacagaaagggaccttccttgaatgtaaactcaagcctgaaaaaaaaagtagacaagttcagatccttgagtgaaataaatctggctactagttagagtttgaatgatgaagaaaaatgtttttgacttaacagtttttactttttcaaaatcttcccttcattctaacagctctgaaagtattattttcttcaggaaatggctctatgcggactgcctgctagcttactcccatgcagggatttattttcatggaataatctttgagactggattgcaaaactcttcttttagaagtcatcagaccaaaattcttaaccttgctgagcctcagctttagtactctgtcactcaaaagtggtgaaaaaattaggaagctttaaataaattccttgtagttctttacatttttgtgcatatctgttgggggaaatgggcagggctacccaggtttatttagaataatccaaatagtaatagtgtggtttatttttgaagctgactaaaatatttttaagaattaaactcttaatatataatacatgtgctgaacattcttaacgactctaatttaaattacatatgtaaaagtagaagaatattagagaaaaagttttacattcatcagataatttagttaggcaataatattagatttaaaaatattagtttttaaatttaatattgatttattagatttaatatttaatttaatattagatttaaaaacatcatcatgatcatctttaaagtgcttttaccaagagctaaacaaaaaaattgaaagtgaattcatgtaattagcaatatttgatatagaataatcaaatgccaattaaatttattacttttaagaagttatccttaaatggttttttgaatgtgaatgttataaagaataatatctttcactttatttaagctttttctttaaaaaaatagtccttatgtggcaaattagttttagaacaatatacagcattgtatgtatggaacatttttgggtatgttcattttgtgtacattttttcttttatcagtgtcctttgggttttcattggtaattagtagaaatattttcagttgagaaaatgtgatcactatgtcacttaatagtgttatttttaataaataaattattaatatgttctacactatatctgatctatcatgtgaaaccatattaggccaataaactcctcttatatattttggttattagtattaatattactatacatacaattatcacttttcattagaataaaatttttaaattctttgtctcaaaaataaaatggaatttggttcattatatgaaattcttgttcatattacttaaggtgacttgtaattcagagagttattgattctgatgcattaagtagcaaacccatgacattctctttattatgagctctgatatcaaataaaagatgggtttacttgctctttcaaaaattgatttattgccagtttcaccactgtagatactatctttaaaacaaaattaaacatgcgaaagaaatggaggtttagtaatgaaataaagtgttgactaatgattacttcaaagcagaaaggttaaatatgatatgagtaaaattttaacagtacatgctttccacttgattagtttcatacttgttcatgcaaaaggtcatattgtcatttaccaaaaatatggaaatctttcgagttgtttgtgtaagcaaggtttaaaaaagttactttaaataaaaagtagtaagaatactttagggaaaagtaaatttctaattatttttcctactacaattttatgttaattggttataaactatggggcaagtgcaagtttctgagaaaatttcatagtactagagtatatttcctagccctttagagcattgtatatgtggaataaattcctcgatggaacttcaagctctgattattacctaagagatttctttgcaattgtagtgtgtaataatctctcaagttttatcttggtgggattctgatggtgaaagttcagtctcatgacattgtaaagagacgtccctgtaaatgtacctgaatcaaatttttctgctaagaaacttggatatttcaaactatctgcatttatttagactaaattttgtgtggtgaatgtgaaacacactgtactctgatgtctatttcttcgaaaaaaggaaatagaaaaatcacaagtgtaactgcaattccccacccccacccccagccccaccccaccctttttggtttgtttgtttgtttgttgttttattatactttaagttctagggtacatgggcacaatgtgcaggtttgttacataggtatgcatgtgccatgttggtttgctgcacccattacttgtcatttacattaggtatttctcctaatgctatccctcccccagccccccacccagtgacaggccttggtgtgtgatgttccctgccctgtgtccaagtgttcgcattgttcaattcccacctatgagtgagaacatgtggtgtttggttttctgtccttgtgatagtttgctcagaatgatggtttccagcttcatccatgtccctgcaaaggaacagggtctcactttcattgcccaggctggaatgcagtggcaccatcttggctcactgcacctttgacttccagagctcaaataatccttccacctcccacctcagcctcctgtgtaactgggactataggtgcacatcaccatgcccagttaattttttgtaatttattggagacaggttttcaccacattgcccaggctgtttaaacaacttatttttagagacatttaaaaatatataaaacaagtgttttaggcagattagaaaactctaatataaaatttttgaaggcaaatacctttagcttaatcaagggctagaaagatagaaatatgtgtttagacatacaccaaagaaaagggtttataatttattttcttttatgagaattgtgaattatcagaaattgttagctggtagattaaacaattagtgtttacgaagaaagtgtttggtaaaagaaaaaaaaggcttttgaatcttgtggctaagaagttattgaaggtatggtctccagaatttgtttaaacctactatagttgctgttgtccctttactttggagtggatcaaatctgttgcattaagattgtcgtagtctaggctggcatagtctaggttgaatatatgatatataaaaatactatttcatcaaaggaattacaatccagaagtttttaaatttggcattaatgttgctaaatgatatgtggagaaatacaaatccaggttaggaggtcagaaggattatagtaataacaggcattcattcaataaatatttgttattactacatttcagggataaaatggtgaatgaaatggatacagtccttgaagtcctacaacttacagtctgagatagatgtggtacagaggggaacatttcataaggaaaattgccagtaaagaaataaggtagtagagaaggcttctagtggaagttgttaaccttaaacagggaagccagattctatgctaatttcaatgtgagatgaatctaattctatttcatatatccaattcattatatctatatcaagggaaagctagccttgaatgatttcttgccagtacttttatattccacagacagtacatctagtcaaaactcttttcaagcttccactcccatacacaatgctttgactcttatggaaaacctcttttgctttctataaaaagcaaagccatgcaaggtaaagtattttattcttaatcttctttttatcttatcaaattgctgctacttcagctcttactgttcttgccttaaggttaacagaaaggtttactttttaataatctcttaaaatgttgagccaatgtcttattcctactgatacctgaaggttcttgtctcatatttactctctcttctaaccatacatatcaatattagtatatttattccctcgttgccaaatttctcaaataatctgtttatacagacatccatggaatcagggcaaacattttttattatgctctcccaggcttctgatgtgttaatgatttaggggaaatgttggtcctatgcagtgatgcagcagatgcggaaaggagcacaacattaaggagaagttttaattcaattgtgaatattttcagtttgaagaagtccaggagctgactgcaataactacacttggggctcatctgaatatacattcatagcaaaacagactctgttatatcagatttttatgtggtaatgaagacatggttttggaagacgtggcagagaaataataatatggaataaaaggaacacaaagtagagctccttgatcctcacacagggcaaaaaacatggtgataaatttgaaatcatgctatgaggctttcttttctttggtgtcattcacttattgctatgtaaagtaccaatctgactcatactttattttctaggtaaaatttcaagtctttattctcattgccacatgttagctgtattcatcattttgacttaactagcagatagccctaattctttacaacttcttgcatccatgtcctatttttaactaaattggatcgggagttagggtatctcctttagcatctaacgctgttgctttttcatcataagcactgtgtgtgtgtatccatctatctattgatttacatatattttaatataatgtacatataaatatatatttatttattgatcatttatataatgctcattatttctgccattgcagaaagtgaatatgatagagaactggaggttatcattattgaatttatatatacattcaatatatatatcaaatgtatatatatcaaataaaaatgatacatgtatattaaataaaaatacgatatatatttttgcttacagatttattataaataaataaatatatacataaactcaataatgatgacctccagttccctctcatattcactttctacaatggcagaaataatgagtattatttgaaagttgaattttagtgaaaagaattaaagcgtcacagaaagtaatttttaccattttatcctgatccttagagcaaaggtaataacatttctagctttatttctcataaaatgagtggaagtgatatccttaacacccttatggagtaagaggaagatatgacaccagtcaaataggcttacatgaaaattgtatcaaaccatgcaagtgtaagaatatcagaaaaagaaactccttttttaatagataagaaatagttttcattaatttttaatgtccctaaccaaaatacttgttgaataaatgaacagtttttaaaatttcagaagtcaaacagtatttttatttatatttttaatattttaagactcctgtctcatttcttcaagcgtgaagtctcagtaaaagattgtcaataaaagcctttgtgatacagaatttatattaatattgtagattttttaaatgagttaaaaacccaacaatttactttatgttgatacatgcttatttgtaatgtttatgtcttaatgaaatccacctatatatctattcaaatatactgattgagcactactaagaccacaaatacaacctgataaaaagattgtcccagagagtgagaatttgtcgcgaaatggaggaaagacaaagatgaataaattaaaaattacaaatgagtataatgtgctctgacagaaggcagcaattgagctgaataaaagaatagaaaagttaatgtaatgaaatgtctaaatgaaaacactataacatccagttttctatactaatcactttctgcacaagaaaaatactaagcagtccatggatattctctacatatcagatcatatatttcagcttttaaaagttatatctggccttaccctaaataaaatgaaccagaattcctgggtatcgatactgctcctctaatcttaataaaaccctagctattttagtgagtattccacatagggtaaccacacatcttttcatcttgtttgcctcagatggtctcaaagctcgtgttctctcttccttgcatagtttttgcacagaggctgtcttcagatattctctttagtttatcttgccttaggaatcaatacacaggctgggcgcagtggctcacgcctgtaatcccagcactttgggaggcggaggcgggcggatcacgaggtcaggagatcgagactatcctggctaacaccgtgaaaccccgtctctactaaaaatacaaaacattagccgggcatggtggcgggcgcctatagtcccagctactcgggaggctgaggcaggagaatggcgtgaacctgggaggcggagcttgcagtgaaccgagattgcaccactgcactccagcctaggtgacagagcaagactccgtctcaaaaaaaaaaaaaaaaaaaaaaaaaaaaaaaaaaaaaatctatacacagggttctgtatatcctttaggattctcctttaatctcatatacttttgtagataatccttttattaaactttcctaaattacttgcttttcccgaagattctgttcatcatcattatacacaaatgttacatgagaatttcatgcttaaaataagttttctcttttgaatgcaaaaatcaatatttttctcttcctttcatagacattgtaatcaaagataggcaacatagcctaaacatttatatattaaagtgaaagtttgggcaaaccattttattaaccatgaaaatggcacagatttgttttcctaaaatgaccaaagcacgtgttttaggattaaaatagtgcctgaaattccaaaggaccaattttaccctgagaaacaagttcagttattttcaaatcattttatttcctaactttaaaatgatcaattgattgattgtttctgtgtctttgttctggaaactattatatcgttggtatatctaataattattcttacaaaaaaggaaaaatgtactgcagtgagaacacatactctttttaagattactgggctactgcttacattcttgcctcctccccttgaatctagttttcagacattagaaaagtgtatccaaatattccttaagtattctcttaataaaaatcctgctgttttctatttgagcttcttttcccagggtagattacagaatctacctcatctacagaatttagaaacattaatgacttcagatcaccagggtatcatgtaatgtccagcagtaagttgttagagactgaaatatgactgaaattaaaaattgcttcctgagatttggagtttaaagctgatttgagcaaatggatttgatccatagtagcatcataggctaatttaatcttgctggaaaaaagtgtaatatctgatatgtgtcgaatacatatggacgagtagaccagtgagttccaacctgactcgttattcttattgtgtcaaataaatagtatttgattattaattaattatattttaagctgagtataaataatattctgaactgatcaagaaatatctatctaatgtatctgctaaatttagaatatcattaatatctggaaaagatgaaatacaaagagtgcactttgttctgagtaactcattactgactcattatcatcatcaaaaagaaactaaagtgggttaatgaataatcttgcctttgactgtactttgtgcttctaatgatcttacctcaatgagaaaataaaaatgcttactttaagatctgtttgtaggattcccttaggaagacaaccttctttgtttaggaatacaccttaatgagtgtttttggttttgtaattaaggacttctgtgcgtattctaaattggatagagcaagaaaaacagctgaaatgctttttgggagaaaacacagaaaagtaaacagggatttttacaggatgtaagcaaattaatcaagaggagatgggaagaagaaagccaagaaatgtggtgataagagagcgttcaagataggggacttttggagttcctattgtgttgaaaaaagaagccattttctggagatcctagtagaaagtagaaggactagtgatagcagagatgacttttatatctgtacagatttctcattctgagtaataaagcacagctatgaaaatatgcccaaagtagacttaataatatttgttgtaattaattttatctgcaactgatggatgaccttataaagtaaggagctcataaaatagagatattcagagaaaaaaaagtctaaaataaatagaaaatttccatattcctgcattgtttttatactattttaatgtttagtattatctgggcttacagatctctgaacatatttactacaaaatacatactttgttatcatagccaagtattataaatagcagaaacaaagttcagtgtgctagcaggagatgtagaagccttggccaaagcaagataaaaagaagaattaggatctgagaacaggtcaatttttaagagatgattaatgacttttataaattacgttcttctaaatttcattgttccattttcactagattacatagaaatacaattttttttgtatattgactttgcatcctgtaacattataaaattgaagtatttgttttttaggtttgttgtagaattcatgagtattttgttgctgttgtttgtttctgagacaggatcttgatctgttacccaggctggagtgcaatggcaccatcatagctcactgcagcctcaaattcttgggctcaggtgatcctaataattcagcttcccaagtaactaggactacttctattcctattttgaaatttatcaaacagactttattatgaatgttcatagaaattctatttacaatgcaatttaaatataatttcaacttagaatctgaatatctatgagacaatggataaaaaatgattggatagtgatgatatattcatacaacagcatactcggcaataaaaaagaaagaatagatgtacaaacattgataaatactacaggcattatgcaaatcatacgaaggtaggcacaaaagagttcacattatatttcatttgtatgagtatctaaaacagtaaaactaatatatggaaatataagttaaaaagatgattgtctgaaggccaaggatgagatttcactgggaattgacaagaaaatattctcagtggtagaaatgttctatattgtgattggatgctgtggtatagatatatacaattatcaactctcataaaattgaatatttgagtgttatatattttaatgtatgtaaatgatacctcatttgtaaaagagaaaaagcaaactaaaaattaagaaaggaactttgcaagaacatgttattctaatattggtctcatacttatatccaaagctgtgaaaggaaaattggtaagtttattcagtagtagattttctttaaataatatgcttacacttttagtacttaacaaaaccagaaatttttaaaaataataaattgatgagtagaaccacattgttgagagcagaggaatacagctctcctttgtttaattttttcaaatgaggataaagacaatatcccataatagatagcattagtgaaaaagtatcctgtgtaatcaagttatttctatgtttaatcctgatctttagtaaaaatgctttgctgatctggttatagtgaatatttagcacaaccaattttattttgtttatgatatttttgtgtgttcatttatgcttaaataatagctttctggtttcctttttaaactgttaaataattgtcctgtttatttgtccttgtttgcaaacaagtagcctctccaatttcactcaacatttaacaacttaaaaaatctccattagtctgtaactggccacacttaagccactcaaaatggtcatgaaaagagaccataatggtcatgaaaacagaacacagatatccaaaacaaagagctgtataccccaaaatatatgtttttcagtagtctttacaatacttgtttttactttttaaatttctctagggagctgtgtgtctgtttcacctccgttcttgtagattagatgatctccactaatgcactcatcattaaaaaattgcaagataaccaaattgtttggtttgccatggcataagtttaatagcttgtgcactattatcaaaaataatgacactcttgtaggtcactgattcactgttgagacattaaagtcctatatagccatgaagtgaaaatggcacatttgattttgtgcctagattgttagatacagaatataaaaattatgcttagtactatttttctgcattgggttcaaattaacctctttatgtaaaagttaattttgtgattttttattgtacagtacactttgaaaagattttgaagatatataagctggagaattagaatataatcaacatgaaattcactattcaatgagagctagcatttaaaatagagataacattgtttcaatttctaattgcaaattgcagtgttacctctaaatgtgattttatttttctctaacttgcatggctacataacatgctatgatacttttctaatactctaaaaagatataacttaatttttttcctctggagattagatataaactttgaaatactagacttggtgtgtaactttttactcttcatcttcttctggaggtgtagggtattcattgctattgcaatatagaccttgtgaagttactgaaagcctctgagtacttgtggtcaattaggccatgttgtggtgactgatcgatgactttcataggatggtgatattctggaaatttcaactttgccttaatagtcctctgttctttatttaataataacacaaataattgcaagtcccttaaataatgtacctttgtccttaagcttaattttgcctatatgcaaccaagcaaagatatcttcaactcaaaaggtggaaaatgtaataattgatgaaaagatgagacgattaattgggagggcagatattatcaaactacaacagagatatagaagctattgtgtttttgcaaagctgttcagagacaaagcatgctgagttgcaattgaaagccatctctgatcaaaagccagccatttttacatgcagtgacattttctaaaacagaatatacagttttactttggaatatttcacatcttgttttattcatttgttttatacattctctgttctgttttaatatgtttagctctccttttgggtagacattagtgaattacatcaattgagatatgtaaattttttttctattttaatgtttcttaaattaagatgtgtttttaaaatcggcacatgtttaatgcagcttttcttttttgaaacactttcattgagttgacaggttttcttgcaatagatagcaccttagaaatcaagagaaaagggttcaataaactaacaaattcaataactttaacattcagtaacttttacattcaataactttaacattgaataacaaattcaaaaactttaacattcaataaactttaacaaatatttattgagtgtgtctgctctgcaagggataaggctaggtactaagaaaaccacagcaagaaggacaaaccaggtcttaatcttctcagagttcttgaaagtagagtaaattaaataggctatagtctagtaaattaccactgtggtatgacagagatatattttaaatgctataggataaccagagaggcaatgtataattctgtctgtgcttttcagaggagaaggaactctcaagtggaaggataacaagcggaagaaagaacgtaagcaaaagcaggaaggtgtgaaatgtcagggtgtgtgctgggaatgatgagtagtctagtggaactctagttagggcactttctctcaaacatgagtaatgaacagaacacgttaaaagaaaaaaagatcttgccaatctacagtattcattcaaattatttttgttaactttacatatgtaatatttgtttttacaacagttaaactccaaaatacatctattcattaaaaataaacaacctcacaaaaacaattaaaatttaattatcaacattaactaaagtcatatgtgagtttttattttggggcatgatgagcttaaactaaacaagaaactagctttttcactagtttattcactgatctgtgaattgaataggccaatcaatttaagtacatgtcaaaatatcacaccataataatgcttagcagctagtgttattgagttattatatgtcaagctctgtaacaactgttttaatccagtatcttattattctttaaagactttttcaagtggcttcccctacggtacttatactttaatggatgtcctcttacctctctgccgccgccttcttgagcatcgttgtagctttatcctcttctaactttctaatattggaatatttaagggttccattcttagttctatatactctgtcttttggtgatctcatttagtttcatgagttttatttttctttatatcctaacaaccaaactcatatattaaactagctccttgatgtcagcacctgggggcctagcaaacatctcatactcaatatgcccagttttaaactactgatatgactgggaacggtggctcacgcctttaatcccagcactttgggaggcggaggcgagtggatcacttgaggtcaggagtttgagtccagcatggcaaaaccccatttctattaaaaatgtgaaaattaaccaggcatggtggtgcacgcctgcaatctcaaatactcaggaggctgagacagtagcatctcttgaaccaagggaggcagaggttgcagtgaactgagatcatgccactatactccagcctagacatcagaacgagactgcctcaaaacaaacaaaacaaaacaaaaactactagtatctccagacctatttatgtttcagtcttcaccatctctcagttgatggcaattccatttcagttattcaggacaaaaccttggaatttttcttgatttattttttctctcatccaagattcaaaatctttggaaattaatgagtttatattcaaaatatatccagaatatgaagcctcttctcacgacaccctctgttgccattcatatccaagcagccattattatcattacgtcttgtctacatttttacaatagcatcttcctaatcagtgtccacattctactgttgttctcccacaattcattgcaatggattctcaagaaagttgccagtgtcttcattctattatgtaagttatatcaggatgtgactcctgtaatttgaaaatcaaaagctttttttttttttttttttttgaggaagagttagaatttagacagtagcctacaaggctccacatggtatgattccccaactttctttttatagaatacagcagcagtgtacctagtgtgcatttgacacatacattggattattgtttagaacttctctcacctatacaacaagaatataattaataataataatgaaataagtaatcagaatagccaggaaataaaccaaaacaatataaaaattattcaacttttgtcatgattatatatacatatatataattttaaaaatattcttagaaaagcaaatagttaaaaatacttaaaagcttaatattttaaaattatatttatacttttttgaaaaaaaggaagcttgtatctgcatttatttggttataatcataaatagtatcattctgttttccagctttaacctctgcatactgtcaatgactttgtctagattactctgctttgcatattcataattaatagaggatttaaacagatatgttgatctgtctatgctcatatttggtcagaggatactttttattggttttaattttttatagtttctttcatatcaaataagagatacacaaaattagaaaaacatttaatatgcagctaaatttgaaagagatgtataaaaatcccacttcacaataaattccagaaaattcataaaaaacaataagtggttacattgaaagtgaaataaattttgttttctttttataattacaatataatttatgtttatatagaattaactgagtttttaaatgtattttgttgtggttaaaaacacttaacataaggtctaccctcttaaaaaatttgtaagtgtactctacagaattgttaattataggaataatgttgtacagtagatctctagaatcgattcatcttgtatcattgagactttacgcccaagggggagttgctgacctgatctactgtttaaattcaggcatagttaggaccaccacaggcactggatttataaactgtgccaagtgggtttaaagaatctcagaacttcatgaatttactcttgattgattatataatgaagttgtctgaattagcattcatatagaatacagtgctttatttcattttagtgatacataataaaacatgacagtttgaaactaataagcaaagtattaaaattcaaaaaataaccaaatcagttttttagagcttagatcaataaataattttttcagaaaaataatttttcactgaccttgttttgagtcgcctgcaccctgttggactgttcctactgttccacctttggtaggccactgaattttgagataagaaattcaagataaatgttccgtatttaaaagaattttttaatacatttgcagaattcaagttctgcttcactgcacttctactttagctgaacctttggcctataataaatatattctggaaatggtggttggttaatagaaaaagtcctttaaagtattagatttgttgccagtttttaaatatatgataggggtcaagaaaccaagaatcacagaacaaatatggcctgccaccagtttctgtaagttttattggaaaatggccatgctcattcttttacatattgtctatgcagctttcgagctggaaagaagaattgagtaattgaaacaaatatcaaaaaatggactgcaaagcctagaatttaaactatctgtcctcttatagaaaatacttgcaaaccccttcttattgtgtagaaagaatttggtgttaaagtttactttataatgaatttatttattgaactgtgttaatgagaaacagaaaagcaaataaaattgatctagtttggccagattgtatgcagtgaatgatttactatctgagaaaagtgttactgaggcaacagtgtttttaacatgactgtgaagtcaacagaggaaagatgtttatatccatggtgtgagattatgaaacattaactttgcattttcattaatattggaaccaaaatagcttttattgaggaagaatgattgaagtgttagcatccatacaaggtagagtaacaggaaataatttatcatgagatgatttataactccactttatagagacgaatattttcatggtacaaatatttcatatctggaaatgattgtaacaaatatgattttcccccttcagcataagttgtatgagcagcttcaccagttcagtgatacaaatacggttgaatattgcacttgtccaattaattgcatgagttatcccctatctattttaccaagaaggttaatatcaactttttgaggtctcaacatccagaattgctgtttgtaggctttcttagtctaaagaacacacagatggatagttagagagcccaggaagtacacaaaagttcccattttcaaaatgtctctgcatcctgttgttgctccatgttctgctgtaaattgctcctgaattttcagtattctgtgggttctgatgtggacctctgaaccttgctccctttcttcccaataggctgcttgaactctaaatttatctagttcctcctgtacaatcatttccatatacaaaggaacaactgtgtagagcagatgttagtcaaaccactgaagttcaagttatcccatttcccattcatagaatggtgattacttgcatacatttgtgtaagtgagagggccactgagttggtgcctaaaaagaacattttcaaagtaatactgggcccaccttgccaaagtggtgggcaagagcttcttgtttccaaaataatatttaatatctacctcataagatatattttaagtggtattactaggaattataattttatatttacaaatagcatgtgtgttttagttataagagctgccaaaatattttaaaagaactacttctttaattgagaggaaacagtgaaattaagacaaattataataaaggaagccatgtaaagattgaataagctttatttgcttaatgatatagtcacagatatccacgtgtattcactattttcacatattgtgcctcgctattatttgtgtgctcaaggtctctatcttcaagtgttatatactgtagagtttcctatcaaatatgagcataaaggaatgtttcatctctatctttacagtgtaatcttaaaactgctagctactattggcttttctttctttttccttttcttccctttggcttttgtgttattgttgaaatgatgtatctattccttttagcatggcttatactaggagctctgaaacccagttcagaaacctgtgagttatttattgatgttaacaaaagttaaaatcaataagccagacataaaaaagaaacttctagatctaagacgaatgtttagttaactttgaataccgtatatgaaattctcaatattttcctgccagatgttcatgtcatagagttagcaaacagttattgaaaacttactgttgcaaagttcttgggattcaaacctaagacacaaaagaccttcaggcaatttgcagtccaattgcagaaactggcaagctgaaaaggaattactgtgtattatatgttttattattggatagaagtaacagagagtgctatgggatcacctagaaagagcaactgaggaaattgtagatagcaataagaagagccaattgtcagaacacagttgtcaggctgactcttgaaagatgagtagtaatcagatagacaatgccatgccatgagaaagcaattaaaagaagttggaaattccatgttaaggacacagaaagacccaaagtgcatggaaataaacaagtgttggccatttagagagcacaagtggtttggaataactagaattcatatttttgttttaaagtgtcaagaaacaggccgaattagggagaaggaaccaaatcatgaaagaccatatccagaaataaaagtttttctaaagataaagaatgaagttgaattttaatgacagtaacacaatcagatttacttttgtaagaattacattcagagaatagtggaagtcagagtgcttgcgtgcatgtgtgtgtgtgtgtgtgtgtgtgtgtgtgtgtgtgtgtgttgagtggggagggaataattttcatactccaataagaaatgttgaagacttgagctttggcaaaatttattaatttatgaggattttgagcctttcatctcaccctgcccattaaaaaattttctaaatttgcctttataccatctcttctgcttactggggcgatttcagagctgccacctggctggaaacttactcacataaagcaagcaaatccctcaaggggccatagcaaaggagataatctgctcatgggtcaatgggaggtgaaataaaaaagaatatgcagaagaaaagattgaaggttgttgcctggaatgattcctgaagccaagcatcttcggttgttattttaatacttcctttggacactgaaggttggaactgttaaaaactgttaaataagaacatagagtcaatgagaatagacaaaactgttaattcatttgtctgtggaaggaaagaaggaaggcaggggctagaggagtgtttggaaaaggtgaatcaatatttattaaaggaaggaagtgggcatttccaagaatatattttaggataaaaaagatgtgggtatttttttataaatatatatatttttattattattattatacttttaagtttttgattgagggtgaatcagagagggacaattttaagttctaggatggtaactgactgtggaagatttctgtggggaaagcaaggacatctagactattggtagaagaatcctggagggatcattcaatgtgatttaaatttatattcaaatatacttttaatagcaattcatatttttagaaaccgctcatgttggaggaaggattccatttatttttgtggtattttttaagcagagttgaagacccctatgaagaaagtatgaggaagcatttatgatcaaaacggggaagaacgttttttgcccaaagtgacaatagctgtattgtttcctctgtctatataagtaatatatgctaattattaaaaatgaaaaaatgacatagaaaatacaaatacttttgaaatttcaatgcaaaaatctttttgttgactatctttaatactacttgctcactctctgtctctctctatcccctacacatacagcttaggtaagtggcatctcatcatatgtggtgttttcaccagaaataattttataaaaacagcattcaaaatatggcttattttatttttcccctttttcttactctctctaatcttacctgtttttgaaacagataaccagaattaattacaaagagaaatgtatttaaattcaatgcctgaggtggggtatattctctaggtagtcaatgtttgtttatttccatgaactttgggtctttctatgtccttaacatggaatttccaactccttttaattcctttttcatgccatgtaattgcctagctgattcctactaatgtttcaagagtcagcctgataacattctcaaaagtgattttgagctgattttctcagaatttccccttgctttaacgaaaacaaaagaaggaagctcaggaaaaaataaacaaacaaacaaaacaactttttgctatctaagaattttcctttaaaatgaatttggatttcttggatgtcttataagataaatagtttcctactatcagaattagtcttagatatatttgatgataatctctcgtacattccatagactcaatttctaaattgagaaggaagttgtcctagagcacttgtaggtttctttccaattttatgtttttattggagctttatatccaaccctatatccttagaatcttcattatttgtaaaattatgaaatacagcaagtgatgggcaatttgtgttatcccagttttaaaagaaaaaaaattcatataaataaagcattttttagaagtcataaaacagttctattatggaagcagaatataacttaaaactataaaaactataaacttttttcagtcttctaatgtttccacttgcaaaataactgagagaatgcaaaatttgaatatagtgtacaatacagtttttctcagtcttttccactttactttttaaatcgcaaaagtaaaacctgtcatggttaattttaaaaagtatacaactaaaagtaactttccatccccaaaccagaacaccaatccctacatttagaagaaaccactcttaagaaacctaatttatgcatataattcaattgtgtaactatagcaaagcttttaaaagagatttgattacaaaacattttttgcaaaatttactgtatcatatccatgttccaaaagcaaactaaaaagatctcaataaatcttccctgtttactgaattacattgaaactcctttgcttagccttcaaagtctgcagtctgaccttactttatctttttagtggatctcctgctgcttttttatatgtgtgtagtgcactcatcaaactgaatattttatgaaactgctcatgcttttttaatctgttaaaatcccttctttttcactaacctttcaaatgcaactatctccataaaatgtactggataccagaaaaagattgtgttttcccctcttgtgattaaccataatacaaatgggtacacattatgcatataaatgaataaatatatctttcaaaaggtattacataatgtagtttcttgcattatatttgtcattatggttgtatttgtcctttaataaattttacattttcagaagagtcccattattttacattttgcacaccagagcacctacttagagtagacacaatatatatccatctttttttaaaaactctaagttctgggatacatgtgcagaatgtgcaggtttgttacatacgtatacgtgtaccatggtggtttgctgcacctgtcaacccatcacctaggttttaagccccgcatgcattaactatttgtcctgatgctctcccttccctcccctgccctgctgacaggtctggtatgtgttgttcccctccctgtgtccatgtgttctcattgtttaactcccatttatgagtgagaaaatgtggtgtttggttttctgtacccgtgttagtttgctgaggatgatggcttccagcttaatcaatgtccctgcaaaggacatgatctcattctttttatggctgcatagtattcagtggcatatatgtatcacattttatttatccagtctattattgatggtcatttgggttggttccatgtctttgctattgcgaatattgctgcaataaacatatgtgtgcgtgtatttttataatagaatgatttatattcttttgggtatataccaagtaatgggaatgctgggtcaaatggtatttctggttctaaatccttcaggaattgccacactgtcttccacaatggttgaactgatttacattcccaccaacagtaaaagctttcctatttctccacagcctcaccagcatcagttgtttcttgactttttaataatcaccatcctgactggtgtgagatggtatctcgttgtggttttgatttgcatttccctaatgataagtgctgttgagtacttcatatgtttttcatatgtttgaccacataaatgtcttcttttgagaagtgtctgttcatgccctttgcccactttttttttcttgtaaatttgtttaagttccttgtaaattctgtatattagatctttgtcagatgggtagattgcaaaaattgtctcctattctgtaggtcacctgttcactctgatgatactttcttttgctatgcagaagctctttagtttaattagatcccatttgtctattttagcttttgttgccattgattttggtgattttgtcataaaatctttgcccatgcctatgtcctgaatgctattgcctaggttttcttctagggtttttatggttttgggttttacctttaagtctttaatccatcttgagttaatttttgtataaagtgtaaggaatgggtccagtttcagttttctgcatatggctagccagttttcccagcaccatttattaaatagggaatcctttccccattgcttgtttttatcaggtttgttgaagatcagatggttgtacatctgtggtcttatttctgaggtctctattctgttccattggtctatatgtctgtttttgtaccagcactatgctgttttggttactgatgccttgtagtatagtttgaagtctggtaacatgatgcctccagatttgttctttttgcttagaattgtctttgctatgtgggctttttgggttccatatgaattttaaagtagtttttttctaattctgtgaagaatgttcatggtagtttgatgggaatgttattgaatctgtaaattactttgggcagtatggccattttcatgatattgattcttcctgtccatgaggatggaatggttttccatttgtttgtgtcctcttatttccctgagcagtggcttgtagttcttgaagagctccttcatgtcccttgtagctgtattcctagatattttattctctttgtagcaatcatgaatagtaattcattcatgatttggctctctgtttgtctactattggtgtataggagtgcttgtaacttttgcacattgattttgtattctgagattttgctgaagttgcttatcagcttaaggagttttggggctaagatgatggagttttctaaatataggatcgtgtggtctgcagacagagacaatttgacttcctctctccctatttgaatacactttatttctttctcttgactgattgccctggccagaactttcaatactatgttgaataggagtggcgagagagggcatccttgtcttgtaccggttttcaaagggaatgctttcagcttttgcccattcagtatgatattggcttggatttgtcacaaattgattttataattttgagatatgttccatccatacctagtttcttgagagtttttaatgtgaagggatgttgaattttatcgaagctcttttctgcatctattgagataatcatgtggtttttgtcattgattgatatacagaagaaacactaagacctccatttcagcatcatctttgaagaataaatttcttttgaaaaataatcacctggaaattagcatatggtgcatagtttcatgtctttgttagatgacactagagtaatacacaggttctacctcttttcgggataactaaaacagtgtcagagggcgtaaaatactttgagacatcaacttgaaaaatgtcattttcattttgtgatgatttattaaaagcccaattgatttaaaattttttattttctgttttaattgtatttctcaatttatattttaaaaatatctaacaaaaatggatatttaaagaaatacaccttgaaattaaaaaatgtgcagatttcataatttttcacattttcctggcatacggaagcttttagaaacagggaactaattcattcatacaaggtatgtgatatttgaaaataattttaactatctcattgacctttcatttttgtttacctttactctgaaaactttgggtactcacctttcttttttgtcttacatttttacagtcttaagcagtttaatattttcttttctgcttatttgtaacctttgacgctttttcagcattacagccagaagcaaatgcataaagtgtctcttcagatgtaacaaggatagcaaaaccactgggctaccggttacaagttgttattagtattttgtaatggaaagatagtagactttgaatatagccaaatagaccacttaactactcactggccatatttttttaataagttgtacttctctgaattttgtcttttatttgtaaaatattttatgtcattttgtgatatttaagataataagtgaaagcactatgcattatacaggtagatatttatttattgaatactgtttgcctgttctactagaaaaattgatctttgttcatggtatcctagaggtttttagttaatgagactattaatagcagcaaaaaaagaactccacaactctactaaatgcttattcagtttattgtttttcttttaggtttagtcatggtgttagtgtatattggtccatttggaccccagtctcatctacatgtgaataagcaaggtagttaaataacaaataaatatgaaatatcaacaatagttgtggtctcaagtttgcaaacatgttggtaccatcactgggtgtttagtttcagataggatggcagcattagaatgctgcagattctgtctgaaggaagatttacacaactgacaggatattcccccttgtaattctggtttggtacccctataatgtgatcatctcacaaccatggcattattggcatagttctctaaccaagcaaatgaagctgctatatatacacttaaatcatttggaaacatgactgtcatttacagactgaatccccttagtagtgcaaacataagtttacctatatgcacaacatacattattattcttatgtgtatctatgaatatatttctaaaatatatctgtatctatcatctatctatcatcaactatctatctattacatataagttatgtaatccaaccctcacactttccaaaaacacttcaaaccacagtcagtgatacactaaataatgtaattgcagttttgtcttcaaccttatcccatttttaagcatttattataatcaatatgtgttaggataattttggaatgttttccatggcattatgacccagaaatgcaagaaaacagaaatatctccctcttgtttgattggaatttctaaagaagctaaacatatgaagaataacctgtaagagcccaagtatgttttttattagtaactgcttgagtactcaatattctaatgcaaaactctaaaaccatgagtcctggaaccacttaggcttatggtctaagatgaggccgcttaccatccatgaaaacctccatccatatcttagaattttcctaccttgttttagaaagtacagaactgataggcactacagaatcatacagaaacatgtctctgatggctactctcaagcatgtagagggaggcaaaaccagagagaggaaatctgcaaggtcttttatgagggtgaaatcaatttattcactcaggtccataaaactggagcaaagtgtgacttgtacctttcacaatatggtgactataccttctagtaactatgagtaactatggtttatttgatgaaccaaaattagctaattggttcacaaatttaactactccttcacaatatacacgtgcttgtggaatgcaaagaatacagcttgggtagagaaattaactttccacttttcataatatgccaaatttctaagatttataagtgaggatagtatcatataagttattaacaatatgtttttttcatacacacaatttcagaaatggaaatgaatgatttttaaggttttgttttttttgttgtttttgtttttgtttttttttttttttttgagagacagtctcactctatcacccaggctggagtgcagtggcatgatctcagctcactgcaacctccacctcctgggttcaagcgattctactgcctcagcctcccgagtaggtgggaccacaggcttgtgccaccacagccagctaattttttgtgtttttagtagagacggggtttcaccatgttagacaggatgttctcgatctcctgaccttgtgatctgctcacctcagcctgccaaagtgctgggattacaggtgtgaggaaccacgcccagcctaaggttgctttttaagttttttttttttttgttttcaactttattttagaattgagggtacacatgcagctttgttacagaggtatattgtgtgatgctgaggttggggtttgattgaacccatcactaaggttgtgaatataatacctaataggtagttttttaaattcgattcctttttgctggaagccaacataactccattctaaccaagagccacatgcttaccatgtatcaaccagtagctacaataatacacagatgtataaatttgaaatttataaaagagttttgcggtccaaatgaatatgctctcttcagcttgcgagttgtagactatcattatcctaggatattgttcccatcatatgattagctcttcaaaattctaaccactttattgagcaatatcaagtcttttttatattcaatgccatttcctattattaaattgaataataaccattattcataattccattaattacttactttgactaaaaagcctcatcgaagctactaatggatctcctttcaaggcttgttaacatggcacctcaaataaaatactcaatgcctgatagctagatgcacttctaacctttctagtattgaatatacctcatcaatagtatttttaactgctgctgaggaaagtaggagatgcttgaattgctgtatatttagtttaatcatcaaagtttccataaagctgtatacattctatcttattcacatccacatgaaactgccctttcctaatacactcttttaagagaaataaagtaatgataacacacttttcaacagatgactcttatatattatcaaagatgtaaaagaaaatcataaacacaatgctatgaaaatcatatgattaaatttcctgaggagttagaaaaaattttaataactttaaaagaactagaattaaaaaaaatccagcataataatattcatagtttttctaacctagttacaattagttaactcctatttatccaaggaaataaaggaaaaagtgatttggaagttattcccttggataaataggagttttctttagggaaaactataaaatacccactgggggagcagtcttataagtaaaaggtgaatgtaacatataaagactatgccatctgttttcttttttttttttttaattattgattcagagagtaaatgcgcaggtttgttacatggatacactgtgtaatgttaagacttgagcttctagggcacgcatcattcagtgaacattgtacccaataggtaatttttcaacgcttacctccctcgcgcctttatcattttgctttcttaagtagtttacaattatgtattttttaaacatcaccccctcaaactagatgtttgtctttgttatcaatagaatacttgttttgggaaatgggagtaaaaattaagttagtgccttgtgaagtttatcaccaaatcttagagaaacaaaatgggaaacatcgaaaataactgataagatctgaagattatttttaattttaaatcgtatttgccaatattattgtcatttaacaagttaagcagttgcatgtggcaaacactgagcagagacaacagagacctgttatataatgtacttctgtagtgtgattcaggagctcccaggtaaggcaaagccaccccagaagtcatggtgtttcctcatgtttctagcaaaaaggtctaaccttggactcctgtgaattgagagaccttaaaacacattggcatttcttggtgggaatggggagacatattttcttgatttaagagtttataaatgatgtgattatttatttatttatttgaaatagggtctcactctcttaccaagtctgcagtgcagtggcaccatcatggcttactgcagcctcaaactcccaggcataagtcatcctaccagctcagcctccagattagctgagactgcaggtgcatgccaccatgcccgaccaattttctctattttttgtagagctaggatctggctatgttgtctatggctagtcttaaactcctgggctcaagtgatcctccagcctcagcctgccaaagtgctggcattataagcatgagccactgtgcctggagtgatttttaaataatttattttctaccacatttaggcctatatgacaccgtataaatttatcaccatgtatgtaatacttaagacaaatttctataaaattgaaatatgatgatttaaaaactgaaactttaaaatgttgcaaatggctgcttttcagtgtctttgagagtggcggtgtttattttgcaacctttttctggccttttacttcgtgatatctggtaaactttactgataatcaaggctgaataacataacatctacaatcagtatgtaatcaaatctgatgaaaaaacatttacacacacttatcacatatctatatatgtttttaaatgaactgtttttaagtactgctatttaagaccttacgcagtagctcttgaactggaaaatttattttttgttatcaatgtcctagtatgaatgggaatattcaaaattattctggtattcatgatgacatttagaatctaggttttcctgtttattttgcttgtctttgtctccagtctgatactaatttggaagttaatatgaatatttgtaggaaaaaactgcattctgaggagtcacttctaaatacttgcatccaaaatgttactaaatgaaaattaattgcttttcatgaaaaagggacattttacaagactgtgtaatcatattagaataatgactggcctcactaatggaaattaaatgtgatgctgggtgttctggcagggtggcctgggagctaggtttgcatgtaaaagtgtaatttctatccccgctgagtagattttgaatctcaaaataattagttctgtcaaataattaattttgttgacaggattaagtagagaatatacaacctcacacacatatattataattatttggaatgacaagatgatataaaacaataatcttcaattctggctctcaaacttgatcagatcatttctgtgagtacttttgagattcatgttaataaaccttgaatgtaacatataagtcatcatctatggcgccatttacatatggaattcttatcatagtcattaaatgtgctttatatgtgggtgtatgtgtttgtaggaaagttattgtttttataaaacactgcagttcaccaggaggtagttctaagcaaatgttaattttctgaaactctttaagaaagtgcagctatgtaaattgtgtgtttcttttgctctccgaagttagataacatttaaaaagacatattgtttaaaaatgcgtattgtttgcccttcaaatgtaattacatatctaatttaactttccacatagattttctagaacactagaagaaataacatttcttaacatacacttacatatgcacacaattaattttaataaatagccagtgtaattctctataaaactgaaatgttggtaatattccaataaaaatcacccacatgtatcctatttgacatattctgtgatgtcatggtcatttccataagatataaacataatatatatttcagagcaattatttgtagcagacagctggtaaaccaacatatacaaattggaaaatcactaggataaatatgagtgttcaagaaatttagattatatcgacccatgtctatatttaaatctatatttatttataaatctacatttatctgtctgtctctttctcttaggaaatatctctggggatggctcacaaatggcaatttttaaaaactcctcagatggttcttttgtatagccaggattaggacctatattaataaataatatattaataaataatatagatcctaagcctatatataatatcatattatgttattcataaataataaattgggatctatattaaaaatcatagaattttactcaagaatgaaacatgaagccttagaccattgaaaatatagtagccacttttccagaagacaaaattgattattgtaaaggtgtagatttttttcacaaactattttgtaatttatataacaatccaatcaaaataccattttttgacaatttggcaaatgacaaatgattctaaagtttttaagagtaaatagttatatttctatatgctattttgaaagaatttcagtaagaagaataaacgtttacacagatacatatatgtgtacatgacaattagcataatctttacatatatgtgtgtgtatatatatctatgactatataatatcttgtgggatacattgcagtccattaactgatcaaataattattcaataagtagtgctagaacaactggctacttttagaagaaacatcagatgtagtctcactctgcatgaagaagaaagtctataaatcccaagcatcccttgaccaagttctttttattctgagaacaaattctgagactaaaaaaccaagatttatacttaattgctatttgcaacaggagaaaaataagcaactctaaatgtccaataataattaaatgcttgtgataggagataaacctataaaaaatagaataaaaaaggtttctttgtaaaaagatgactaagaaataaattggaaagaaaatatgacaagagttaattatatttgtcttgaggttatttttcttcctgtgtgttttcagttttcccaatctccatgaataagcaaatatgaatttataatgagacaaaacaaaacagaaaaaaaattataccaactactatttattggagttaatttgttcataaaaacttggaatttcatcgagtattgtaaaattacctaaataatggcttgataaattttgctgtatagacatacttaatagtattgaaatgcccttttactttaattaatatatttatttctgcttcaatcaaagacccactctttaaaaaaaaaaaaggaaaaataatttagagtataatttgaagaataaacccgaaagaaggttttgaaaggaaaaatactggagaatcatttgaataatcagttttagtaatggaataagaagaaatattggcacgggaatagagaaaaatatactgataagtattaaaaattccagagcaaaatctatgtgagtttttaatatgtaaaaaggcaaaaagggcctcactcattacttttctttctctttttttagagacaggatctagctgtgttacccaagctagagtgcagtggtaggatcatagctcgctgcagcctcaaactcctgagctcaagggattcttcagcctcagccttagactcccaagtagctggaactacaggcacacaccaccatgcctggctaatttttttttttttttttttaacagacagggtatcactatgttgcccaggctagtatcaaagtcttggcttaaagggatcttcccaccttggcttcccaaagcactgggattacaggcatgagccaccattcatacccacttcacttcttttcaatagaataaataatattgttaatagataacattgaaatattgggccatctgtcagaaatcaattttatttctaagcctatagaaaatgaaagcaaggccgggcatggtggctcacacctgtaatcccagcactttgggaggccaaggagggtggatcacaaggtcaggagttcaagaccagcctggccaagatggtgaaaccacatctctactaaaaatacaaaaattagccaggcgtggtggcaggtgcctataatcccacctactctgaaggctgaggcaggagaatcggcttgatgatctcctgctgaggcaggagaatcggcttgagtgcagtgagccaagattgcactgcactcaagcctaggcaacagagcaagactctgtctcaaagaaaaaaaaatgaaaacaaaccaaaaatatagagaagattataaagatccaaaagtaaagacaaaataatcaaatattagaaaaaatatagggatattaattcagacagacatgaaatccaggtgatttaaagaaaaagatgaccatacctgattgcttgggaatataaattccttgcagatgaaagtcaccataaggaaagagagagaatcctgggagatacttaactaaaataaaatagttactataaagaacaacattaaaattgataggaaaaataaagttttaaaataggtaaatgttgtttaacaggcaattcaaaaaagaaggaaaagcaaatggatactaaagagatgaggttaaatatgtttaatagaagaatataaaaggaaataacaatgacctattcatttcaccaatcagattgatagaaactaaatttttgttcatattgaatacttttgtgggaatggggaaattggtaccctcatgtaattttcgtggaactgtgaaatgctatgaataataataattttggaatttaagagagcagcatctaataacattttgactgtgcatataactttaccctataattacttttgataatttttgtacataaataaaaggccaacatattaatatacatgtcaaatattctaaaaatattaattctgctggcaaaaatcaagaacagtttccatggtggttacatagggaatggctaatcaaataatattttatctcttataggaaaaaggcaagatttaaaaagaatgagtaactgtgcagtagcctgaaaagatgtccatattacattgttaagtaatgtaagcaagttgtacataatgtatgtgatatgatgctccagggttttagacactttatggagtgttgagacacacagatggacacataccaagtaaagctatattaaatttcaaatttagttagttaaggataacaaatcagtgcagaggagtaaaggcagaatacttcagtatgtatactcttggccccagggtcacaagctgggagattgaaaaagctcaattattgctacgcccgcacccctatttttctcaacatgtaagtcaccaatggggaagaatttaaaccatccatctaagtgatgctgtgtatgggaatgttacagatattgggctgtcttgcttgtgtcccaaatttagtatcagcaatacttcactctcatcttagggcagaaaggggagtcagatgccatgagtgcacgaacaatacacctgcctccatcttttcagcatcctgagattcctatttgccatcaatctgcaccttacctcggtttagtatccagttcattttctttctcatatcacagtttgatctgggctctgagattccagaaacattttccttatgtgacaaatttttgccttaaaatttgataccttcttatacatgctcctttatgtttatatgtgcttcaaacaagataaacaaatactcagttcatattttaatctggggaggagagaggcatgttagtattggaaggagtcatttttatttatacattttctgtgttgccatacatattatttaccaacaataaattgtgttatttttgttggttaaaaatatttagaggaaaggaaataactaaaataaaaacacatacagaataatgtgaacattttatatatttttaaaatttcaactttgattttaggttcaggggatacatgtgcaagtttgtcacatgggtatattgcacgacactgagggttagggtatgaatgattccatcacccaggtagggagcatagaacccaataggtagttttcgatgatttaatattaaatggaaacaatctaaaactgcatgtgattagacatatttttaaatggtaaagttagaatagcatgctagaagttagaatagcaagctagacgagcaagcattaaaattttaataatattattagatggtaaggttaaagatataaatttcataaaaatgttggcatattacctggtatagggtgacttttgatttattttgtcatttttactcatattaaataccatgtgtgctaagtttttctgatttttgtactttccttacacatgctagtgtactgtgaaatagaactccataattagtattgtaatggtaggattgacaaacctaacaccgattaaattgatcacgacattagaataccattctctggaatttctggtttatttctaagcatcataattacttttccctgttttctaactaggtcaccatgctgtcagtaatattttcagtgttacagctacccaggttttataataattgccttcatctccactgcagctttataaagaaagtgataccattatcccaattatattttacaaatagggtaaatgaagatcaggaaagttaaataactttcataaagacgcacagcttatagagtacattgttgtcatttgaaccaaggccacctgattccaggttctatgatatcaatattctgtgattacatccataagttaattcatagaaaaatgaagttcttctaaatttgctttctgtaatataattactatgaagtttataattcaaattactgttttctaaaatgctaataatcaaaatattttgtaaagtattcggttattggatgtttcaggcttggaaatgtatttagttgttctaaatgaaataatggaaaggaacttaagtgtttagtttttctgaatatcataaaaattttaaaaataattttaaaatatcacaacagactaattttgagttactttttattttatctaaaatatgataaattttaaattatttagcatattaagaaatcttcataatatccctgtactgagtttattttaaatagtttagttgaactagaatacaagtaaaattttacctggttgaaatattatttttttgattgacccctttaagcctaagcaactgtgcactttaaattttccagataacagatattttgctctcttctgaaggtaacaaaggtaatgaaagtttttacatctgaaacctgtcacggcacagcccaatttaaccataaattgtatgtatttatgtaatcagagtaagactgtcatctagctggcacttacctagaaagtaccatatgtactttcacaaagtgcctagaacttactataatcatttttattgacctggtaaattgacaatagtagagtttttattgttcaccactgtttctactctgcacttttcctgccccatctccttttcttaaacaacaacaaattctgcagttactaggatactatcaccaaagcctatttgtccatcagatataaaactacaattatttgtgcataagtttctcttttgattttttcttattgactgcaggtacacagaattaaattcataataattctgggtttgtgaaacatgaacatcattggtccatgcatgacccattttactataattaattatttaattactagataccaaagtataattatgaattcagtaggtatgcagttctaaagtaagacaacgcccagaaattgtggttcggtgagataaacgatcaggcttttagtctgaaagtcaggctgtagcatctggttagtatgttgcaattaggaggaaataaaaaggtctacctaagtacgaagtatattaatttgccatcaagtataaattgtcaagtctcattaagcacgtagagtttttgtttgctccttgttgctctgtgacacaggagataagctcaaatgactttatagctaacagaggtttatttttccctccaaaggcagagcacatgtttggcactgagaagatctcaccttgtatccacagaggtttgcactagccaatggctgtggacactgttgtcaataattacaagcagtttatttgagtttacatttcatacagtgattattaggtcctgaggacagtacatttcacaattagctgaaagacagttgtagccttttgttctggcagaccctaaatacattgctaatcctttctgaaggaggaaaattaagtatgtatttaatgagttgatagctggaagtagataaatgactgacatatctaagcgtctatgtcaaagaatcgaaataaacacttgttaacttgatgcattagagtcaatatgttcttttcactatcattgtaaagggaaataattagaaaagaataaaagaagttatattagacacatgtaaaggtcttacagtatttcaaagagactattttttagagattattatccctcagatttgaattataatagcatgtgttgttcaagttcacatgccttgaaaaaaaataagatctctaatttataaacaggataaacactcatccccctcaagtgcttgagactatccttagcaaacagtgattgagttaaccctatggcttatactaagctgcatcacacataggaaggctgtgtaagtgctaagttaggtcttagttggtcttggacttagccctttagctggatgatcaatatctccaaatattttagccttagttcctttctgtaaaaaacagcaccaacaatacaagttccatctacttcacgaggttattattagaatcaagaagataataatggtgaagtattttgtaagatttgagtgctatataaatataaaacataatttaaattaaaaatcttgaaaggatctgtagtgtggcatatatgctgattattaaaacttcttaagttagtactgcatgccaagtactgcacaaattatatacatatatatatttttttaaaaaaagatgaatttttccaagcgtttatgattgggttttatcaaaaaaagtgttaaccatttctacttggaggaaattgagaatacaacgttgttaaacattttgccttagattatgattctcagacttctgctattccccttataccaggctgatgatgcattataaaaattataataaaaacaatcttttcaaaaagtcgtgtatatttttatagaattgaaggattaattgtcactaggtttttagaaaggaatgaataatcattaatatgtaaatgaacataatgactgtttcttgaataactaaatttgcgattccaaaaatatttttctgcttatacttttgcttgtttgtatactttaaaaaaatgtacaaagcatgttgactacatacatattatatcaaaaaagatattctattggagaaagagaaattcctaaaaataataccttgtattgtgtactacgtttattgaagtaagggaatatctgcctggatgaacacattctttgatgtatagaccacttgggttcatgcatttgatttaatttgctgggtagcaatttttttcccttattttcaatgtgtctttgtagaaaaatggggtgcctcaaagagaagaatcttctgagaatgagaaaaatatcccttgattaaatgcatttatgatgctctgaacccttgtcaaatcctccaatattgaaattttgaaataaattgtactgctgtatgaggccataattgcatgatggaattgcagacttttgcgaacattttatcctaggctttggtttgtcttctcattctcttgacaatgtcttctgcagagtaggggtttttaaatttaataaaactcagcttatcagttatttgtttcctggatcgtgccattggtgctgcatctaaaatgtcatcaccaaatccaaggccatctgtatttcatcttaggttgtcttctaggtgttctatagttttccatttcacatttaggtcaaggatccattctgggttaatttttataaagggtgtaaagtgtttgtctagattcattttttgtatgtaggtgtccagttattccagaaccatttattaaaaagactatgttatggtctatagttttgcttttgctactttttcaaagatcagttgactgtgttcatatgggtgtatttctgagctctctattctgtaccactaagctatttctccattcttttgccaataccagtctttattactgtagctttatattgagtctcaaagttgggttgtgtcccttccaactttgttcttcaatattaggttgcccattctgggaacttagcctctccatgtaaagttaggaatcattttgttgatatccacaaagtaatttcctggaatttttattgagattgcattgaatctatggataaagttgggaaaagttggtatcttggcaatatctatgaacatggaatatttctccatttatttagatcatctctgatttctttcatcagaattttgtggcttttatcatataagttgtatacatattttgttcgatttatacctatggtaaatttacacttgatcttagccaaaaggctgagaagcgatccctatggcaaatttaaatactgtatttttaatttcaactcctctgcactgatttgttatccttagctaactaaatctgaaatttaatgtagctttacttgatatgtgtccatctgtgagtctcaatactccacaaagtgtctaaaaccctggagtatcatatcacatacattatgtacaacttgcttatggcttccaagaaatcctcggtagcaatttttcaccatgctctgatcaaaaacataccagcttcagccaggcacggtggctcacgcatgtaatcccaccactttgggaggccgaggtgggcggatcacctgaggtcacgagttcaagaccagcctgaccaacatggagaaaccccatctctactaaaaatacaaaattaactgtgcctggtggcacatgcctgtagtcccaggtactctggaggctgaggcaggagaattgcttgaacctgggaggtggaggttgcggtgagctgagatcacaccattgcactttagcctgggcaacaagagtgaaactatctcaaaaaaaaaaaaccataattgtataaatttatggggaagcttgtgatgttttgatatatgtatacaatgtggaatgattaactgaagctaattaatagatcaatcacctcactcacctatcatttttatgctgaaacatttgaattttacttattttggaatatacaatcatttattatagtcatcctgctgtacaatagatctcaaaacctatttctcctgtctatctgaaacgttttaccctttgataaacagctctccatttctatcttttccctagcccttaagcctcttgtaaccatccttctactctacttccatgaattcaacaacttattctgctttcaggcatcaattttcttcttttaccatgggaaatagcaagcactgtgcttatcaaagatgtgcttaaagtttaggcttctagtgagacagaatatcagactctcaagctgaattgctggagttaaacttaggcatttgcttgaaatatcttcagtttgcattcatgcataataggtatagaattaagtgaattaataatgtcaagttattacaacaatgcctggcacatagtacattttcaataagtgttagaattctcttattttttatttatacatggtagttgtacatatttatggggtacatgtgatattttgatacatgtgtacaatgtttaatcatcaattcagggtatttagaatatccatcacctggagcatatataatttgagtttggaacatttgaaatcatttctactagctcttttgaaatttacaatatgttattgtttataatagtcattctactgtgctatcaataattagaatttccttctatctaactgtatgcttgtatccagtgaactacctctcttcatctcacctctccccatacccacatatgcccttcctagtccctggtaagtatcattctactctctacctcccttagctctcatgtatgagtgagaacatccaatatttgtctttctaggcctggtttatttcacttaacataatgacctctagctccatccatgctgtgcaaatgcaagatgtcatcctttttatggctagatagtattccattgcgtatgtacaccacatttcctttatccattcatctcttgctagacacttaggttgattccataactttgctattgtgaatagcactgcagtagacgtggggatacaggttcccctttgatatgctgaattccttttccttctataaatacctactagtgagatcgctggatcatatggtcattctatttttagtttcttgagaaatctctgtactattttccataatggatataatcatttgtattccccccaatagtgtataagagttcccttttctacacatcttcatcagcatctattttttgttgttgttattgttgttatctttttgataatggccattctaactaggtaagattatatctcattatgattatgatttgcattttcttgttaatgatgttgaatgtttttcatatacctactggccatttttttggttttcttttgataaatgtctattcagatcctttcccttttaatgtgattgttttctttttgctattaagttgtttaaattccttgtatattctggatactggtcccttgtcagattttatcccattcaacagattgtctccccactctgttaattgtttcctttactgtgcagaagcgttttagtttaatatagtcccatttgtctagttttgtttttgttgcctgtacttttgaggtcttagccataaaatatttgccttgaccaatgtccaggagtgattcccttatgtttcctttaagtggtttcatagtttcagttttacatatatttatttaatccattttggtttatttttgtgtatgataatagacgggtctagtttcatacttctgcatatggatgtccaattttcccagcaccatttgttgaagagggtgtactttctccaatgtatgttctggcacctttgttgaaagtcaattggctataaatatgttgatttatttctgggttatcaatattgttccattggtctatatgtgtgtttttataccaataccatgctgttttggttatcatagccttggaatatatttcgaagtcaggtctgtgatgtttccaactttgttcctttttctcgggtttgctttggctatccagggtcttcttttggttccatataaattttagtattccatttctgtgaaaaatgtcattggtattttgatagaaattatattgtaactgtagattgctttgggtggtataatcatttaaaaattaacttttcattcaatgagcatgaaatgtcgtccatttttttgtgtgtgttctcttcaatttctttcatcagtagatgtttttccttgtagaactcttttacctgcttggttaaatttattcccaaatattttttgtagctattataaataaatgctattgctttctttgatttattttttagctagtttgttattattgattttttgtgagttgattttatatccagcaaactgttagcaatttttgtagctatttgtcagatttggttaagattcttgttcttatttttttaatttttaaaaatattagacacaaaaattatttaagaaaaagccataacacaattgaaatattaacctctggtaagcacattcaattatgagagataaacatgtaatctcaagtaaaaatttacaccttgattaaggactccaaggtttaaatccattggaatggactttgttgctgacatttaattaacatttgtaacttttattatcttgttatatttaaataaacgtttagtttttttaattagatgcatattctataattgtttcctattgttaatcactataataggtaggtaacattgactcttaagatacaaaatatagaagaaacaacatgaatgaaatggtacctataaataaactcctttgaagataagaaatgccaataggaccaggtgcagtggctcatgcctgtaatcccagcactttgggaggccgaggcaggtggatcacttgaggtcaggagttcgagactagcctggccaacatggtgaaaccttgtctctaataaaaattaaaaattagccaggcatggtggtgtgtgcctgtaattgcagctccttgggaggctgaggcaggagaatcacttgaacctggaggtagaggttgcagtgagccgaaatcacaccactgcactccagcctgggtgacagtgagatttcatctaaaaaaaaaaaaaaaaaaaaaaaaagaaagaaagaaagaaaaaaagaaaagaaaggaatacctaaatacctatgttgtgacacctagatcttctgactcactttagctttacaaagtaagaaagtgtgttgctacttctaaaagtaataacacagtaatctgttgtcattgaagagtcatgaaaaccatgaatgtgttaagatgttttgaatgttacattttgtttggtctccaatatgtttaaaatttaacaataggtaagtggccgtctatctatgctggtataacaaagtatttgagatagagtaatatataaatgatagaagtttgtttctcacagttttagagtctggaaagtccatgattagggaaccagcaagttctgtgtctgttgagggcccactctttgcttccaagatggcaccttgaaagttgtgtactcacacagtgaaaaagagagagaagcaaaagggtctagtttgttccttccaactatatcacaaggtcactaattccattcatgagagctctgcctcatgaatcacctcctaaaggacacacctgttaatactaccacatacgggtctaaattccaacatacaaattttgaagagacacatatagcagcatcagtttattctcaatctaagaatagtcattatgtgcccttagcccgaattgtgagtagactttgtgttgtatgtggattgttgcttgtaggtgtgggccaccccagtaataggtttttgcaggtgctagtattattaaagatgagaaagtcctctagagagctcttatagttctagcagttggttccctagaagtggctgttataggtaaagtgttttatagaaccttagagataatcagataacactacaaataatgcctgctgagtatgcagtaggttagagagtatcagcactcttttaaaaatcagtttggcttctggtctctcaagcctataaaatctacttatgtagttgcaataattgtgtttttctgtataaatctctgcaaagttaaagtcattactgtttatgtttacgaccctaagcaatattccactttattttaccaaataaacttcacagtgttcacctagaaaatagctacatagtgacagtgattatttctaaatatactttagtaaaatacaggctttttctttatgcatgaagggaatcactccctgtctaattttttaaaaagctctattttcctgtgtaattaattatattgtatatagtgggcactagcatgtttttgcgtggaggaatgttatatatactgtcttaaaatgagattcatttgaaataggaattacatatcccttaattcagtaccacagcatatattcctttcaatgtggttcctaaaatttgtgaaaaggcttaaaataacaccattaacaacagtagtcaaaactattttttacatatctctgaatctctgattctcaaaattgtgctcctgctctttccagaaatgtgataatatcttctagatggtgtctttcaatccatttaatttacatagtctcttctatttgatttagattgttggtcttgccagaaaggacagtgattaccatctttgcatgtatagtacaaaaaaaattattaatatactctgtctaaaaatggaataaattttcagttgacacaacagggaaaagaaaaaaatatttttccagcccaagaggtatgacagatccttttacaaatgttaacctaccagaaagatttctcctctggtagaatctgtgattgctcctgttcggaattttgactctcaacaaaattcatcgtatgattattaaaggcaatggatttaccagtgaatgctgttgctataagattatctcaaatgataaaaagaatatattccagatgctatttgcctggtttgtggtggtcgggggcagggtagggggcggtgtggggtggggctgagagtgggagaggtgggtggggatatagttaattcaaattggcaatatcaataagaactaaaaataatagtagacatctgggtttccagtcatacattttagatggttgtaaacacatttaatgaactcagcaataattaatatctaatatgttcaaaaccatgagctaaattatatcacagggttaaaatgtgtatgacatatacacatagagtttataatatatttcatccatgcacttaataagaaaaataatatacctaatatgcataagtggagagatatacaccagaagtattttacttttttttgtataatatttccttaattaaaagccaaatccatatatttaaatttcataaatgaaaccctagtctgaagaagctactttgtggctcgtttttagagctgtataatatatttaagcactacagtttgaagcattttaaataataatatagtactgtaagaataatttatgtatgaagttcattttgaaactctttggtgacaactctattggaccaaaattgatatcaacaaaccaagcaaagttgtatttttaatatgaagaaaggataaatgaacttaaatataagcaggagacttcacacctttctccactttgctggggtgaacatccctggttatcaagtctgcattaagatatcccaatgcaagagggtatctgtctctgttcagggtggatctctcttcagctggggattctggtttcttattctgctgagaggtctagagctgatatgggtattctatcttcttattttaataccgatatttgtaaattaaaagccagccatatcagtgtgtgagtgtaatttactgtttgaatactactttctgtctcatcagcgttgaagttaataagacatacattgaatatttctgcaaaaataaaacagcctgcatagaattggccaatctctggaatctgacctctcctgagtattaaccctacagactgtctcattatttgtattgtaatggtatcaaatttgtagaagaaatttctgacataaattctcaaaaagataactggccaaacactgttacctgagtgcataaaatatacactccagttgaatcatagatccatgcagtcattctggccccaatgcaagctatcacaggatttgcttgcaaaatcaaggagtcaaagagaatatgcataaaatatggaagtcattcctgagagtatatatatgggccataacaaacaccaaagcttatataacatcataacttgattatgtatatgctggtgatacccaaaggctaggtcataatactgaaggaaagatacctgtagaatcacaactgctcctgagtacaaggtaaatatcaaccaaggctgttatatgtcatttgtgaattaaaacactctccagcaatgttgatccacaagaaactgttgagaccaacatgcttacttcaacattaaaattatatcagataaaatactagaggctgtgtcatatatccaaaggaaccagcaaatgcatctgggaaggaacttatgtaaagcactagtaatcaaagtccaaattcagcttcagagaagttatcagattgctggaaaattgcctgagaatgtggaagtattcaaaagggagatgtaaaacgtccttggataaactcaatgtacctgaaaacatttccactgaagaaaaatagtctagggcatgaatttctaacttatccatgtattctgaataataactaagctaatattttaaaattacctcttatatgccaaatactgtgcttagtaccttagtgcatctcatttaaatttcttaaaaatcatattcatagtttctatcaccatttttaaaataaagatgggaatctcaagatcagagagcctaaataactgccaaaagttactcagctaaaaagaagtagttctgagcctggaatccttgttggcataactctaatggttaaacattctaaaaaactaaggtagacttattctccgaagtttgaaaatcttctatgttatactatttatgctaacattaaaatctagtgcaaagtctaaggcctaagtggagacaacaaatgtctagtgaactaagacgtagtggtatagttatacctatagtcaaccatctccttactattatttctggagtaagatcttagcaaactttaaccttgactaagcttaaacattagcttttattagagaaaaagcatccataatttttaatttctacatttcttagaattttccaaagttttagggaaattctgctttctatagctaaggggaagggagaagtggaaactcactcatggatatcatgatagactattgcatcaataggaataagatttattttaccaatgagaaattacattctaagtcagtatttgcaataatgcattgctagatgctatcatttatgacattgcatctacagtcatagcagttgaatttaaggaatgtgtaaaaaggaactttatcttatctagacatacagtaggcattttcactgtatcatttttgtttgctgcctaatgcaactccaaacattcaagttggtaggaagaaattcaccattgcatctattgtagcacgtttatttttatcttagaagaattcaagaaatttcaggggattgattatgggatttaagacctttcactttagggccagtcttccaaagctgcatcagtaatgactgaaagttgtgcatctctgtggccagtatagtagcctacatgaaatcacttagcgatcttaactcctgagggagctgtcatgattgacagtttgaacaaagaggacaagaatagaatggacctattaactaggactgagtgaatttctcctgtgggcatgacaatgtttacctcctgcaatttagctctttgtgacagagagttttaaaatggagaaagatgttttattcagtggaggaataagagggatacagcagagtttgattccagtgaatatacaagaacagtcttcttattctttctacattgctgtcttcatatactacatcaattataaatgaatataatgatgcttttgccttgactctccagatttgctttgttcaagttcattaatgtgaactgtcataccatttattattaagtaacagaagaaggtgaatatacagttatatgtcatatactctattttacatattttagggaaatttagctggagtttgtagatttgcggatcttataatttaagaaaaatgataacagtttctgggcattctcaggatactttttaaacggccatcctctctcttaatatgaatcatataaatcacaaagtcttagcagtttgtagctattctcaacatgacataaataggtttggcagtaaataagtccctcattgtagactccttgggttctgtagtgattggtgtcttctctaagtaacttagaacactatttgaaaataatccagatcccagaggaaacaaaagaagtgaaacccttccctcactgctgtaagtgaatgagtatttcataatcacttagaccaatggcagatataccctaagtgttttgtgcttattaaatataaactaagcatttcagaattatttttgagatagttttaatggcttctagaccttcttttaaaatgagaaatctcctaaatggaaccccttttagcaatgtctacaacaggcactaaaacaaggggatgatatgaataaagaattaaagtgtcactgatttcttcttctccactttagtctgacttcccagtctcagcccagtaagggatctttccaaatgggttttgatttttacaggatgttgctgaccagtcaccaaacaatgtaatggagtcccatggtcctcggccctctgccaaatatgattcaaatagcaatcagtgacacagggttgcatctgtgcttggtgcacaaaccctgatagtgtagacatagcaccagtcacaacatcaccaatcactaaaggaagcttgtttattaattgcttcatttctcaagatccttatatcacaagtgggtactgaccttgactgatctatttcccgcagtaaaacaaaacaaaaagtctaattattgttcatttgacttttctatataactcaaaactatcttcttactaggtcatcttgatgagcggaaagttatggaagcataattgcggtcagtgtatttagacaatatgtatgatttaagctttgttttgcagaggaaaaatgcttttcagattatcacatgtgctacatttcctagaattatatcagtttggtcacattccagagaatatggagagaatatgaatgtactttaggagaatctcttgaaatgaatacttcttagtgataccaccgtatgatcttacttctttaagtctcttttatttttaaaattgatatttaacttttcttctttgtaaaaatttcatcggaatattttatgtgatcttagtgattggatacatagacattctttagataggggtccctaatccctgggctccagacaggtatcggtctgtcacctgttaagaacagggctgcacagcaggaggtgagtggccggtgaggcaccattactgcctgaactctgcctcctgtcagatcaacagtagcattagatcctcatagaagtgtgaaccctattgtgaactatgcatgtgagggatctatgttgcgtgctccttacgagaatctaactaatgcttgatgatctgaggtggaatggtttcatcctgaaaccacctcaccatctctcacccttgtcccaccacctgcatcctatggaaaaattgtcttccatgaaatcagtccctggtgccaaacagtttggggaccactggtttacacgagccctcacagaataaatatagcaacaatcacattgcctcttatggctcagagggagcttattccatttccccaaagcttcaaaacgaaaagtgggttcttactgttggataatatgaactgctgtggattgaaatatgtctcctcaaaattcatatattgaagccctaacccctaatgttatgatatttgaaggtggggcctttggtagataatttggtttagatgaggtcatgagcgtgaagatcccataataggaattgtgcccttataagaagtggaagagaggccagagctctttctctcttacatgtcagacacagtgataaggcagttatctgcaagtcagaaagagagctgtcaccagaacccaaattggctgtcagcttgatctgggacttcccaacctcaggaactgtgagaaataaatttctgttatttaagctactcagtatggcatttttaaaaatggtaatctgaacagactaatacatcaacatagaaaggagttccattggttatttgttccattggttatttattctctatttttggcctgacccagccagttgtgttgtttcatctgcatgaatgtgtttaacccccttatgaaccaaggtgatggttccttatagaatagaaccctctgccaaattacatttggatcttcagcacttcattaaatgttccccaagagatagtttaccacttattattactctttgtttacaaaatgtcagtcatttaatttatatttaacaaataattgtttaacatggaagtttattaatattccaaattctcaactaagttttaaatattgacttaccaatatccattgatttccaattttgtagttaaaataaccaataagaaattattaactttttataactatagttgtaacattatctacaattatatatttatttttgctttccaattacttaatctcaatctccagatgaaaacacctctttcttagtacctaattgttctattcaaacctagtctctcctattaagatatcttagctaacattatttgctctaacaaaaattaatgcattcccattattctacagtaatttcatttttatgttgcttacgataattttaataaattttgatgagctgttgaaggaaatactatcatttgcctaatttttaaaatatttctagattccatttagtggtattttaagctatttttatttataaaatctcttacattaatcagtttactgtgaaatttatcatgtgacctctattttcagcgggttcttaataaaatattttatatctttaatgctttatacacaaaatgatagaaaggaaattttttttttttttttttgagatggagtctcgctctgtcgcccaggctggagtgcagtggcgggatctcggctcactgcaagctccgccttccaggttcacgtcattctcctgcctcagcctcccaagtagctgggactacaggcgcccgccactacgcccggctaattttttgtatttttagtagagacggggtttcaccgttttagccgggatagtctcgatctcctgacctcgtgatccgcccgcctcggcctcccaaagtgctgggattacaggcgtgagccaccgcgcccggcctagaaaggaaaatttttataatattgtttaattcaaatatcactcactttaagagattttctctgatatttttcaactggatatgatcactttctctttcaaaagtgacaactttagtttgtatttattgcagcattttccatggtttatcttaaagtactcacttgagtaatagctctagacttcagcagattataacttttagtgtatgatccattctttcttagtcatttttgcctccctttcatcctttcctgggtttttgaatagtgtatatattaatattgctggtggactctcatgaatacttgatgtattattccattctcatgctgctaataaagacatacccgagactggttaatttataaaagaaagaagttccatggatacacagttccacataaacagggggcctcacaatcatgacagaaggctaatgaggagcaaaggcacatcttacatggtggcaggcaagaagccaaagttgcttccacattttgggtatctttacagcagcaccccactcccagtaccaatttactgtattagtccattctcgtgctgctaataaagacatacctgagactggaattgataaaggaaaggggtttaatggactcgcagttccacatggctggggaggcctcacaatcatggcggaaggtgaatgaagagcaaaggcatgacatatggcagcaggcaagagggcatgtgcagcgaaacttccctttataaaaccatcagctctcatgagacttattcacactcatgagacttattcatgagaacagcatggggaaaaaaaaacccactcccatgattcaattacctcccactgggtccctcccataatacatacagattattacaattcaaggtgagatttgggtggggacacaaggacaatccatatcacctgggtgttttttgatatttctgttgttgttttttatttttttatttttttattttttttattatactttaagttttagggtacatgtgcacattgtgcaggttagttacatatgtatacatgtgccatgctggtgtgctgcacccactaactcatcatctagcattaggtatatctcccaatgctatccctcccccctccccccaccccaccacagtccccagagtgtgatattccccttcctgtgtccatgtgatctcattgttcaattcccacctgtgagttagaatatgcggtgtttggttttttgttcttgcgatagtttactgagaatgatgctttccaatttcatccatgtccctacaaaggacatgaactcatcattttttatggctgcatagtattccatgttgtatatgtgccacattttcttaatccagtctatcattgttggacatttgggttggttctaagtctttgctattgtgaataatgctgcaataaacatacatgtgcatgtgtctttatagcagcatgatttatagttctttgggtatatacccagtaatgggatggctgggtcaaatggtatttctagttctagatccctgaggaatcgccacactgacttccacaatggttgaactagtttacagtcccaccaacagtgtaaaagtgttccagagtgaacaggcaacctacaaaatgggagaaaatttttgcaacctactcatctgacaaagggctaatatccagaatctacaatgaactcaaacagatttacaagaaaaaaacaaacaaccccatcaaaaagtgggcgaaggacatgaacagacatttctcaaaagaagacatttatgcagccaaaaaacacatgaaaaaatgctcatcatccctggccatcagagaaatgcaaatcaaaaccacaaagagataccatctcacaccagttagaatggcaatcattaaaaagtcaggaaacaacaggtgctggagaggatgtggagaaataggaacacttttacactgttttttattttttatacaatgtaagtgtcttagtgactctatcatttagatggaaattcaagaccactaaatcagcagaatggtagagtttactagctggtgattttgtctgctccaaaaaaatattttatctaaagcacatttttgagctgcctttaatttataataaatgtatcatatatggatccaaaggtaaaaatctctctcaaatagaaattaaaaggctttatttattctgatcacatttctttataattttacagagcatttaccacctcagcctgatatttccggaatgaacccttaatcttttaaattagttatcatatgacagatacttgaactttttattcttctgaaatacagctacactattgtatctttcctaagttttcaggaccaaaaacagccgttctctaggtttgaatgaaacataaatagctagatgtatttctgatttacttttatcctatatgtctagaaggcaagatccctgttagcctttcggggtagagcaattcattaaaatacggcctcaattttaactaagtaaaattaaaaatacagtgtcttaatcatactagccagatttgaagggttcaaaagtcacatgtggttattgactaactttttggatagtatagatatcaaatgtttccaccatcatagaaaattctttggaacaacagcaacagtagtttacagtttatcttttattttacaggagttttcatagatagacactttacatgagctccatccaaacttctaaattaaaaacagacagtttgtttgcactgaaaaattcattttcccttgtcatttgttttttagttgtaacatttctttgactgttatacaccatttttgtgtcaaaatatagatattttttccaatgcctgacagctctctattttttctttttatcacttgtttttagtaattttattatgatgtgtctggtgtggttatatacatatttattctgcttgaggttcattgagattcttagatctgtgggattatcatttttatcaaatttggaatattttggccattaattttcttgaatatttttctactagctccttggagactccagatttatatatgtttaacggcttgacagagttaaatattaactcactgaggctctgtatattttttcaatgttttatccctatactacattttacatattctctatttctacaacttcaaattcacaaattcgttcttctgcagtttcatcaccattcagtgatttaaaaaaaagttttagatattacagtttttatctttaaaagtcccatttgattcattttttaacatctttaatgtctcttctggtcatgggtcatatttcaattcttaagatctgtaggagtttttgtgtgatggtgaaaatagtgtattttatgtgattgaatgacttctattttctcttttcttttttcttttttttttttttttttttttgagacagagcctcactttgtcactagaatgcagtggggcactttctgctcactgcaacctctgactcccaacttcaagcaattcttctgcctcagccttccgagtagctgggatttacaggtgtgcaccaccacacttggctaatttttttgtatttttagtggagatggggtttcaccatgttggccaggctagtctcaaactcctgacctcaagccatctgcccacctcagcctcccaaagtgcagggattacaggcgtgaactaccacacctggcccaattattgtttttaaagaagtgttatacttttctttgacagacatttgggttgtttctggtttagttggatcatcttaagccttgttttcaacttttgctagggtggtcacagaatacctttacctattggaatctttaatctccattactaaggctcacccttctgatgcctaaatttaattctccaggtagtcaatttggactctgcactgctgctggtaggaacttgaatgattcttggccttctgcagttcttggaatcattcagttcacaagtttgcaataacttcttgcccagcctcgtgaaattatagcgtttgcatacatgacttagaaatcagcataggttcaaaggactttaaagcagatttctagagttctttgtctgcatagctctcttgtctcaagaaacctgtcacacaaattccaactgccccagatgctctgaactctgatctgtatctcctcaactcagtagggtcactgtctcagtttgcaatatcttccccactccacggacactgctctagacctgaaatatgttttacaggcagaaagcttggctgtcctatgttttactttccttgtctcttctttctcagatgtaatggctctgtactgcctgtagtttaatgtcttaaaaacagttgcttcatctatatttccctggttttctatttctttgagtcaggagggttaatttagtcactgttactccatcgtggctgaaagtggaagtctttcttcaactgatgtaaaagtttatgtaatagaaaagatattaaactatgaattgaggcctaacttttagagaatgttgaaatgacagaatacaatactacaacaaaacttactcttataaacactgatagaaactgacaagtcggtggttgtgaagaaaattagatatatagatatgtatagattttaaggtaagtaagagttattaattagaattacacagttgtcagtttggaggtacaggtatgagtgtcatctacacagaataaaagaacagagcagagtccaagatagcatgttgacattcacagtgaggattcagagtacagctgtaccctcgaattaaatttgaccaagggttatcaatggcagaccaccgggctctgtaaaccacaggtctgatctaatctagcaattcttgtgtttgcattttaaccaatgtatatctgtccaggaaataaaatgtcaactataagaattgtttacccttgaaaataactctatggtgtttctaaaaatatatgtcacatgagatcacaaacaaagtagtatgctttctgtggattgtattactggtgttggcttggaatggtaagaaaggaaactgactctaaattacctatcttgatttttcttgtttcattaattctcagagcatttgtcttgagatatacaatatctcaaattgcaagataaaaaaatatatatcaacttttctttcttcaactctactttgaataattcataaaggaaccacttaaaggtagctaatctgaatcaatacaaggcagtgttataatctttgtttctaatggtgttttactcttaatttttatgtaaataactgaatgtattgtttattaaactgatcttcattataaggagatatttataatgttggctgtccaatatgaagtaaagctttaaaaatcccagatgtaatattgaacaacttaatttgaaacattttatgctacttggttgctcttgatttcaggagtatctgttttaaatgcataataagtacattttcaagcatatccaatttacatgccttaaagacttccaccgccttaatgcttaatttagaaatatcattttaaatgattcttaaaaatcagatgcacttatttttgtagctgtaatattttaagagagccttcatataaaaatatagttgtcactgacaaactgtatcaattagctaatgttcaacaatgatcatcaatgtcagggactgttaccttgttgaaattttagtttagccttaatggtgtctataaattaataggtactgtaaatgatgcatgacaaaaaatgggttgttagcaaatgttgtggaaggaagaaaggaaggaaagaagggaaggaaggaaggaaggaattttcaaggccttaagaataaatctatatgtgctggaatacttagaaataaaagttttgtttaatttaattaaacacagatattctaccaagctcacaaaatgatttttaaaaatactagcaatcattaggcaacataggagcctttagttaagtgaattagaaagtgaagttaagaataaaatttcaacagttacctaatctactaatttgctgatcattgatgaacactggctcttatgttttgttttgttttgtgtttttatgaagctgacatgtactattggttcaaataaatagcatatatagtattctggctaagtcgcttatttttaaaattgtggttttcttatgttaaatttttgaattgaatttctaataccatttttccttttccacagcctttaatggaacaaattgttagtttctgacagaagggttctgatgttgaaatagacagtatgtctacctattacagaaatatagaaataaaaatgcatgtactcaaacagaagatggaggttacatttctttattacatctatcatcagaccttagccatgttggatttttggttgctgttgatagaataaggcagattttcctcaaactttcttttgcaaaatagttagacttaaatataaaaacaactgcaaaatattcagtcattaacaaatcaagaatctttataactgaatgttaagtgattatgttttttctactgtatttagcaatgcaatacttaccttttatattactaaatatattaattttattctcaagaaaatcattaatacttagggattggaggtttcctgagtgtaatattgaaaaactgttaaaaagccactgatacccattcgatctaatgatttaccttttgattatttgttttgtttgtttgtttgtttgtttaaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttggtaagtcatgctcagacatggatctcacgttattgttcatatatctggaaattgttttatttcacaaaacccaacaccactgttgtttctacctcttctttaaccaattagagtgattttatatttattatttatattttttcatcctcatattgttttgtatataggtatcttattttctgtacaaatttataaatttgagatcaaggctactttgcaatacttattacctccacccatcctaacacagccaggcaaataataaatatgcatcaggtttaactttatttgacttgagatagcatctgtcttccaggaaacactatcctatgcaaaaaataacttcacttgtcatacttatagcatttgatctgagcctaatgcattttcctcatttcctatgttttggaggagaaggggtagaaaatagcgaaagaaagtaaatttttagaatggggaaaggaatataattcacattttaaaaatctagttaaggattttgtgtattatacctgtataatcatgcataataatcagatttctgtctaatgttcaagaaataatatagtttttttcaaagaaaggaaaacaatgcagtctgaaataaaaagacttggaaaaatattttataattaatgtgtagataaaaatcaaaattagataattatttagatgtttttctaccttaggaaaaaaatatggttaatatattaatgattcctcaatttatgtttcttgttctgtctagattaatatatcaaactcattgtacagcatcttctcatggatactcaaaaggcatttcagcttcatatgcccagaacaaaacccatgattttccataccctcaaccttctccactcccaaatttcctcatcacaataaagggaacccccaatttatccagtttaaaaaaaaaaaaaaactttgattcttaacttcccccatcatcaagttcgcttgtcaatatattacaaatatagtccaaacccaatctccttttaaatgtgtgctgaaggccatctcatacagcccatggttgtatctcaggggcactgaaataactccctagttggtccgcttctttttactcttgccagagtgtcttttaaaaacattgatcagattatgttcttaacctgcttttaaacctctaatgcctttctcatacagaataagattcacattctataccatacctacaatgccctatactgccacatcttcaattctatctccttattctctctcccttcttgaaccactctagtaatgctggctgccttgataatgcctcaagcattccaagattgttcctacttcagaggctttgtatttgctattccctctgctcagacaacaggtctttgctaattatttgctcctttctttagagtgtgctgtgctaaaaatttacctccagtgagaggcctttactgaccagcctatctaaaatagaatagtcatcttcctccttctttcactgtctattctattactgtgtgttaatttttttcatagcacctatcagaatctggattacatagttcaatttataatcttacctgtgtcatgaccacaaatataaagatgaagaagcatacaaaagaagcaagttaaaagtatagagaaatcaagctaggagagtgttaagaatattgtgaatattatcaaatgatataacacaattaaaactatttgggaaggtatgaattcattaaaatgtaggagaagtcagagggaatagtcttgagggaaaaaagcaaaagatgttttgggtaagtgcctgatatttaactgcaaacaaatcactatcagataggaatatagtttttatttacattggtcccatcgaactttctatattttaaagaaaggaaagaaaggaagtgctttccaacagacattggtatattttccacttgtctttttgttttccttaatgtctccattctgcttgcttactttgatatgggaattttctgacatttgtgttttcctttttaagttgaaagtcttaattcagggccatatcccagcagatttcagggcaagctctatttactgtctgtatcctgattgttatgaaactaacaaatacttgaggaaatgcatttaattatttttgttgtttgaaaaattaattatcagtttaagatcaattaaaagcctgattcactttttaatgagctacagctaattttctggagttctgtttcctatcactactcagttgattgctgtctttttgagaagaatgcaatgggcaaagataaataccacactaaaaatgtagtgccttacatgcacaaacccaaggaaaaaaatgatgacaccaaattgctttgctttgagaggcacaaagttaaattgtacctcttctaagataccatttctcattctcagtcattcctcttagatcctctcttagttttgtcctcaggtaaatctttagagcatatatcctaatcatctataatcacactttgtgcctgaaaccaagtcttagactttatttctttagttcaaatctcgtctttcactacctctgtccaagctgaatgacttcatacaaagcaagtacattaaaatttatctaacaactttgcttttcaggtcaagtgcttgaatatacccagcggtttttttgtttgtttgtttgttttttactatgttgctagaaactcaggcaaagacatgacttccaattgttccctatagaagttagttcatccatcaggtcccgaagaagaccctcagtttgtaggatgtatatacatttctagctttaagtattatacctttgtttttgatgatttgagcaaaacttaggttcaagtatattaatcacttgcttcttgagttttttgattcccaagtaaactctttctaatctgccctccaacaaaccccggccagttcttaatatgaagtgcatttttatggatgaaataataggctattattatatgaagttattattagtgtcaggtaccacgacctatctaagcattctcctttctcttaagagtgagaaggaaattaatattgattagatcatgcactgcattagtactttacctttattaccttatttgatctcaaataatgcatatttgtacatcattttctgaaaaggaacaatcttttatttactgcatgtttaaaatatttatatatgatttagagattaaaaattaaacatcagtagtaccaggaaaaattaaacactctaatgtcagttcttaaagttttatgaagactatagataacttggccataatttaatttactttcttatacatttccagttgtttggcacgtctttcgcaccatgatagagggtatccatgtttattcttagcttctgtctttgatatataatagaagactgctaaaacctctgtggaaaaacaaaaaagattgcattttgactcatattacttagggattcctaaaatgtcagaatctatctatgaaattattcattattcagaatttttttaaatcacaattcctataatgtaaaaatcctcataaaactttacgtctatatttggttatttaattgattttaatacaatttaaatataagcaggtgaaatttaacatatcctcttaatatttaattgagtttgaattctaagtttgttaatattggaaatatttattgcatttttcaatctaagtgtagtcattagaacttttttcctcaaacacattatatgcgagataaaaacattttaaatgcttaatagagacaatttttatgagtagtcacatacgaagtgtccttttacacaaaatgttatgcagaggttagagactaagactagacagtgccaattttatgtatctattgattacattggcttgattacagacatgctataaataaacatttgcaatgtctttctttatattcggattattttactgttacaatgcttgtaaaagatacaatttatgaacttgagaagccagctgtggatagtaggaggaaccaaacactgaaaaataatttatctagagcaatcatttttgttctgaaacccatatgcaggcccctgtccttaagaagcaaagtgtgctttaggaaaagaatatataaagcagagaattaaattaattgtatcacattgtaagtgtcttgcaaatgcagaaagaattcaaagtgggaacatgatgaatagggatggtaaattttaaagtaaatatggtgaatatacttaactagatcctgaaggaagtaatggaattgtcttagtagagaggaagatgtttgagagagatataagaacaaagaagagaacattcaaatgcttgtaacaattcccgtcaagcatgtgctgagagcaatggatttcaaatgtcttttcatccccaactgttttgcatccagagtgatcttttcaaaatgcaaatctaatcatgtcactgtcttttaaaactttcagggatttctcattgttctcagaaaaaagaatgaaacctttgctgtgggctacaagtttctacctcatttgtttctttgtcacctgcagactcacatcatagccccatcagccttgcttagagctacaactacattcacttctttcagttctttgaacaacttgtgttctatcgcccaacagggcctgtgcacatgctatcttgactgctcagaaagttcttccctatgaagctctgcaccacctcaccctacttccccacttaatcccttttgcctggctaatcattcttcagatctcaaatgaaatttcagtactttagtgaaacctacttgtgtccctcaaagctagctggagtgttttacttcactttctagcaagtatcttcttttcaattgtatttttatatttattattttgtaattgatatctgtcccttctccctctaagctataagttttttagggcacggaatatatatgtttttactcatcttcttagcacctaacaaaatgctaacacttccatggcaaatgctcagtgaggatgtactggatgaatgattggatagatggttagtaggaggaatggatggacttggctaaaggggtccctcacatggaaaagagcaccacaggaagaagacaaagaagcaggaggaggagaaataagaagagaacagggagaagaaggaaggagaagtggcaattacaagttccccagaaagtgaggcgatatagttggggttgctgctaagcgaaggcaaagtgatcatgatcagcttgctaaggagactaggtatttaatcttgaaattcttcaacagacattccaaaggtaactgtttcgtaggcctgatttcagttttttataaatataatccaatctttaataagcatgaaatattaacacatatatactttattcaaaagttagagtgaaggatatattggtttgaagaaagatttctattcatgaaaaacttcctacacattccttaaaatgtcatcctttcatagttttctcttattaatagctggatatttgcatggcacttcatcattgtcaaagttctttcatgcacatattatcttctttgattttcacaacaatgccaataaataatattagtatttacgcccattctgctggttaggagccaaagcacagagaaatgaacttagtctatatcacacaaatggtggtgcaagattgttggctcacattttctgaccgtaattatttttactatttctctttccagaaatttattccatttcagcagagtgatcatcaactctgtcatccaaacagtaatacttttgagagtaaaaagttactctcattgattttgctttgtttgtggagcctgtcctgtgcatggtaggatgttagtagcatccctgcctttttttttttttttgagacggagtctcgctctgtcgcccaggctggagtgcagtggcgctgtctcggctcactgcaagctccgcctcctgggttcacgccattctcctgcctcagcctcctgagtagctggagctacaggtgcctgccaccacgcccggctaattattttattttattttattttattttattttattttattttttgtatttttagtagagatgggtttttcaccgtgttagccaggacggtcttgatctcctggcctcgtgatccgcccacctcggcctcccaaagtgctggattacaggcgtgagccaccgcgcccggccgcatccctgacttctacctgcaagatacctatagtaccccttccaaatagtgacagccaaaaattgtctccatgttaccaaatgtctcctgggaggcaaaatcactccagttaagaattactgttgtagggtaatcataccaaaataaactccattaattttcagaattgttctaatggtcttaggataaactatattaaaacaatgctttgaattattttgacagtaactcataatttataataagaatgtatcttttccaattgttcaggaaataaaactcagtaagtgcgtttcagggcaattttaatgtattcatgaccatagcttacccacttatatcaccagtttgttacaaagccttctgtctcttcacatctttaatacactgacttttagaggtgtgatttttctccgttagatccctccattcaaacatgtctaatcgccactagaaatgatgaagaaaaagaaagtatcatggaagagttaagtgaaaaatacggagtaccaagattactcagaggctcaggacgatcttcaaatatatattattcaacaacaacactaaaaacttgttaagacaaatacagaattgtagtatccctagttgatgttgtctctaacaaatacattagttttaccaagcatccatcctatttcactttggtaagtattattcttctgcatatgcctccagcttcaaattagatggagtatctgagcatctagcaaggacagattgacagacagcctggggtgaaatgagtatggataatcatttttgacaaagtagtctatcacagaacccctaaagaagcacatgaaccttatggagatttctaagtcatgaaaaatcttgtagaaaacatccaaagaatgctgcaggtaataaatagcactttcagcaatgcaccattatgtaattctattaccatttggactgagaaaaaagaagataatttttagcttttgcctcagtgtctaaagaagatattgttatcataatttcttaacttgataggttaacaaaacttccactctcgaagatacaaatcaaaagttagtgcttcagctactttaaatattcgctgcaataagcatacaaaaatatttgaatatgtaaatcttggaatttttcttaacaacctttgaaactattcatcattctagctttttccactaactaaacgttcaactcattcctatattttaaacatccaattttcctaccatattttatgttatacagattatgcaaagtagttcatcaattgcagaatgctatgtagagatggctactatatttgttttaaaaactctattcagggtgtatacgtgcacatgtaccctagaacttaaagtataataaataaatatatatattaaaaaaaaaaaaaaaaactctattcacgggccgggcgcagtggctcacacctataatctcagcactttgagaggccgagacaagctgatcgcttgagcccagcagtttcagacctgcttgggcaacatggcaaaaccccatctctgcaaaaaatacaaaaattagctgggcttggtggcatgcacctgtgatcttagctattcaggaagctgaggtgggagaatcacctgagcccgggaaattgaggtagcgggctacagtgagctgtgatcatgccactgcactccagcctcagtgaaagtgaaatcctgtctcaaaaaaaaaaaaaaaaagtctgttcacaaggctgtggagggacttaaatggtatacaaatgagtgggagtgtgaaaaattacttacgagatggtattcagtacaaatcacttttgtttcatcttttctgagattcatagaaatatattgccatcctgtatcagtggcttgtagtaatgttttttatttatatatcattttttcctcatcaaccttctcaaagaagatcaaggtacacttcattacatttttaaaaaattatctttccagcatccttcaaggaagttagatagtagatttaattaaactcattttacaaataaggggaattctataatgtacttaaagagagcaggttttatgaaaacaaaaatctcagaaatttcttccaatattgtgcataattactgtaagtttccttaattctacttccaaggtttgtatgtatgtatgtataaatctggtaattgtttaagaagtcttcatcctcatctttcactgtcatcaattaataagtaataaaaacaatactatgtgggttataaagcacaacagacatttaaagttttcagtaattaaacagagctacttaaaatgctgtaaacaaatgctaattagcaagcctccacgatagagtgaattgtagaactaacggtctgtcagccagggagatacatggccccacatatgatagaaagcccgggggatttgctttctatttctaaaattgcttatttgactcaatcactgaacctaaattagcgaaagcagtggtagagactgtaaataatttttttcattaaaactatcattggaaacttctgagcaacatttaaagattgtattagttctaacttgcttgttgttacttaattcctactacaaagctaaataatatataaaataaatagaaaaaatcagtgtctcaagttatcctttaatgtggggaataaaatgtctgaaagtcatttatgaactaattttagaatgctctactactggaaatatttattctttcaacactacatttgttgttttagatgcttgccaacatatatgttaaattctaaaagagaataaaaacatagtgcctccaccaaaatgaaataacataaaatataaagtaaaataataaaacaaaatagattacagctcttggaaaatattctaattgtggagtaaaatatttatacataagataacatgcagatgaagatgataaatacaagataaagcatgatgtaatacagatcaaataccataaaaggatgaagtattgtaaatttatttaagaaaggcttatgcgccagttgtggagtaaaatgttcacctataaaacaacacacaataggaagtgggaaactcaaggcattacgtaacacacatcaagtgctaccggaattttaaataaaaagtattataaggttgtttggaaatgtggattataataaggcctgttaggaaatgtggatttgaatttaactgttactctaaaatatgtggcaaacaaattgagtataatcatgaagaaaatctttataggctgcaattcttaagtaattttaattggaaccaaaacacagaattgaaatatagcttgcaatgtttgtgaaagttggtggtttcgagttaggctcaggactcacgattcctatgttagaatcctagctctccacttaggacatgtggaactttggacaagttactaaaggagcagctgctgttgtcttgtctgtaaaatgtaggtatcagaatagggcccacctcatagagttgtgaagattaaatgcatcaatatgtgtaaaatggttaaaaacatttcctgggacatacaaagtgatgtaaaaacctaaaagaaggcaaaagggctagatatccaattaagtcctactgtttaatgccttctaaaaatgaatttagaaaactggagaaacaggtcctagatctttagctttttgaaggtgttggtcgtgttacaagaatttatgttctctggctctaattttctcatttgtgaggaagccatgggactaggtgatcagtaagatcccaaaaaagaccaaatagtcatgatggtttctgctttttctgtcttgttgaaaaaaatctttgcctcttctttggccataaagacatgcttctgtgtttccttgtaagggacttttgtattggttttactattcacatttagactttactacctctggaattgaattttttggtatggtatttgatagtgaaaaagattcactcatttccatgtgaatatcaagtaatcccacaggatttgttgaagagactcttgttttttaactgccctgaaatgtctctctgaatatatattaagtgatcaagtatacatatatatatatatatatatgtatatatatatatatatatatatgtatatatatgtgtgtgtgtgtgtgtgtgtgtacatgcacagacatacacacacacacacatgcacattttaatttacatgtaattaaacgtatgctgcaaatatgatattgtaaataatactgataaatactgtaaatgacaccattttggacatatttcctaattgtttattcccggtctatttattgatgtatttatgaccttctaaaatcacgtattaattttaagcttactctagatttttaaaccagtgtatgtgtacaacaatgtctcttgcaaaaaattgagttttatttattatcttccaatacgtactcatttctttccttgcttattctagaataatattgaagagcaatcatgatggtaggtagctttgtctcattacgtgagaaacctgttaatattttgttattattgtttatcataggatttgtgtgtgtgtgtgtgtgtgtgtgtatgtgtaaactttctattaaattaaggaagttatcttctatttctagttggctaacaacttttaccaggaaatcatgatgaattttatcaagtatatttcatgcacgcattcaaatgaatttttattttcccttttattctgttagtgtgatgaactacaacaattgatctttgattgtgaaatcagtctcatacttctggaatcaacccatcatgataaaaaaaagtgttgtcttgtgtgtttttttttaacctctatgttcatgataaactattggcttataatattttttctggttatgtccatgccatttgtactgtcgaggagatgctggcctcatagaacaaactaggaagcattcctacttttcctgttatctggaagaatctgcatgtgattggtaacatttcataacatttggataatccatcaatgatgccaattgggtctggaatattttgtggaactatctttaatacagatctaattgccttcattgaaaagtactattgagatttttaaaatattttcttgtgtcagttatggaaaaatgagttttcaaaaaaaagtgtacatttgatacacattatcaaatatattagcataagattaagaactttaagctatgtctttttgtttttttaatcagaatagtgataatttttcccttacctctttcattttaagtcagattagtcatctattcaaacacccaaattatggctttgtgtattttctctatggcatgtttgtttttgcttcattactctggaataatatccttttttttttcttctacactttgtgggtttaatttgccactcttttcctaacttcatgaatgaagacatagatcattgatttttagcttctcatgttttctaaaacagcatataagtctgtaattctctctgagcacagtctcagcctcatcccacatgttctagtatgtcatattttcagaatcatttagttgataaatattttctagttcatgtctatatttcttctttgaccatgggttattgagaggtttgttactgacattataattttaaaaattgattttagcttaatttcactgtaaccagaaaataatatataataaaattaattaaaattcaatgagaacttttaaatagccctagatatggtcagttttagttagtgttctatatgcagttgacacacagtacatatattctattgttgttctgggtatccttctttatatgtcaaacaggcaaaaatcgctaactgaattactctgaccttccgcatcgttactgatttttgtcctcttttccatcagttattaatagatgtgaattacgattatggatctttctgtttatcttcttagttctttattttgttttatatatttgaagcaatatttagtaaatacaaacttggaattggtgtatcttcctaatgtagtcatcctttcatatagtatgatatatctatatctttagtaattatttctgtcttagagaaaagcttggtttaatcttaatattccttaactcacttcctcttgatttgtgtttgtatggtatatcatttttcatccgttttaatttcagtgatcctgtgtcttaatatttaaagtgttcttgcaaggaacatagaatcttccaaatacagtaggacaacctttgtttttttaattctaataacctattcacatttaattgcggttatatttgaatttgtgtctacaagtttgctgttttttaaatttgttccatgtactgcatgttcatttgtggccatttttagattaatgtttcttttattgttttgccgtttccactctgttagctcctaagttctgtatactttactgtatacatctcagcttataccattttactttttttatacatcatccgtttcctcctcagtacctggattgttttgaagtaaattccaaatctcagattacatcatttaatctgcaaatatttcagcatgcatgtgtgtatatgtataatatatgtttcagcatatatgtatatatgtaaatacatacattataatttcttaaataaccacaatattattatctgatacggtttggctgtgcccccacccaaatctcatcttgaattgtagttctcataatccccatgtattgtgagggggaccatttgggaagtaattgaatcatggggggcagttaccctcattatgttctcacaagaactgatggtttcataaggggcttttcccccttttgcttgccacatcttgctgccaccatgtgaggaaggctgtgtttgcttttccttctgccatgattgtaagtttcctgaggcttccccagccctgaggaactgtgaatgaattaaacatctttcctttattaattacccagtcttggatatttcttcatagcagcatgagaatggactaatacattatctcactgaatataattgctgtaatcccttagtgtaaatctagtaacaatcgtgttttcacagttccctctcataatcatttaattaatttgtttgaattgaaattcataaaagatacagagattgagattcattgacacgtcccttaagtctcttagtttaaaagctctcctaatatatcccacatccccttgtattttatgttgaaatacattttgactccattgaaagaacaaaatcatttgtcctatataattgtacaggtctacagtttgattattgcatccttctggtatcatttaacttgcttctctgtgtttcttgtacttcctggaaattattaattatatctagaggcttgattagattcaggtggaattttttaaagatttattcctggtgactgtgaacttccatcagaaggtacatgtctgattttctctccttttttggtgctaacagccagtgaatataaaattcactcctgtcttttttattgtttttttttgctggaattattctaaaaagagaaatatttttcattacatatttgattaccatgaattatgattgtatagaaaaataaagtaacttactatttcccctttatagtagtattcaaaatagtaaagtggtggtgtatcactttacaaaatctcacaaatcaccactaaagaacttatttatgtaaccaaataccatctgttccccaaaaatctatggaaataaaaaaaataaaaaaaaacaacttagtaaagtggtttcctagtattttctaaagactaaaaatgagttttaaaatattcttaataattttatgagctcagggattaaacatagtagatatatttcagtaccttgccattatctcaattaatggtcaaattattatgactttggctttgacaccatatttatgttggtttctgggtcgttttgacataactctaagagtctttgatagtttcctttatttctgatatgacaaaatgtttctgagtcataatttcctgccccatgttgggaatcaaccagttctctaaaatactctggtatcatttattggggaatactatttagatccaatattctgggtgctaagaaagctcattaacctcatcaatcttacagtgacatcgatcagcattgtcagaaatatcacttctcaatgacactattatgactgctcatttgctttatcccacaatacacctataagtctcagaaaaacagtaccaccagcaccaacatcattatgatatctgaaaagagtttaataattttttatttgagggctgcagaatattccagagaatattctgttaggtaagaacaacaaaattattatgttttaaagtcacttggagtggttctcctctgtgaggttatgtcaccaagtaaatacacagttttaatgtttgattattatacttgcttttctttaattttttacaaccatatatgatacttacacgattccaaaatcaaattaaaaatatatatattcaaagaaatttagctttttttccctctgctatcctctctctcttcccacttgtaaacttttatttttttaaaaatctaatctatttttctatctacatactctccattttagataaatcatgatgtgttaaacatacttttatccatgtcagattttttatttgtcttttcttgtaaaaatttcatatcttttggagatactctctttttatcattgcatagtattctattgtgtagatgctccatgtgccatagtttattaaaccagactactgaggtgatgactgaccttcaaatgtttccagtcttttcttatcattagttacactgcagaaaataacctgatgagtatgctctttcatattttacatagggtacactgagatagattccaagaaatgagtgtgggatcaaatagtaagaacatattacattttgccagatattttcaactatctatcatattattcaacttcacattttatcatgcaatgtttgacagcatctgttttccatatattccatatatccatatatttggaatatattttacaacacaaaatatatttgtaaaacttgaatttttccccatctgatggatgatgataagtagtatctcatatagttttaatttgtatttctcttattataagtgaaatcagttgtatttttcttatacattaagaaaataattaaattcattaaccttttcactgttgctccttgaatcatatttctgaaaaaaattcccacttctaacatctataaaaacttgcctttttttctcctcatgcagtttatgtctcttatccatgtggaatttacactgatatgcaatataagaaattgatcaattttttaccatatccatacagttatccagctacaccatcatcacttattttataatccatcttttcctctatagtttaaaatcctgcctgtgtggtatttaaaatttccgtaagcaaccagttctatttttggatttgcttttctgttccattggtctgtctgaactaaaacctgtcaatactaaatgattttcattggagaagagtagttttatcatctggctggacagtcctactccatgctgttctctttcaaaactgtcctctctgtacctactagatttttctttcaaataaaatttttattcaaaatttttagatacagaacaatattatattctaattgggcttgctttaaatttgtaaataaacataaagggttgacaactttgtgatattggaactctgcaactaagtacataatatgtatttccatttgtccagatctacttttgtgtcttttggaagtgttttatggtttacttcatgtatgatcctcatgtatatttattatgtttctgttttaatacattcttttaaatttgttagcataaatagagtattttctcacattatatctttttttctttatatcttacaactgattttgttttcatatatgaatgctactgagctttgggggagtaatattataatgacatactttacaagttgtctctttcttaagtggtcctgttgatattttctgcttctcaaactatatagtcatatctacaagtaaagatatcttacattttattatcaaattattatgtttttccttgtcaaactgtattaactgatagctccaaaaggactttggtattagtaacagtgatgaacattcttgtgttgctcctgattttgcagtaaattttctaacatttccacattaaaattctgactttgggactgagtttatgtgtgtgtactgtatgtgagaaggaggaagtggcagggcgggatgagacagtggagagagacagaaagagagaagagaaaaagatatatatttttttttgacaaggtctctgttgcccaggctggagtacagtggcgcaatctcggcttactgcagcctcaacttcccgggctcaagtgattctactacctcagcctctggtgtgactacaggcacatgccaccatgcccagcgaatttttgtatttttagtagaggtagggttttgctatgttgcccatgctggtctcaaactgctaggctcaactgatctgcctaacctcagcctctcaagatgttggaattacaggtgtgagccaccacgccgagccaagagagaaatcttaatgtaaatatgtacttatgtactgaattttgtcaaacgtctttttagcatcatggagatgaccatctgacttttctccacaactctaccaatgagatagatgactgtgaattaatgaatttcttaataataaatgccacttggctgtgatgtatttgttattatgttgctgaattctgttagataaattttacaatttttgtttataagtgagttgattagttgtttacttttttggagaaatcttatactctggcacaatatgaattcctaacatttcttattttactatgcttgggttatctgatctttaaagaatttgataggattcccctggataaccaagtgtatctagggattttaggggtgggtagggctcttgaatgactttatttcttcagtaataattgtgctttcttactctcctttcccagttattttggttaggatagatagtgctttgtctattttgttggagttttcaaataataagctattagatttacatcttagttctaattttaatttttttaattttaccttaagttctgggatacatgtgcagaacgtgcaggtttgttccaaaggtatacatgtgccatggtgggttgctgcacccattaacctgtcatctaggttttaagccctgcatgcattaggtatttatcctaatgctctccctcctcttgccctcccaacaggccccagtgtgtgatattcccctccctgtgttctcattgttcagctcccacttatttttaaacatttttttccatctttttaagtgggtgttactttttattcttaatttttattttcaaattaacataggtatttagcgttatttctggcacttgatatgctatatttttctaaaattctgtagttttagtaattcttttatccaaggactgttgttattttttttctttctttttacttatttttttaatttttttttgagacggagtctcgctctgtggccaggctggagtgcagtgatgcgatctcagctcactgcaacctctgcctcccgggttcaagtgatgattctcctacctcagcctcccgaggagctgggactacaagtacctgctaccacgcccgtctaatcgtttgtatttttagtagagacagggtttcatcatgttggccaggatggtctcgaactcctgaccttgtgatctgcccacctcagtctcccaaagtgctgggattacaggcatgagccactgtactcagccaagttttttccttttatctctaggaagaccttttcattgtcattaatttattgtattattgaagttttctttgtgggataatatgccacaatttggtaaacattcatatgataaaagttgatatcatttttgagagttgagttctctggtaaatgtttaccatgggtccttacccaggtttccagtggttttcattgtctgaagcttgacttttagtatattccccagaaaggctaatgggaataatattccctgagttgttgcttttatcctcaaagttgtagcctttatccttgaaggtcacttttacttgttagctgttctcggtcaatttctccaggttaaaaatgtgttcccttagtatatattttcaaattagattttttttcaggaatgtgttctcaacttataatttatggtagctaatttatatcgtttaacatttctttgctaacttctacgtttatcactttttctcaaatcctttttatctttttttaaagtttatttttgatctttaaaatttacttcctttccatctcgtatttttcttaagtatgattttctgtgtttgtttgttcacatgtctcttctagcataggctttctttatgaaattattttctgtaattttcaaatatttcgagttctgtcgcatgtttacagatacctttttctccactcatgtcattgtagggactttcttattctaattgctatacttatttaatagttactaccatttccttaaaagttttagcacatgttgaaattatgtgttataattttgtttttttgtggccatgtatttccagtgtgcttttgtcatctgtatggatgtatttccagttcttgtttactttcattttctcttaaaacctatttggagacttgaatgtgatctattcctgttgtacatcttaaaaggaaattcacttttcaatgttttcagaagggataaagtaaggcagaatagattttctagctttaaatcattagaattctcacttttgttgttttcaaaagtgattttaaaatatgtccttttagaacttgagttctctttactgctctttcttcctcaattttatttgagccattttttctctttttcttttttctttttggacctaatttgctttctgttcaacttggaatttattctatgcaatttcttttcactgtgatgtttcgctttgcttggaaggaaattactggttgttaattgagagtttaaaaagtcaaaacctctctagaatgaagaactttcctcaaaatacagaccctttttatgtactcgcaaattggatcatgagagccctctgcaagttttggatgctgtttccatatggatctactacatccaaagggagtagctgtttgaactgtcctgttctcagagaggcccagttatttttattcctctttctcccacacagatacagctatgctatgtagaccttgcagcgggtaataatttctctccatgtgcttactcatctttgagggttcatggcatatttttgtcaggagctcagctaagctggagaaagtagccaagtaaaacaacaagccgaaatgaagataacagtcaaccctttaatcacttactgtgatagtgtgagctagaaacaaaacagaggaaaacaatgccacccccttccaatccattttccccatggattggtgtgatggttgaggttcaggtggatcaaaacagacttgagggtcatctttttgatgacatagctctaaacaaaatgagtttgccattttatggatccaggaggtgggagaggacaaggggctagggctagaagtggaaaaatgctgagtactgagtctgaacagagaaaactccttcaaaatgttttgcctctcccctgataaggaggtctttgcaaaagctctgaggaaggcctctgggaaagagctaaaataagtaaactactgaatggaaacacctgatctaggaatgcagatatgcatgagagtatggcaggccggggagcctgagtccttaactgcaactcccttcagagactgcagtgccctggctgtgtatccagtctagggtagggagggcagctttcccccaggaggcctgtccagtaaagcctttgtaattgcctatgtttgagcctaaaaaattcacacacagatttttttgatcagaagctaaactcctcaaccttgtcaccaatatttgttgtatatattggatttggattttttttatttcaccattgtaattgtggtgtctgtttttatgaggaacatttgtggagtactgccaccaccacctatccagaacactctctacatacactttagcaacaggagaccatattgtcattgtttggtggagccaatactcattaacatttacccagatagctaccctttctgctactcattgttcttttccttcatttccatgtttctttccaaagaactttttagtatttctttaatattaattgagagcaaacatttctctcaattttgtgttaatctgggtctctctctctctctctatccttctccctctctctcccctccactttctccttttcctttagcttcactttcaacattatcttcacaagctataaaaactagattggcagttattttctttcagaattttaaagatatcaaagaagttgctacaattaacagtaaagatattttctaagaattgaacagccttgctaatgtagtagttaaaatttaatcaacacatgagcaaacttattttccttatgttcctctcatgatattgaaaatatttataagttctagactgcaaatagtaccatatttttctttaactactaataatgaaaagtgaagctgaaaaattacccacatagacttagttaaaataatgtttctttaataaaatattatatatttgatttattatatacctttttattttattttataagagcaaaagtaggcttatattataacagaaatatgtttgtcctttagaaacttatgacagtctatttcagagtatagccattatgaacgcggttcctataaatactattattctgacaattttctgcaatgttgaaagtaaattaaggctcattattaaaaaataaagttttccaaatttcttagtgaatttttacctttgattactatctataaaataatcataaaatcaccatggaaacagaaattgttgtttcaatattaagaaaacaactatttcattgcgacaaaatctaggtctataaccattacccaaggtataaatataaacttacattaaatagagaaattaagaaaataaagcataaacaagattttttaagggtagtgacatttacacacaaactaaggaggcacagaaaagaatatggcaggtttttttctatttttccactgaataactctagtttttaaaaatagaatttttattggtattacatttattacattgtaattttctgttttatgttgaaatttaaatttctactagataaaggctagagaagaatataaacggtacctggaatcagtcttttaaagtaattgtaataattatgtcaagtttctttaacaacataacttttcactgtttccattaacatgcatttcttttaaaaaatgatttattgaccaacataattgtttctggtttgaagatgggaattgtgtgacatgaattctaactcagaatcatttgaattcaaatctggctacagtcctggagtgcacaaattattccatatagatgtgctagatgaagatggtataaataagagaggaagttgaaatggagttaattagatcaggcttttcctctttaaaagacgacttttgagttgaaatattaagtaattagagacttgatagagttgataggtaagcacattctagttaagaggaatagcttgatttaaaaaaaatgaggaaagagagtcagaagtggataataatagaaagaagtatttaatagcagtgagggattatgttggaaaacagcaaaagataattctagaaagatagtgggaatacactgggggcagagagccacgtataatttattcttggctgtatttctatctcctaggctggtgcatggtgctgaataaatattcattgaaataaagctatgccatttttaccctagcttggaccaagatggtaactgtataaatgaaaaggaatcatttaatctttcatttatcctagactttgctctgaatgcctattgcaaagggaataaaacattgcctcagtactatagatactcccatttttccaaaggctacagaataacaggaaaaaaaatacacatgcatgtgcacacatacacatacagagagagagagttcagtacattttgataagttcaaaagtagagtgatgaataaagtggatcgagtaactctgtcagaaacttttaggagaggaagttttttttttttttgactatcagattcagaaaatgaaaaagaacagtgagaggaaagttttaaaatatctccaaagttgtgcagaactgggagaactgtggtttcagaaaagtgctgagaaaatacaaataagatggttgtatttccaatattttcaattaaatttaaagcattttctgttgttttacctattgtgtaaactatagtaggatgtgtgtgtatatatatatatatatatatttttttttttttttttttttttttttttgagaaagcagagacagcaaaggtagctctgtcaaactggtgccattgttggtgattaactggatgactctgtctccaatatgaactcactcatatacacacttattgcttagaagacaaggcaagcaaacctgcccaattttacagaggagaacaatttcacttataagctaaagttaacactcctgatactcctggttcatggtgctccaatatttgttccacttttcatgatttgaccctacttagtcttagactccttgctgttgatctaacctggtactctgattttggctctttgttttgactttggtttcctaattagaccccttttttttttcacattccaaaagttgacttcttgttgcaacttcatataatgaagtgcatgttcatgtcaattaaattcaccagcctcaaatttaaaatatttccatcaaatttttatagtaagtagcattcaaaatgaggaaattattatattaagatccttaaaataagacaaagtgataaataaagaagtgactagtcaataacatgattaaagatcctgaggtaggggttgaatgggcgcaaggagggaaaaaattcacacacatacatacataaatgaactagatgagggataaaaggaaatcttatgcaattatatggaaaaatacttaaatattgtaagtttacaaattttaaactactttgaatttatataaagtaaaaacaaatcttaatcttaaataatttgtttagggaaagactccacttctttcacttctttttctttttttgggagggggacagcatcttgctctgttgcccagtccctggagtgcagtggcacaatcatagctcactgtaacctctaatacctgggctcgaaggatcttcctgcctcagcctcccaagtaattgggactacaggcacacactgccatgcccagataatttttaaattcttggtagagactgggatctcacgatgttgcccaggcaggtctcttggcctcaggtgatcctcccatctcagcctcccaaagtgatgggattacaggtgtgagccactgtccccagccaagactcctcttcttattgacaagagttgagtaaaggtcaatggcatgtactggtgctgaggaaattgtttcttgcaggttccatctgccagcctcacaacatccctcaaacgagacatgttttggggactgagatctgtacctcaaattgtttcaaggtaaaaatagcacagttaagaattggaagtatttctaaaagaatatctattaaattattttgtaacctctaaagtaacattttcttattgtgcctggaaaaaaaaaaggagtgaaaatttattaaatatccaaagtaaaatcaagctacaggtggcagtggtcctttaagaaaattaatgtattttgcctatactgtctattttatttcttacgtgtatatctatgttaatatttaaatattattagccaagtgactttaagtagtagaagcagaaaatttaagtgttacacaaacatttgctgttaagatgaatcatctttccatacacataactattttcaaatactttagaatacaaaatgctttttaaaatgccttgaaaacaaagaattaatctgacataatcacatccctaatagagttttattttcttatatttctttaattctcttactgaattgaaacttaataggtttcttttagaaacttgattgtcatgatacaatagtagttttgtaataacaaaattcctaaaaaaattaagtaatcatggctgaaagacatttactcgtgtgtaggcaacaatgttctatcattagctcaagtcatctccatatttttcactttaagttaattagactatcacacatttaaacactggagatgtaacaatttacggtagttcattgtgttttgttttccaaccagaacatgttctcttaaacatgagagtgcatcttttgaagagaaaagatatcaaaataatggtgttaattgttgtctagtgtttctgttatatgaaaatataaatattacaaatctaggagccacatgtctatgtaaggagtattttcaaatgaataatccaaagaaccaaaaatattaaaacattccaagttatatttgaatcactgtatgttcatcaccaaatgtcaaagagatggagacacatagtcccagtaatacttacagcccctcagagcactccgtttctccagcacctggtaatttctgggattcttgctctcctagctcagaagaatccttttagccacaacacatcctatttccatatcacaaaccaaataccaatcattcgaattcccatttcagcaggtcctcacattcaacagtgcctcgtctcttaggacgaataatactatataaatgcaagtaaataaaataaaatgtctaaaatattctttggacccagtatagaaattttgataaattatttcttcaaaacaaaagagtatgacaaagtgtcagttttcatgtgagtcgcccatttttttattaaagaattttcaaggataattttgagtcataactctttttttacctttatatgctgactttagatcctagctataaaatatgttggcctggcacagtggctcacgcctgtaatcccagcactttgggaggctaaggcgggcagatcacgaggtcaggcgttcaagaccagcctgaccaacatggtgaaaccccacctctactaaaaatacaaaaattagccgggcgtggtggcacacgcctgtaatcccagctactcaggaggctgaggcaggagaatcgcttgaacccgggaggcagaggttgcagtgagccgagatcatgccactgcactccaacgtggcaacagagtgagactccatctcaatatatacatacacacacacacacacacatatatatgttggctcccacatgattacttgtttaacacttctctcctcatctagacagtaatttccatgacaatatgggaaacctctgctttatacaccagggtggctctgatgactggcaggtagtggcatgctacataaatgttcattcttgggctcttcattcatcctgtggaacctctttaggctgtttcatgccacagactcactggaagaaattgccgtcttctctttcactaactggtacaacttcattcaaggaaacatttcctgaatcagtgaacatttggataaataaaagtaatgtgaatgttctgttttgacattttaatttaataatacgttctaaagtttcctttaggtttttggaattatatttagcttctaaaattttgccacttaacatatgctagaaacagccccattctcaccacagagataatctcccaagtatatgataatcattgtagcttatataacattttctaaatttagatatcccatcagtatataatgatcaagctatttgctaacaatttagaatggaataaaaataataatatggaaatttgcactataaagagcaggtgaagggtagtgtacataattttcactgttttagataatttgcttttgcaatagagtcataaacattagaaagaacaccagaacttaaaataacctgctcacttgggcttgcctctacagcatgtctgtatggtctgcactctctccccagattaattgctttcatatcatgtacatttgcaggaacagtgtgacaaatgataaaacaaaataaggtcacttaatgtgattaaggacaagagtgatttgtgcaaaatattattgaaaattactatttaagttgcattttgcgtgtacttttcagaattttaaaaagagtgatatgatgtgtggagatgatggatgagggtgagatggaaagcatattaatgtatgaagccactgaaacttctgaaaagatactcaagagttttacattaagcatctcaatacctaaaataaagctgtgagataagcattattaatttattttcagatcagaaatctaaggcacagagggtttgctcaaaaccaaacagctagtaagtgtcagagttggagtcttattaaggctatttgactccaaagactaagctcctatcgaccatgaagaacttgtaaaagacaaaaaaaaataaaataaaacaaaaacacatctttattatttattcacatccctaacacattactctggtaatttttataacattggtctccatttttgacatccttgtaatgactttttgtagacagagttatttctctttcctgatgtcagtattggccatgaaacttgctttggctaatagaacacaagtgaacatgatatacaccacctctgagtggtgctttaaatgtgctcacgtggtttgattttaccactctgtttctactcttttttttgacaacagcatgttttgggaagagctgctctttcagcctgagtctctaagacacctagcacagatctgaacaccgaccacaccgaccaaagcctgaaacagagactcagcagaactgtcacagggcatattatttgaatgggaaataaatattaaagccactgatattttggggttacttgacgcatagcataatttagagaaagctaaataatatgcttttcaagcatttaggagatacagccgcagatctgaaaagctaattggtaacatttttacaataggaaacctaacttgtcacagttttcttctactgcatgtgaaaagcagaaagttgttgtagagatatattttcaccccgtgtagccagaatagttttgttgccctggtgccaggaaaagacttctttgtaaatatatatccccactatggtacgagatcatagaaattaattcatcttgcttaagcattgtttcctcgaaggagagagtttttataaataatcctgggagaagttactcagtatgtaagcaatgccttactgtgcatatgtttgtcaaagtaattttccccgtgactggacaggcctgggatggacccacagcaatcagcagttactgggtggaaaggaaataagagtctcaaagcagagggaaacagtgacacaggctgaggaattaaatgactattgtgacttcttttatatcattgattactttatatcgcaatctgaaatcagcaaaaatatttctagagcttatgcattctctatgaacatttaaacatttattacaatatgttaattaaaatgatgcatgcataatctgactcatactttaatttaaacatagccaccttttaattgtgtctatcacacaaagtgtgtatttacaatagagttggcactatttactatatttactatttattctagagtatttagaagatctatttactatagaaaattgttgctatgatttcctggcctaatgagaaaaaaaaaacaaatgctgattaataggccagtgaaaaatttgagtgaaaagacttcaagtcacactgcccaaaagaagattttgcaataattttaccagaaaagccatacaatgcagtcattaggagcattactttgggaagtaagacaatgtagaagtctacagaacctgaagcatacaagtaagtatgttcatcttgtaagctgttacttagtttcgtgatccatcccattaatgtaatgttgctgatttgaatttatggatattatggctttatttctgtttaatttataaatgagttttatagttgcttaaattataagtgtaaagaagctatacttagtttcacatttatatgtattttagtagtgcaataaatataatttaagtcaacactggggttagcaagaattgtacttttccttaataaggcttattcctttacaagaattgtgcttttcctttatattcattggtgaaaacactattttgaaagcataaacttgcctggtattagttgtacaaatttaaaaataaactggatctgacaagtttccaaattaggtattcatttactatatttggcatgtttcttgtgttttgtagtatctgtaaatcatctgcaaaactgacagttaaaagatgagaagttactgtttgtgaatcagcctagttgtttcacttgaagacttttttagttataagagattagggcatttctttgtatttccatttaagaacaatttttaaaaaaattgttgtggaatgatagtttctatttctgttagctgaactcacttctgtgctatttctgttagtttaaatcacttctgtggatttaatttatttcccagttttgcaattatgagggtttttttctgggtttatgttgacctatatatactaaaatttgaatttaaaatttctggtcgctggagaggaaaagttctcctacagagataattaggcaatatggatgtagtttttcaacatgtgctgtaaatttcagtgaggattgtcctctgtaattgcttttagcactttctgattttgtccttggcaccatggtttgagttcagggcacctgaaacacatcattctctttcttctaaagaaggtcactagcctttgtcctctgcactgtaccgagtctgtgaaggaacacaatagtaatcaacaatactacaaataatatagtaaaatctcattaagccttcatcacattttcatgtcattaccatcatgttttttctgaaaaataattccatattctttaacagagacccaaaatagcactttctgtttgtgtggttcttcctctaacattttttttaaattactgagtgatattttttttaaattactgagtgatattttttatttatttgggagaaaaagatgataaaataatgtttttctgttcatattaatttaattattgaagtgtttttaatagtgggtttataagtatttaatgtaagaattattttgaaatcataaaaagatacagtaagtgtgaaaacattaaaataattatacttagggaagtcagagtgcaattgtcttagaagcaattaagaactatatttattctcttattcaaccacaagtatctcttaggataatctcaaaaagcagaaaacagatcctttgtcctttgtttatatattttttaattttgaagtcattaacatagctttttatgtaacccattcagtgtctggaaaatacttatttctcatgaaattaaattcacatttcatggtgattcatttttcatgtagatgattgtgaatttagtttggtaggttggactattttgattcataattagaaatcaggaatggcgtaatagaatggaaaactagtaatatgattactaattaaagagtaagcaaagatctggcttgtgaaaataaaattatgttaatgaaagtgataacttatttcaggatttaaggggctcaggtgggaaaaaattagacatctcaggatatgaccaagctgtggttgagcatttcatatagataaaatcaggtcagagtagcagctaacacaggtcagcaataaaagagtaagaaacaggggggaaaggaggctgctaggagacactgggctgggttatgagctccaagagtactgtagaggcatagtacaagagagctctgaactcctacaatcaagtgtaggcaatatattaggtttttttttttttttaattgcctcaaatggatgctaactctgcctaacctaaacaaaaatgaacgtattggaagactatgtgagagtttataatttccatgagaagactggagaatcagacctgggaaatgataaatctaaagtaactacaaggtctgaaaagtctaactgcgagctagactttcattcttatgccattatttagattataaggagagagtgtccaaatatctgtgccaggttaccaatctatctcttggctagggaagggtaatataccttaaataaaatgttcactaggctataaacaataggaaaagagacaatttctcaaaaaaggggaaattatcaaaagaaggtgaagtagaagttaaacaactaaatatactgataataataatgtcagcaacaaaaggtagaaactatccagagccatgggtatttctatagataccaaaagcttgtgaagggacaatacaataacaatagagacaatgtagcctgggatataattatgtttttattccattcattgctatttcagtgtcttaattgtgattactatttctagcaatgctcccccaccaccaaaatttagttgttctctttgccagagaattctcttcttctgagagactcacctcttattttgcatccaaaaatattttggtttaggataatacagattagggtaaattattgtatcagtggcaaatgatactggagaccaaatttcaagtgaagaagagaggataaggtagacacggatgcttgggttgaccaccgcagagaggcagcccatcaccctgcttatctgtttggggaaaacattataagaggaggtttcaagtcagagaacttgtcaattaaatgcccttggctaactctcttcatagagagttacctattctctatttctggttctctgtaattatcaaatggatgttttctcctcactgctagattttgtgattgtgcagcaaaggaatcatcttttgtgttgaatttagggaaccactgaaatcctagaagtttgaatgtatttttcagaagctccttcctgtcttcactcattaagttttattgaatacaatatgccaggcattatgccaattaacaataattaataccaatctctgaaaatctaatttttcttaacctagggacctgacaatagtgttatttaggattgcatatgctgcctactacattttcttctataaatggcaattttatgagtgaaataagtcagacacagaaagaaaaatactgcatgatttcacatataaatggaatcttaaaaaagtataatatataggaacagagagtagcaatggtagttaccaggagtgagactggattgtagaggggaagagcaagatttagctaaaggccacaaagttactattatgtaggatgagtatgtttaaaaatgaggtccggtagtcccccctatctgtggccaatatattctaagattcctagtgaatgcctgaaatcacagacagtcctgagccgtatgcatactatgttttttcctatacatacataacaataataatcttcaatttataaattaggcacagtaagagattaacaacaattataataaaatagaacaattataacaatatgccagcatcactactcttgcactttggggccattattcagcaaaataagggttacttgaatacagccactgcaatagtgagacagtcaatcttatcagatctgagatggccactaagagactaacgggcatgtagtgaagacagcatggatacactagacatagggacgatttgggttctggaatggagtgggaccctgtgagatctcatcaggctactaagaatgacacacaattaaaaacttacgaattatttatttctggaattttccaattaaaatttttgaacaacagttgacctccaggtactttgaagtattactaaagccgatatatctaagaactcttttcaacctggccttttagatttccaccaaacagttgttctttgatttcagtatataagacttttttcctactgtcatttcacagctgagcaagccatgtgaacctttgaaagctatagtacaatttaacttccaaatgcttatgttagggattaaaaatgcaaactcagtagtctcttggattcaaatcctgaccaaaatacttgctgtaaaatcccttatgtgaatcccattgtgtgccagctatcatgtaacctcatccctgactgatatttattttaattgcatgtgatcttactcattatagttcatttgcataaagagagtgaactgtagccggccagcaagtttaaaacctgcagtatttttttattccctgtgataaactttggtcataccactgatgtcctctacgtttaatggtatcaaaaactcataagcaaatattaactcgttaacatcttcacatattgttttgaccaacacatattctcctaaatttgccaatttaatgtttctaccaatatattaataaaatttgttttttccttatagttataattaggagttccatcaagtaggtgaaagatggtcatataaaatgtatgggaaaagattcctaaaaaatggaacagatgggcatccagctttagcagtgaccactattcactaatatagctacttgccacttttgcctttaaaaatcactactaactaacaaccttcttgctatacaaaatgtggtctgcagaccagaaacatctgtctcacttgacagacactggggcccaactagaggcctactgaatcagattctgcattttaataaggtctctaggcaatgactgtgctaattaaagttagggaggcattacgctaatctaccaaggtgatcagagactgggaataccatgcagagagaccttgggcacgagactcaatcaccatatgtgcattatagaagcctgtggctttatggcatgcagtcctctggatgagggtctgaacacctagacaaagctttccttgcagagaaatgtagattctggaaaggaatggcagtcactcttacatgggcagtcctaggagtacctgatgacccctttgtaacagatgaactgcacaggagacctggatctcttctggctccgagaatatgacagtagtggctttggcagcaaagaaactcaggagtagagcaatttcctaagtccttcagtgaaggactggtggctttccaactggtgtatcacagaaccacagggacagatacagataatttctacataagattccatagcatcttgggttgattctcatgaaacataagctcatgaggaaacacaaaaacaaacaaacaagaaaacaatgccattaagagcattgagaaattatacaaaggaaaaagaagaaaactaaacagcacaagcatcttctaggaaagaagaactggaggaggcagactattacattggcactcacactcaatttcctgagaacctttatatgagttaagtacagtctcttcttagagtcttatcttagaagaaccagtagtttggggcagatttagagcctttagtgtaagcaaagctgactgattaaattggtaagtttttttttttttaaattaccagcggtcgatatagcacagcgaacctagatcttttctttgttgtttttatgtgcaggaaattgctccactagaaataaaccttcttttccttacactgtggttaaagataatgttttaaaaagatgtctccctgttattcacttttacgttttatgatattatgattctgtttcttattttggttacatgattctatatgtatttggggtttatgctttattatagattttgaaaaatgtaatgcttatttgctttgtttttaatttttacatttaaggaacattattttaacaatataaaaatatttcaatgtgatttcaggagtttctagaatgttgcatttatgtaaaatttttacaggtatgtaaaaatgtatttgagaatttccctgggggaattgaagacatatatacacaaaagaatacaaaaagaaacaatttcttcatataaactactttctaatgactaagtattatcttataatggttttacctctcttagatttaattcttatagtcatgtttcttctgtcaattctaacttcaatatcattatacttaattttaaaagtggtacaaaatataagttagctctgcctttctttatcatctcttgacataagtttcctcctgtaggtgctcttatgtacactatgaaatagaagtcttagaaagcaaaaagttattatgtatccttagcccaatctcatactctgtagaaacacccatattaatatatgtcacacataataatctggcttctcttgaacactttcaagaatgattattattattgggaaatatttcctggactaagcttcaccctgcattttcataatgttaacttcttcccaagcttataacctgcatctttagagaagcttaaggctcaatccatatgatagccattcagaatttttaaattgtcaacattttattgctaaagtcttttatgttttgctgtctgccacaatcccttcaatgtgtttcccattcgtagtttctagatcttttattatcttcctgctaatcgttgcatggcttctccctgaattgtcggttacttttgtaaagagtagtgattttacagacataaaggcttctaaaattattgtctgaacaccagaaataaaagctttcctaggtcctgaatgtcccaaactacatttcatcgtatttatattagtgtgacccaagtttaattaccttacttagcaataattttattttgtattgtaatgattgttcaatcaacaaatatatgaaaatattcatataaagattcatataaaataagttcataaaaagctcatataaaatactatttaggcaagtatctgctcatgccgcattcatgcaatttacttatctgaatgtaaatcaaggctttatatttatcaaagctgatattcattttgttaatgtgctttcataattttcctttacaaaaattattttaaatgtcttattctgttttctaatatattagcagcttccctgagatttgttttatccaccttctggtgaccaatgaatggaacagtattaaattatatcccaaagaatctctcttctggactatataaattacatatgtagttaatgacaaaatagattaattagctaatactatttgagtgcagaagctcaaccacttataaatttaccaaactatgtgttttcatagccattttctcttatgttgcccatttggctggcacaagatatttttattaaatatcttggcaaatcaagataatcaatttctgtaacatttaacttatgtagcatctagcatctcaacaggaaatatttatctaagtatcactgggtcttatgaaattaaagctagtttctgaagagaattcctataattaaataagattatgctgtatatgaaaaaggttttataaattttgacagtattatgcattgtaagggattactgagggttgaaaaaacgatctgcttaataatagtctatcctagaatttttttgaaaaattaaacaataggattattagttcaatggatcttcaacaactctcaggaaaagaactagtaataataaatgtcaataaatagttatggaattaatgtctgaatgcctgttgattgtgatgaagtgccaactaaagaaggatttaaggttacattaatttaggtgcaaattttaactttgctatttacttatactgtgaatcctgaataatttacgtaacttttctgagcatcctcaacttcctcatttgtaaaatgtgttaataccacctaccttgggggattaagtaaaataatgtatatgaaataaataaaatagtgcaaaattgtttatttccttctttcaccccatctcttcctccaactaaagatgaaatgaattaattgctttgtgccttagtacattggacacaaaaccaattcatttgaattaggtcaggcaaaagttcagtcatttggctactagtatcctttgataatggaagtattatggtgtgtattttttcacaggggccattagactgtaggtcatttggatgtcattaggagaaagaatgatgatcttgaattgcatagaacatttcgtgctttctcatgctgtgctctttactctttccctttttaagagaaaatctacaaaaaaattttaaactacattataataatattattctatactggaacaaaaaaatgacaaatatacaaacaaattcaaactatggaaaaagttggtggggcaggggtggagactatgaaaaataaacaatcaaaacagcagatatgttcctaaattaaaagaaaattaaatattagaatgactaaagacttcagcaagctacaacaaagccaaggattttttcttctctgtgcatactagagccacttattttctctttaattcacattatactttattatatagtagtagacacttttgctttctttgaacattttattcatttactacaaatgtatattgactctggatgtctgttcagaaatcatgcaactaaacaagaactcataaccgtgattttttttagatggttgaagacctttatggtgcaattatccaagttaatgaaggaatagaatcagacactaaccttgagagtacataatccaaaatttactggataatatactatttttaagaaactgaaataagagccaaacaatggacctctagtttttctaaaaccagtaattacttgtgggtaagttatctaaattattgaaacttggccccaattttcccagctttttaaattacagaattatgctgtctatgattatattagatttttcaaagtgactgtgttaatacatttgaatataattctctcatttacagtttcttttaaaatttttctaccagcttatcccatctccttgaacaatttcctcccattcctcatttgtattgaatatggaaagaatcacttcttaaagtaattaaagttatcagcctaagaattgaccttttttgaatagggttgtttattttgttgttgagttatatgagttatctataaattctgatcattaatcacttatcagatataatatgtgcaaatgatttctcccattctgtgggttttctagaattcagttcatattaacttttaaaattttgttttaattttagacagcatgtctaaatgcatgttcattacatgggtatattgcataatgatggggatttggcttccagtgtacccaaaacacaaatagtgttgtacccagtaggtaatttttcaaactcaccctctaccaccctccctttttggagtccccagtgcctattatttttatctgtatgtccatgtgtggccattgtttagctcccatttataagtgaaaacatgcagtatttgattttttgttctgagatattttacttaggtctccatcaccatctatattgccacaaaggaaacaatttcattttttatggctacatagtattccttggtgtgtatatataccacatgttctttatctaatcaaccattgatgagcacttaggttggttccatgactttgctattgtgaatagtgctgtgataaatatacgagtgaacgttgtttttttttttttataatgatttattttcccttaagtaggtaccaagtagtgggattgctggattggatggtaattctatttttagttctttgaggtgtcttcatactgttttccatagaggtttaactaactgagattcccaccaacaggtcataagcattcccttttctccacatccatgccaacatctgttatttgttgactttttaatggtagccattttgactgtggcaagatgatacttcagtatggttttaatttgtctctctctggttaaatgatgttgagcattcttttcatgtgtttgttggctgcttgtgtgttttcttttgagaaatgtctgttcatgtccttttcccagtttttttttaaattttattattattatactttaggttatagggtacatgtgcacaatgtgcaggtttgttacatatgtatacatgcgccatgttggggtgctgcacccattaactcgtcatttacattaggtatatctccctaatgctatccctcccccctccccccaccccacaacagtccccagagtgtgatgttccccttcctgtgtccatgtgttctcattgttcaattcccacctatgagtgagaacatgcggtgtttggttttttgtccttgcgatactttgctgagaatgatggtttccagtttcatccgtgtccctacaaaggacatgaactcatcattatttatggctgcatagtattccatggtgtgtatgtgccacattttcttaatccagtctatcattgttggacatttgggttggttccaagtctttgctattgtgaataatgccgcaataaacatacatgtgcatgtgtctttatagcagcatgatttataatcctttgggtatatacccagtaatgagagtggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccacttgttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcagttttgtcttttgttgccattgcttttggtgttttagacatgaagtccttgcccatgcctatgtcctgaatggtaatgcctaggttttcttctagggtttttatggttttaggtctaacatgtaagtctttaatctatcttgaattaatttttgtataaggtgtaaggaagggatccagtttcagctttctacatatggctagccagttttcccagcaccatttattaaatagggaatcctttccccatttcttgtttttctcaggtttgtcaaagatcaggtggttgtagatatgcgacattatttctgaggaccctgttctgtcccattgatctatattttcccagtttttaatggggttctttatttttttcttgttgatgtgttgagttttttgtagattctagatattattagtcctttgttggaggcataatttgcaaatattttctctcattctgtaggttgtgtgcttactctggtgattatccctttttctgtgcagacactttccagtttaattaactgtcatttgtctatttttgcttttgttgcatttacttttagggtcttcattataaattctttgcctaggtcaatgtccagaagagtgttttctagattttctttgaagatttttatagttttaggtcatacatttaagtctttaatcaatcttaagttgatttttatatatgatgagggacaggagtccagtttcatttatttgcatatggctagccaacttccccaacactatttatcaagtaagttgtcattttgccattctttatttttgaccctattgtcaaaaatcaatcagttgtaggtatgtgacttaatttctgggttctatttccttttccattgatctacatgtacatttttgtgctagtaccatgcttttatacctactgtagccttgtagtatgaattgaattcaagtaatgtgatgcctccatatttcttctttttgatgaggattgctttggttattctggctcttttttgcttccatgggaattttaggattggttttctaattctgtgaaaaatgacattagtaattggataggaactgtgctgaatctgtaggtggccttgggcagtataatcattttaacaatattgatactttcaatccatgagcatgggatttttttatttgtttgtgtcatctatgatttctttcatcagtatttttagttctccttgtatgaatctttcacctagttggttaaatgtattctaaattgttttttttttctaactattgtaaatgggattgagttcttgattttgctctcagcttgaacattattgatgtgtagaaacgttactgagttgtgtacattgatttcagtatcctgaaattttactgatatcatttattgatttttggagtctttcagaggaatcttagggttgtctaggtatacaatgatgtcatcaggaccagagataatttgacttcctcttttccaatttggatgccttttatttccttctcttgcctgatctctctggctagaacttccaatactatgttgaataggagtgaggagtgtgccagttcttgtgccagtcttgtgccagttcttaggggaatgctttcaacttttctccattcaacatgatgctggctgtgtatttgccatggatggctcttattattttgaagtattttcctttgatgcctggttttttgtgggttttgtatcatgaagcgatgttagattttattggatgcttcttctgcatctattgagatgattatatatatatttaattctgtttatgccatgaatcaaatttattgatttgcatatgttgaactatccttgcatgcatggaataaaacccacttgaccatgataaattatcttttcatgtgcttttggattctgtttactagtattttgttgaggagttttgcatctaggttcatcagggatattggcctgtagttctgtttgctagtattttgttgaggagttttgcttctaggttcatcagggatattgcatgtagttctcttttttgtctgattttggtatcagggtgatattgatttcttagaataagctagggaggaatccttcccccttgatattttgaaataactcttccttgtatgtttggtaacattttagctatgaatccatctggtcctgggattccttttgttggaagattttttttattatcgattcaattttattactcattattggtctattaagggtatctatttcttcttgattcaatcttggctggttgtaagtttttagaaatttatccatttcctttaggttttctagtttttgcaaataggggtgttcatagtagtctctgatgatcttttgtatttctgtgatatgagttgttaatgtcacctttataatttctaattgtacttgtttgaatctccttttttcttgcttaagctaggtagtggtctatcaattttgtttatcctttcaaagaaccaactttttctttcattggtcatttgtataatttttttggtctcagtctcatttagttctcctcttatctttgctatttattttcttatgcttgctttgtgtttaatttgttcctgtttttccagtttcttaaggtgtgatattaggttgttaatttgagatctttctcttttttatgtaggcagttagtgaaaccaacttttctcttagtagcccttttgttttattccagaggtttttgtttatagtttgtctattttcatttgttttgaaaaattgttctgatatctgccttaatttctttatttacccaaaagccattcaggaggaaattgtttagttttcatgcatttttgtagttttgagagctcctcttggaattgatttataattttattcaactgtagtctgagaagacatttgatatgaatttgatgtttttgagacttgttttatggccaagcatatggtaaattctggagaatgttctatgcatatatgtatattctgcctttgttgggcagaatattctgtaaatgtccattgggtccacttggtttgtagtccagtttaagtccaaagttgagtctgtttgtgtctttagcaattaggtgggtctcttgtatgcagcagatgtttgggtcttgttttttttgtttttgttgtttgttttttgtttttgttttttatccttttccactctatcttctaaatactgcatttaggccttttatgttcaaggttaatattgatatgtgagaatttttcctgtcatagtgttgttagctagttgccttgaagtttcatttgtgtaattactttttgggatctgtgatatttgtgcttacctgtccttttatgatggtgagtattatccatccatttccacttttagaactcctttgagtatttcttgtagggttgatctcatagtgataaattcccttagtgtttgcttgtctgggaaagacttaacttatacagtggtattggcaaaattaggcaaatcatctttcctatcattttaactcatttcaattctcaccactctcctcttctatttacaataacaaatagaatcctctgttctgatttattcatgtatagattttgaagagaattctgattttgatgcacgttagaatacgtgaaagagcaaaagaagcaagtgaaaaattttgcagtgacatacaagaaaatgattcagtcttaagatatctgcattttgaataataatgtacttattatggttacatttaaatttactatcttaactgccttcatttgtccactcactgttctatttccttttttttcccaatcttctcaataattatttcctagaatataattttatctctactattggatttttttgcttaatttttttatggtcgggttacagtttaaaatttgcaactttatataatcccagtgtatcttcaaatccttttatttcacttcatatataatgtaagaatcttacaacagtgtacttccataaccttttattgttttttcctattttcacattatactttatgtatattattaacacaatatatatttttttactttatcccttgtcttttaaataaatttaaaaaattttttattcatatatttataatttctgttattttgtattcctttatgtaaatggaaatttccttctagggttcttttctttccatctgaaaaacaccttgcagatctagcagcaaattctctcagctattttgtcctcattttaagaacagttctgccagatagaactttagtattatagtttttattcctatcaggtcctccaaaatggaatttaattgatttctgacttaatttttgatgagaaaactgtggtaatctttgctcctatgtacaaaatatgtattttctcctctgactactttcaaaattttctttttttcactggtattcaacaatttcattagaaaatactttggtatcgttgtctttagatttatccagtaaggttttttacagatcttgaatcagtaagtttatttgtttcatagaatatggaatttttttaagcacttatttttctctctttttgaactccaatccacgtatgtttaacatcttgatatttttaagctgtttactgaagttcctgtcagttctcaccatttatctttctctcttcttcactttggatatttgctattgctgtattttctctgatctcttttgaatagtgttaaatcagctattaatcccatccacagaattcttcacttctgataattgtctttttcacccacacaagttcaattttttcttttatatacttttcatttctctcttcgttatttttatgcttttcttttaattttaggcttgcttatattatctccacctgctctttcatttctttctaagatctttttctactaacctttctatttattacaaattttagattcttccacatgtctgttaagctttaattggataccggaccttataaatttatgttgatgtcattgttgagtttagtagtctttaaagagtttaggctttaatctgacaagcaactaaagttacttgtggattagcttgtttctttttgaggcatattttaaaagttttccaaaatggcctacttttaccctactattaaaatatgactcttctaatgtctttccttaattccttggttgttcaaaaaagtcttatcagaaccgatatatttccagtcctttgtgaattctgagaattggtgaactcacctttatagctcccacagttgttctttggctggccttctgaagtttttccatatatattcatggcttaatattcagttacactctcagggagactcctatgcagatttttggatctctttttccacagtgctcccttttctccagcactttgcccaagatattccatgtgcctcaattttcccaaacacttttctctgtctcctcgacccagaaagcctattatcactaattatccctctctctacctttcacacctttttttcactatgatctgaaaaaatcctggcagaaagcttggatgatatcataggacatacctcacatgtttcttgtctctgttttctcagtcttgtgctgcctacttttcaatttcagaacacgtttgtttcctatatatgtagacaatgtatgtagttatttactgcagtaggctcgaggtgattttagtaactctgtcatggctgaaagtagaattaagtaatgttttatttggcatatttctaaccattattaaagttaaatatttggttatatctccattcttatgacatcagactaaaacttatgaagaatcatatatttttgtctataatttttaaaaatagttgtttacgtgacatataaggtaaaagtttctggaatccacaaaattctggctgttttcactcagtgtcagaataatctaagattttactttcatttcttcccccttgatgatgcagataacttcaacctcagatttttgaattataaaagcaaaaaagattatggtttataattacagcattacatttttattctgcaatagaaattaaaaatatgtcttttctatttatttcagtgctactgaatctcccattaaaacccccacatgtgcctgtcacttgtttataagccagacctaaacatgtgtgccaattatttgtttataaacataaacataaaacataaacataaacataaaatcttgtatttgagatatatgtgttttatatgaaatagtgaagattattcaaaaaattttaaacataacttaagataatttgaaagacttactttcttctatagaattataaaagcagtataaatcttttgctttagtttgaggataaaatttttaatgaaataatttactttacatttttatgcgttactgctggtcaataattgtctagtgcagcatggaaagtgttcttcctcacaagattgaggttgacagtttagtcaataaaagatcattcttttggggcttatcttgctgacacagcaaaggctcattcttaatgcacaggggcataaatgggaactctgtgccttgatagattcagacatggacatcctctgcttttttattaagcatgtcgaactaatgggaggggattttatctcattggcatatccaagagtctctacttgaaaattaaggtaagtgattttggcaacctaaatctgatgactgctgtggagacagaaagtgattgaaggcagttctagctttgattaccctatagttttagaaaagagaatattgactgggcatagtggcgtgcacctgtaatatcaggtaattaggaagctgtggtgggaggatcacttgagcccaggagttagagaccaggcctgggcaacatagcaagattttgtctcaaaaaaaaaaaaaaaaggaatgacaatattggatatgaaacaagttattattctatcatatccttcctaattataaagtaaaaagaatattttacaatggcatagccaatggtcaatattaaaaaggagagtgtcacatatttgaccacaaaataaagaataatcagtgattttttttcttcaagcgtttacttgcttgtttaaaatcaaaacattaaaactgtattttggactgtgaaagtaaacaatattcatttcatatactgtgaaatttttatgttagtttctttatcctatgaatataaacaaaaaaagcactgaacataagcattactgtaaagaaattgtaagtaaaatgtgttttgattactacaaaaaattgagttttacagttaaatatttatatttaatttcaggctgcatgagaacacatggctggaatttagaaaaaacaattgtgccaactttgattttgtagacaaatcactagctgaattgggatggcagatgcatttgttttatgtggccaaaattgaatgccttaaggtaatacatttgctcttcaggttgacacaggtgccaccactccctctagcacacagtctccagaagtagacagtttaaatttgaatgccacacttcttgcttacatggcctacacctcactatacttatccataaggtaatgaaaatcacagtgcctaactcatagcattttttaaagattaagtaaatatccagatctagatctagacctatctgtctattgctggagacaaaatctgacatatagtaagttctcaataattgtaatagttgtagtaagagtaagagtaatatctggtctctccacaaatacgtcttacctccctggcttctgaagacatttgaatttgtgactgcaactctaaaccttaattagtcctttgcactggtccacagcaaaatgactgttggttattgacagaactcctgaccaaccttcatgttagtttacagtgcctatctctctcattgtaattccaccaccttgactgtcttcttgttcactgaacttttgactgtacatagaaggtgacaggtgttttcccagaagtgataccaaccacttcacacagcttttatctgacagtttttaggtctttctgaggagaatttatgacagaaacgccatcagacaagcaggccaacagttgcgtttggcgtaattacgcacttccttgagggaaggaaacagtcaatctcacagtttttagtcaggctgacactatccacatattttgcaaggtacattcacaaagttcaagtagttgattgactgaagctgagcaggaaaggctaaatgtcaggcttttaaggtgaaactagtggcagctctgtagcagcgtggcaggtagagtgaagtctggaattaagagtgacagacgaatggtgggtggtaaagaaaagactgtgtttgctggcagagaaggaagttgggctgtgctcagagcattcatggggtttgattagtgatagaaaggctaaaatatatacagatttaagtgttcaaaattatcttaacattccaaagaaaaactgtcagaattttactaaaataataacttttaatccctttacttttaaaatgttaatatgaattccccttttttttaaacagttttcaagatgttgagatttttgtctaaagattattgtacttattgcattttgtcactctagtctctgctttaagagctagggaaatgtgagaaaatataaattatatcttaaaggggcagagattagagtaaatacatttaaagataatgagaaaattaagaaaatttgtgaaaagttttgattcatcatatttttgtgtgaaaatgaaaaagatatcctaagccaatcaagattttgaatagtctaacaaaacatagtaaatagagcacccttaacttaataaaataaagtatctaatgtgacactggcatgggaaacttagggtattgcttttacagctggaaacctctgtggctggtggtgcctttgcctgagtttttgcttcggcccactgggcttgttccacccactcagcctggcaagtgcactcatctcatgccaccagtccagatcccatgcctgccaagggtgagccaggcacagagtggcaaggggtgcataagtgagtgagcaaaaggtctggccactgcacacagccatgcacactggctgctgcagtgggatgggcagctctgggtgctagcacaggcactgagtgcaagcctgcagctggattagatgcaccataagcggcttctgctgtgggtgtctacatctggacaaggggaatgcagtggtgcccagaagcttagagctgcaaccacagagctccaaagagggtgtcacagccctggctcagggatcacctaggtctgggctcccaaagggctgcagctcttctttccttctagttgcctgcaatgtggcaagtcaggggtgatgtttcagccctgtttgtgttacagctttttcagttgtcccacttccaggaagaatgaagtacatggacaactggtaggtgagaaaggtggagaggagctttattgcatgacagaacagctctcaggagacctgaagtgggtagctcattttcactagcaagtcatccagagtgtccagatctcagcagaaaggagacccaaagtgggtagctcctatccacaggcacgttgtcctgacaagtctccagctctcagtggagagatgaaccacagtgggtagctcctttcacaggcaagctgtcccaacaagtcaaggagacctgaagtggttagctcctttgggcagctgttagtcttaacgtctgtgtgagtctggctgggtctgggggttttatgagctcaaaagggaggaagtgcatgctgattggtccataggcggccatgggcaggcccagaaaaagcaccatacattctcactctgggccacagactccacgtagaactgatagctcggcccacaggcttcaggctgtccccagcttgaaggtggggcttcaccagggaccacccctttctgcccaggaggctgtctgcttcctcccaccatcaacatgtcatccatagtgcccaggctgttcatgtggaagggtgcctgcaggcccatgccaagcagccctcagcccccctaggcctccctcccatgattattggtgcccaaagtttggagggggccaaggcagcaggaggcagtcttgttggcaccaccccaagcatgcacacacgtggccaggttgcaacagcacccaggcttggccacaactttgctccgcccactcccgggcaccaggagtgggcagaggacaggcaatgggagcaggccctttcaagactgtgtgggcaaggggcttcctggattcccaagagtgcagggatccctggtccagagtcatggctggtcagctgcagctgtgcccaggagcgtggggctccagccctaatgacttggtagggggcagagctcctgcctgttcatggcacttgctgactctgtggagtgtgcaaccctggctgtgcctcctctgtgcaccctgcatcttagtaatggtggttccagacagggctggcatcagcagtaccatcagctttactgtgcatgtgtttttgacaccaagtcttttttgctttcttattttggaatgacaagcatctcaaagtcattattttagttacttgggttatataaatcattggataaactaatatctatcttctcactttttggaattggagaaaattgtggcaaaataaaaattattaatcagattctatactattttctttcactagttttagtattttccaagataaaataatggtcagtctagtgctgtcacatagataaacaatatgaatcacagatatgagctaccattacatttaacttttcttaggaaccaaaattaataaaaatttaagaaagaaactgatgaaattaatcttcatagtgtattttatcatgtaatcaatataaaaattcagatatccaaaatatcacttcaatggttaattaatgtaaaattattgagataattttacataatttttggaactgtcttcaaacacttgtattttatacttatggcacatctctatttgattgatagccacatgtggcttgtgttatcatataagacagcacaaattgggatagtttttatcttcattccattcatttattcattatgtgcatggaagtcaacaaatgaaatattaattaatggcaaatatatttttattgtctatgtcttaatccattttgagttgctataaaggaatacctgaggcagagtaacttataaacaaaacttatacatgaaggaggtttatttggcttacagttcagcaggctgtataagaaggagggtgctgacatatgctcagtttctgatgagcacctcaggcagctttcactcaaagtggaagataaagtggaccagcatgtgcagagaaaggaatggggtgtgggagtgccaggctattttaaacaaccagctcttatggttactaatacagcaagaagtcattcacctggtgaaggatccatcaccatgacccaaacattgtccattaggtcccgcctgcaacattaagaatcaaatttcaatgtgaaatttgaaggagacaaatattcaaactatagatattttcaaattattttcagtaatattctcctttcgggctaaacaatgtccagtaatagtaatgtatcttattatgaatattgtttaaattactaaaaacattgctgcaattactattgctgcataataagtcaccccaaattgtattagtgtaaaatcaccattttattatgctcataaattctgtggtcaggatatgaaaaggcagagcagaggtgacatgtttctgctccacaggttctacagccttgaaggtaagtcttgttggctgggaatggctcaatatctgggatctagaatcttctggaatcttgttcactcacatatctgttgcctaatctgggttaacttaaagacaaggatggccaactttaactacatgtggcctctccatgtagtttgacctcctcactgcttggcatctgagattgaactttccatgttggggctcaggactccaagtgcaagtgttgcagcaaatatgaccaaagttgcattgccttatcagactgtgcctttgaagtcacacagcatcatttcgatttccttccactggtttcagctaagtcattaagttcagttgttattcaaaggaaggtgacatagatcttccctctttacttaggggtcagaattttagaacatgttttacaatgatcacacaacttttctttctgaacactttgcttcacaccttctcatatccacggttatgaattctcctgactatatctattgtaacccaaaatattgactgtactcagagattcatcagagatttcatgtctatatgcccagagcctgatataatgccaccttattacacacataatatagaatctgaggactacgttaactgatacatgttaagtatcctgcagagagctggcacattggatgtgctcaataattgttagctttaagtatcttaaacagctattattataatgataagtctttgttcatgtttcatctccatgacttgtcatgtgttttgctctgattacattacttgaattcttgaagcctctgtttctcttttgtaatgtaggtaataatagtatattttataggatattaatagtatatcctataaaatgagataatccaaataaagcacttactgtagtgtctggtacatagtaagccaagtatcttatgaaaatttgtctagaaattttaactgagacaaatttctcaatgaattattctttttaatcaaccaagaggaggaagtagtaatttattccaaacaatagataaagaaaaattctggccagtttaattctgatgtattttattacataaggtcatttgtgttctggaaatagtctgagactaattaaaatcaagtaagtgtccagattgacaataataatcattgggtgtctattggaaacatttataattaattaaacaaaattaggattgttagctattttcttacatgtctgattcttaccttagtacagaacattaagaacaaagttgacacaaagttatattgtcattctcctatctatatatttcaatatattcaagtccttcctaagtggttaagaaattgctattcaaatgtgtttataattttatactccagtaatgactatcacagtttaaaattggttaattttacctataaccatgtggagagtatttgaatggtaatgagaactactgttataacaaacgtaactcatttttgtttaaattatacctttattttcacaacagttcaaatgcatgatctgtaatgaatcataccatattggaaacgctctatcaggctggtgtgttagctgcagtctttccccactctacaatgtaactgaaaaaaaaaggccagatattccacttaactaaatctaacccttgttgaaggatctctcattcatgatttttttcataccacccacttgatttgtatttcaaatatgcagtattttctgggacattgttattatcttcttacatatggttcacagatgatattaaaactcttcgaaagtctagatgaagcaaagctgttagaaagcatcactgagctaagttaggagagctgggatctagtatctctccattgctaacaaaataactgattttaggcatgctacagaccccttcaggatgatttgctctataattgttggtgtggtatagaatctataaggtcaattacctacaaatgtatttaatttcataaaatatgctatagatttatgtctcatcataatgaccaatgttaattttacaatgcttttataaactaaaagttagatatagtttgggatgctgtgagatactgatttaaattcctttattcttaagtaatcaataacattcttgacttatttcctgactccatctatctatacactaagatagagctgccttagtaacagagatcgatgatagtgatttggatctttgatttctttgtctcttcattttcctggttcaaaactgacacaacattttctttaacttctgataaataacagtgccttttaaataaaatacagtaatgttagtcctcttgtccttcagtgaacatatgaacttactgagatcagtatcatggatgattaggttaagaatgatttgagattggtgagttggaaggtttccaaaactaattgttgaattcctgaatatgactaataaaattaatgagtgagatctgtgcctatgtataatattatttcactttgataaaaaatggatcagataataaaatctaacatgttcaggcacaatgcagtgccatacttagtctatttgtaaacttttcagtacagccaagtgtattcaataattttcagatatcatgttcctaatacattaaacttaatttaataaataatcaaatgttagaatgtatttcagtaatttttggaatgactaagatttctagaagtccagtaaaatttaggttattttgtattaatgaaaaattaaacagcaaaattgctcagtaaactctttgtatttactgtcagaccttacagggaacttaaattattttatatttctggaagagtgaaggagacatccctgcacaattataaaatatattcttaaaaaacacatttttattatatagtatatgctaggcactgctaggaggctaaggtatcttgcattattaaatccttgcaacaacgttgagatgtaagttattataggactgtcataaaaacagaggcttaggaatagtgaaattattaacccagtttagaacctgaatatagccaatgattttatgatttagtatgaccacatatttgatgatagtggaatatttttaaatttttttattttaatttctgtgggtacatagtaggtgtatatatttatggggtacatgaaatgttttgatacaggcatgcagtgcataataatcacattatagagaatggagtatccatcccctcaagtatttattttttgtgttacaatccaattatacccttttagttatttttgaatgtacaattaagttattgaagtccatagtcaccctgttgtgctatcaaatactagtggacatattttaattggaaaaaatctggatgatataagaatagatcatatggcagaacatatacagaggaacttacggaaacaaagtaccacattcccacaccttttaccatttttaaattattgatatttaaggccaggcgtggtggctcacacctgtaatcccagcactttggcaggctgaggcaagtggatcacgtggtcaagagatagagaccaccctggccaacatggtgaaaccccatctctactaaaaatacaaaaattagccaggcatggtggcgtgcatctgtagtctcagctactcaggaggctgaggaaggagaatcacttgaacccaggaggcagaggttgcagtgagccaagattgtgccactgcactccagcctggcaacagagcaagactctgtctcaaaaaaaaaaaaaaattgatgatttaatagctataacattttatttgttcttagtcctttaaaaagttgtgaatatttaggtgtgtcttttttacgtttctttttccattaactaatattattttataataagaagacatgcagaaacaacagaaactttgctaacgcttgtgttaaagatgtgggatccctaagttgagaaaaaaagaaaatgaaaataatcacaaagagataatagaactgctaaaacataacttctttccatctcttcatatcttcttaggatcataaagaaactgctagtcagatgatttttctcttccactaaaagctttttatgagtggtttgccctagagcagccctgttctatgccatattattcaatatctagggtaatgcaacccttgtttctgcctcactagctgttcagtgattaatatattcagggtcctcacttgacgtgagacttttaggtcaaccttctcccagcatatgtgcttgagtccttgtggttgttatgggtattttttttaataatggtgataaattgcattaagtaatttagatctctcactttccttttaagtgtcaggtattgatctatatgccatgatgtcagtcattctttccctgaatgcattaaccttctttctctatgtttgtgtctgatctgcctgtctagtttggaataaaagccctctgggaaaagtctaattcagtgctgtgtatattcttaagtgattgtgtgagcccattaaatgtttattaataaatataaattgtcaacattattaatatttattactgattcatagtaatgacaatagtatacatgaattatgggaatcagataactagatctaagttttatttttgttaataaaggaagtacagttaacgtgtatatacaaatatataaccatataatatgtatacatattcaataattattgtttttcatgttcatattatagtagaaaatgcttcctcagtgactgttttacatttcatttaaatatactttactcttaaacaacataggcaaaatacaactaaatgttgtttgcattgacattgtagttaatcccaaaatgccctttttttatacattaacaaatattccaaatgtgctgagcactctgctacatgttggagacaaaaggagaaacaaaaaatggcccctctcctcaagttgcccaacatgaaacatacacacaagtaaatgggtgcttgcagtccagggtgccgaatgctgagactgggatcaggcgtggaaagttcatccaagaattccttaaaaaacgtgatgtttggccaggtgcggtggctcatgcttgtaatcccagtactttgggaggccgaggcaggcagatcatgaggtcaggagtgcaagaccaacctgaccaacatggtgaaaccccgtctctactaaaaatgcaaaaattagctgggcgtggtggcacacacctgtaatcccagctactcaggaagctgaggcaggagaatcacttgaactcaggaggcagaggttgcagtgagccaagatcatgccactgcactccagcctgggcaacagagtgagatgcgtctcaaaaaaaaaaaaaagaaagaaagaaaaatgtgattttcaagatactctcctgatttcagaaaggcactgtccttgttaaacactatcatgtactaactaaatgcaagcttcaaaagaaccttagcagatatttggtttcaattttcatgtaagaaaatgagaacttagagaaatttgtgattaatttatccaaagacatagagcagaaatttcattccaagtctgccaggcacatcaaggcttaaactctggctgtttactaatgactctctatttaaagtcttaagaatccaataaatcagaaagtgtacttggatctatgtaatagaaagtcttctgtaatttcatctattaaggatgtataataaacctacaatttgagtgactgatacttaggatccacagaagaataacaactaatattcaaatgcttagtctcacagctactacagttgagctagtacagttgagtttgaaaatcatactaagcaatgttttcccttctcaaaaaactgcatgttgctgatttctatatattcctagggttaaaggtcaatcccatatacttattaaattaaaaaaaaagtctcatgaccctaataatagtctaaacttattggagaagcatgttcttttcttctacttggaccaaccattgctaaagcaccatatgattttttgtgtgtgtgctctctacatcactgttagaaaatgactcatttggttcattttttctgggtcaaagagcaacatgggtgtctcaactgtccaagcctaaaatattgactgctactgaacgtatcattaaacacaacattcagtaacttcagccctggatttcagtggcagtactcacacttaagaagcagaaaggaacagacatagcccagttaaatacagctagaacacagggttatcaaacgaacctacattaaaagtggaccttttcttgacacattctggtggcaaaactgagatacaaacttttcagctaaatgttgctgtagtagagtttatattaatttctagaatttcttgaggttgaaagcttttttgaggcgtaatggcaagagagtaagtcctagagaattattcagttcttgaggaattgataattgactttaacttacagttcattatccctttacaatgatcatattgagtttcacattgctttatcttatgtattaaatgttatttcaaaatatgttttccaaattgtgttccagtgatatttgttctataagatagcagtttatgtagaaaaatggaacaatgtcaaagaattctggggaaatctaagttaaacaaaaagtatgttgttttaataatattttatagagcttttcattccccagataagagttattctacagcagcatttctaaactaatttgatcagaaaacctcttttgattgaaagccaaaattaaggattttttggacaaagtactacaatatgcatagcatactgtagttactaaaattttaaattaaatatttatatgaattaaaaacatgtaaaatacaaagagctgttgaatgagactttccatgtgtctcagtttattgctgaaactccaaaactgagagcatcagattatgagtagcccacattctactaaggatggctggacacattcacaataactgagtacatgatgacatgaaaatgggtatgctcagcaatttttagccttcctcgagcacctataatagaaggccaaaaattccaaaggatggtagcagagtgctgtggaagtagagttgtcagcctcctaaagagtatgatggcatttcatattttctacccacacaccccacacataggaggtaacctctgctccctcccctaacccaagagaaacattgacagaactttggggtttgcttgaaggtccagggtggcatcactctcctcagctggtgaagtgctgggctgtagaaatgtgtaggaccagtatgtgcatttcaggggagttaagcaagataatttttgagacagccttacctaggttgttaaattaaggaatgtacatggacatctgattcccctgtcacctttttgccaagctgtgagctgttatggtaaaacacctttctttatgccatgataaggaaagaaatctgtgtttctgcattttcagattatgtgttggctcactcagagggcctacctaataaggcagaaagaagccataaggtatgccactggaaatagttgccagggtgggaggtgtgttcgggtatatataatgcacttaggaaactgcagtactatttatgtgaggtgtgtaacagagcaatgttctctgaagacatcacaaatgtgactcacaaaaaagccagcgtttccagatatgccatggtggagggtgtaatgctcagccagtattaatgccaagtgagaattatagcagaattagtacataagacttttgatgtctacctgaaattcctcttccactgcattgaccctggaaaaaccaaaagaaataaagaggtggaaggagagctaaagactgagccaaattccctcccactgggagtaccagaaccacagccagacctcaaatggagggaaaggaacagcagttaactgaatgtaaatgcgaatattaaatgtccccaagactggagttattcataaagaagagaggtgttttttgttttgttttttattctttcccctgtctcccaacataggacttgttttttttttgacatggagtttcgctcttgttgcccaggtggagtgcaatggcatgatctggcctcactgcaacctccgcctcctgggttctagcgattctcctgcctcagcctcccgagtagttgggattacaggcatgcgccaccacgcccagctaatttttgtatttttagtagagatggggtttcaccatgctggtcaggctggtctcaaactcccaaccttagatgatccgcccgcctcggcctcccaaagcgccgggattacaggtgtgagccaccacgcccggacttgttttaaacatcaatagtgattatgaaactacagaatctcaatgcgatgtcttccaaggatctgaaagggattcctgaaagaaaatcttaaacatatggataggagaaaaatgtagcttttttcttactgtatcctgttagattcagcctgtccagtaagccagttacagagatcatgtttaatttccaggtaattaactttatgttgaattaccagattactgtattaatagattaaaacaatacaaatttactaacttactgtgagattaattacatgaaaaccattgcagtagcatatatttcatatgtataatttatatgaaatagcttatgaaatattaatgaacataattcactgtgaaaaatatattttagaacttcaggttatgtatcaggaaaatacttttaaatagctaatattatactttattatcttaattcatagctaaagtccaattattatattaattattttcagctgatcatatctggtaacatcagaaccagagggcaaatgccaacctaaattaactctctgtgtcacattttaagagaagagcaataagaacgctaaaaggggaaaagaaacatatgaatgtgaaataaactcagccactctgttgtttaaaattattaaaaagtcatatataatatttctatatcatgtagcttgtggcaaagacatcagtcatcacattatctgtacattgaacatgataaattgattgtgttctaatgagaggatctaattactcagagaaatgaagagggcatatgaaagctttttagctccaatagccatatattatcattgataacactgaatctggtgtggtttaattcctttgttctgtacattttggaagatataatcttcctaattcatttctttaaagagacatcagatcatcaatttatcatactcctaaaaatagcaaaaggaaatatcacaggaatatgaaatctgtgcaatggtcatcagaggttttgtacttgggttccaccccgcccatgccaggctttgctaaacttccacaggtagcaaactaaagcttccacataattattgtttcaaaatataattgtaaaacttattcagtaatttctacaggatatctcatgatcataaaattatgttggaacccttctatagtcacaaagtagaatcaagattcagaattatctcaacagtgtgtcactcaaggtcaaaataaacaagatgaaatataatagcagaactgaaaacttgtgtatttgagtttcaatgatcatttgttcaaacgtagcataaggagatataaggtgtgaaatgagtgactgaatgagctcattctcagttgagaaggaaaatattgcacatttgaaggacgctcatgtggaaggaggattagatctacaggcaggtgaacctatggaatttaccactacacagtttttaattcaagaaatagcatgttaacaaccagagctatcaaataatggaattgactgctttgtaatggggtgagttttcttcctggtgtccttggatactgccaagcaataactgtataactatgtcgggaaagttgattatataaaaagcatttctgcagtcaaacctggaagtaatgattatatgacttctaagctgtctcctctgactttaagacttccagcttgtattttttttcacttatgtaacctttcaactctctcactggtatttatatttcgtcttattaattataggcataattgcacatgtctttagttcctttatagatgtttttctatataacaaattttataagataagtaactgcattgtttttatattcttctcttctgtgggaagtctagaagccttggacttagaacatgccgaaagcatttgagtgtatggtgaaattaatacaggatagtattttttaaaatagcatataagagaaatatttattatagtattaaaataacattttcctgagttatctttcaaaaactgtgaagagtctgagtttttacccaactggcatgttaacaaggtaacgtaagtcagttttatggatgctgattgaatacctgagacatcagggtcagaaggtaccacagtttcgtggatgttaacagaagactcaagactcctgagataaagaaaaatgactttattatttataatacagcaaaaagcatagacatcagcatgtttgggtcgcttcgccttgccaccagatctcaggggtaagatgcagatgggcccagatagtgcttacacactcagtaggttgcattacagaagataaacctaagtttgcataaggaacccaatttttaaataacagatagtaagcacactttccctcttctccaagggagaaaatatctattatcctgggctgtttgttataccaatatccttggaaagatggtccaaaacaaaattaggtcattgcctttctcacaagacatgcagaaacatgagagagccatggctaatcgtctcccaatatcactcataaaatacttctacatcgtgaactgaagagggcaggacttgagccagacctggtgtaggactgtgtgatgatgatggggaaaaagaaagaacacggaaaagcaaatgaaattcacagatccagtgtgtcgaagtgactttgaaactataatttacctttagttaaataatctgtatctagaattggcagtggctatatattgatatctatgatatttgtggcttttatttcttgataggacgcctgattccatcttcaccatagctcttttctttttgttgttcaatgtgaattttgtactatagctcttttatattttattgtttctatgtgccccacacatgagcagctaaccagtgcattttggtttattttttggccaggcgattctaaccaggatgggtgacttaacagaaaaagaaaagcaaggacaatctacataacccataaaacccaatttccaaaaggccaggtcctctatttaacattctcataacttgctctgtttccataccgcagggaatagcaattctgtttaaaaaccataaggaaatggtagcagatattatcagaaatatataccaggacaggacccttttttactttaaaagttttaaagataataagtttcctttcaaaaataaccgtgctcactctcttcaggaataaccaaagctttcattttctttgctttctttcttttttatttttgctgtcttttgaaaggcaagacttgtagattgatacagatctgtctatataagatatccaaaatatatagtttaaatttccttaaactctgtggaagtttctgccataattactaattttaatctcaccaaatctgttgttatcattaacaccaaacactatttataaagcacttaattgaatgtgggcctgtgaatactattgagcaaagctaattaatgcataccaaaattaagtaggctattataatgggacatatcccacaatagtacatggaacagaggaaatatccaccaatttatggttaaaccaagaagactgggtttataagcacaaagcataaaaatgaaaagtttcagaaaatgtttcagtaactatgaaaataaatgaatatcatattttctttattaaatttattagttctgccttcattactctcaaatttgcacacaaggataaggatattgcccactaatagataaagttatctcatctaatatacacatatttagcttgaaggttgtttgagaatcaaatcactaagacaggcttctttgggtgaatatactgactgcactggtgaactccaaaagtatattagagcaccagcattagactctgtattacattacaacatatgactgcttttttcacattacctacttatagtgcatttctaagtacattagtttggatcttatctttttaatctttgtatatggtgtaaggtaggggtccaaattcattctttctgcttgtatagtcccttcttcaccaacaatctactttaagctctcccctgtatgtctggtcttccctatattgtgagttctattcactcataatttgtgatttcttatagtttctgcagttcaggctttcaggtcttccatattgtctgtgttcttcttaagccttcttagcttctgttctgtcaactgataaactttcctcatgcgtcgccaatcttcaatttagagtcctgaataaaaaatctggctgacactaaacactgtgatctctatttgggaagaattttcaaaaagatctctagtggcttatcaattggcttttgtccagtaggacacaggctttttgcatttaacctctaacagggtatcatatgaaatagaatgggatacttataacatgtagccatgtgccttctcacagagtagaagactttatgaaggtaagccttagctgtgtcaggcatttgtggttttaagagtccagtgtaaatctctgtacataggccatttataatttcacagattgtgtcttttatctccaagttgattcatttaaagcagaggtctgaatagtttattcattcttcaccttagacctaaaggaactctgcatatattcctttggtacgagataaaacttctcctttgcaaagtgaacaattacctccataactgcctaaactcaggtctagtctctcttttgtccagatttaacacaccattatatgcactgcccttcctcagaacctttccacccacttgtttatgatcatcttccttgtagctttgcctcatggacaactatttcttcactgcctcactcatagtagcatttgtgtccactttaatgcttcttgtagctttttccacatcagcttccaccatgttttctgtcctactgatctcaacattttctatttagcctcctttacctgcatttctctacctaaatcctcattcagttcatatttctggcttctgatttcccatcccactttaagtattatctgtccatcaaccccaatgcctaaaaagcattaacatctctgaaatatgtattttcacttaatagtgtagttcacttttaggaaataaaagtcacagtgcagtctacaataaattagacaaaataggatattataagcaatataatcatgttgcctagcatataaggatgtattaaaaacaacataatttattaaattattgttcataagacagaaatgttctttcttttttgatccaaagtgagaactttttaagggcttattttataaacaagattgtactgaaattcatatatagataaaaatgaacatgatttattatgaacaatttcagtattcagcatatttatattgttattaataagattgggagcagagagctaaagcattttactttgccttaaaaaatgcaccaattatcagcctgaccattttaatataaaaaatgtttatattatagtataaattattaatcaatctgccacaatcattactttagttaaaactgaacgtacttgtggctagcataggaaaggagacattttcatgttaacgtgaatttttttaacctaaattattgcagcctattgatcctagatctgaatcttcaaagaaaactgatttatttcattaattggaatattttaaccagagaagtctatcaagttggggtttcaacctgaatgaaccttttccatttagaaaattgatcttccagtcacacttttatgaaccttgagcttttagagcatggttgcttttaaagacagatcatctccagtaacatcttatatcattgacaggttggagtatggatgttagagcaaactaagtttgtgatatataaccacccacatacagacaaaatgaacaaggcatatatttaaatatgcaagctagacaacatgcagagcagtgagtaaggagtaaatactgagtcacccttagaacataatatatgctggtaactaaaaaggtgggcacggggcaggaactccataaaaataataattctgccatgatgtcttttatttaccaaattacatctccaaatacattgctgtaccatctatataaagaattgaaagtgtctttgaacacaattacttgtgttgcctattgactcattaagagaagagcattgttggaatgtgatttacttagattaacagtggtccctacagttaattgggcacagagtgaatatctcaaagtgaacagctcacaaagtactggaatatttatcagagaactaaatgactgatgtacaatgagtctacttgttagagtatctacagtgtaggtttggagtcccaaaaaacaagatttgaattctggcagcagcacttaaagccatgtgcccttgggtaactttaaaccacctttagtttttaaaagtgtgaataacgggcacttttaagaatcttaatgttaaacaaaatgtttgaaactgttctttcaaaaaaggaggccctctacaaataggtcacaataaaatatgaaacataactgacaagggtcatagaaaatccattttctagcaacattattttttcctctctagaaaatcacagagagtgaagttaaaaccataagttttttttttttttttttttggcatccaagaaatcagagcaaatgggatttgtagtatgagcctgatcattaaggcatgcatctccataatggaagaaaaccacacgctcatgggaacagcaggcaggatcctgagcaagagtaagcccttccagagggcaaggtgagagaaacttgcattccttctcaaaccactcattctttcctttctgagcaccaaatttcaggtgacacacacacattctttaggcatgatatgagatttgctcagctaagaatttcttagatattctatgagtttactatcaaatggacaagaaatcaactacataaattgtgacacctaagtcacaattctgtttacttgagctcagtgtaaattttgagaagatgtcagggtttttggttctacataaatatattgacactcaatcaagtcattattggtgtgtccccttgcccatttatccaaattgctgctgttggcagttttgctttgtattcccatcactatctatacttcagttggtccatattttagctcttcaattgtgtgagttttttctcagcaactgccatatttgaaaaccatatccctcttctgtgtcgcaaagacttattatgcatgcttctctgacacctggttttaaattctcaggaaatactggacaggaaccatcagtttttcagggttaagagaaaccatcttgtccagcaaataatcccttctttttcttttgttaagctaagcctcttgccaagaaattctaatttaagaagtctaatttgctggtcttagctgtttgattgcttctggttcccctgtgatgagtctgtggaaacaagggccacagtgaagtcaacccaacccaaactgcagaagtgagttacttttctcagtgtctgtggtttgtcttcaagcgcctgttagacacctatggaaaatttttcctgatctcaactctcctggataattctgaatcagctaattaggtgactagagaggtagcaaattcctgggtttacaagcatttttttcttccattgattttctttgatttgctcttgctctaacttctttccttctatcctgggacttgatttgtatatagcaaatatgacaaatcttactgatatcaatagagcagaaagggggaggctggtagagtctctctgttacttaaagaagcaggatgagggtttaggtgacaaaaaaaatgatagttgatagaaaacaagaggctacagattcaacagaatatatgctttaataggaaaacgaaccttttaaaagctagcttttctgaggaaggaaaatctaaaataatgcaagtcatctgactaagacagtgaagtttcttcacttctcacaaaagcaagaagaacaggcagaagtttttctaaagtaatgaaacatagtccagtggaataagtcctttatcaccgtggcgcttagtttcctcaaaattctctgaatctatcattttatgatttaaggtcctaaaccagactttcttccccaattctctatgatattttatggcaccaccatctacctagtcattcgctccagaaaacttacatagattttgtgattcctcccttgtgctcacctcttaattatcaaattctgttttattgtccaaacattcttgatttttctccctcctttcaagctttactcccaatatccttgttcagcctcacatgagtcctatactgactgactgaaatagcactgtaataggtttctgtgactccagtcttgtctccttcaaatccatgctccatggatttcaccctaatgatgtatctaaagtagggatcagcaaactatagcttacaggacatatctgggcttctgttcacttttgtatggtccataaacccccaaaaatgttttcttcatttttaatgatttcaaaaatcaaagaggaataatattttgtgacacatcaaaatgacaagaaatttaaatttcagtgtccataaataaaggtttattggaacacagccacactcgtttctttatgtcctgtccatgggtgttttgtgctataacagcagaattcaatagttgcaacagagatcatagaatccatgaagtttaaaatatttaatatctggctctttacagagaaagtttgttgatccctgctcttaagcacaaagactattgcatcatttctcgaatcaaaatattttactgatattctgtcacctgcaggagaaacctagcctcctgagcatgacatacaaacctctgctatctgagccctattctctccagcctcacccttgtttatactgttgccttgcactagattgttctgctctgccttggttcctatgcttgtcttcatggaatgccttactcctccctctttatcatgtaactttcgcattacttatttatttttaggggcagggtcttgctctctcacccaacctgggttacagtggtgcagtcataactctcactgcagccttgaactcctgagctgaagcaatcctcctgccttagcctcccgctacagatgtgcacaatcatgcccagcttgtactacaggtgtgcaccaccatgcccagctctgtttctcatttctgtagaaggagtattgagatcatctcctccagggaaactctgtagacctccatgcagaatagtaagtcctccctgacttctcttgtcctacataccacattattttatgaatatcgatttgtgcttgtgtctaaactgcaagctctggattttgagcccatcaatacttggaaaaggatctcattttttttaatcctcagcaaatatcattgtctcacacttaatagtggctcaatcagtgtttgttgaataaattaaaatgtcttatatatatctcaactaacaatagtcttttaggtttaaggaggactttacataatactataaacagtatcatctgataacaaaaatgtagcattaaaattatttgtaaacatttctaatcttttctactatgaataatgctacaataaatataggagtgcaggtatctctttaacattttgattttcttttctttggaaaaatatccagctggatcatatggtatttctgtttctagtttttggagaaacctccatgctgttttcaatagtggttctctctccacgttctagctagcatttgttactttttgtctttttgatcatagccattctaattgtgatgagatgacatttcattgtggttttgatttgtgttttgctgatgattagtgatgcggaacattcaattttggtatgtcattacaaaatatctgattttcagtttagggacactgtaaaacatataaccttaagattatttagatgtaaaaataaattgctctcatagggctgaataacacatttcataaatatttaaacaactctgcttgccattctctttattatcatgtatcactgaccactaaaaatttcatatatgtgctatgattatagaataaattaaaacctcatacatgtgaaatattttatatatttaatattagctagaagaaaatatttagcatagttaaatttagcattaatatgtcatagcatcactttgtacttcttaagtatatatatacaattgtaatttgtcaatatgcaataaaataaaaattcaagataatactttgtatttattttgtaagtcaaaaaacaatataagaaaataggcttcttcctcccatagaagttagtagaataactgtagcaaacatatcactaattaaacattagtgaaatgtcatttttaaagaatctaaggcaatatatatctattgagcttcctaccatggttaaaacctactgttaattattgagatattcaaaggatttactccctttgatcttgctaatgagaaaaaaatatttaattctttaagtgttttatcattcattcttttcaccctctccctcaacaacaacaacaacaatttggattgattcaattgcatttgtaaatgtatgtgtatgtgtttcttaaacaaaggaaattttattttagctatacactttttagatctctttttcttcaaactagttgttccaaaaagaatattttgcttttgttatttgcggagggatgtgagaaacttgttcaggggttagcaggaggtgttttttttttttttttcttctgccattatctgtaaaagtatgaactctcatgacctagcctaatctgatgatgggtcactttctgttttgaatctaatttttatgttgccaatctttgccagactgatcggtaatatcctaagcacatacacttatagattttcacagtgctgtctgtcaatctttgacttatttcatcccaaaacttttaacttgggaatttgctgttattatttttgctttaatattggttttactattttgctttttcccttctaatacagaatagtgtaatgtttaattacattccatcccctaatactcatcctcagttcatcaaatatcgtccttttctttttttaatcatgtgaaattagaacacctctccaagggctaaggtgaagcatttggttctttatatataaatacagacaaatcactgattgtgagctattttctgacatttttggtttatgctagactgtctcttggctggacttatttagtttatcttgtgaccatccactttctgttatttgcctgctgagcacacatttttgcttttgcagcctgtgtagaaaggtctgcactttaaaaagttaataggtaaaaggaggttggtatttgaggcaaaatgttttcctaggaggatccccatagctgacatttgctttccttctagatctcacagactgaatttgcaggcctttgggactctgtgcacagcccatctgttagagcaaagctatgccaagctgatctggatatgactgagaggaatgaggaggggatttttaaaaattacttttatagtcattttctttttctttaaatacaaagccacattgttaggatgaacttgattctgccatccaaggcaaactgacagtgtggtattagaaataaacatcaaacagaacctgttgaaatgtcgggttatattggaaaggtgtcaggtttcatgtcatatgtgtttctgttcaatgatttccatcatgatgctattggttatcaacaataactgaattaagttaaacaatatgttcaggaaacatttagtaagtgcctataatgtataaactatgtggaaaatcttagatatgcaaagatatctgagatgtggttccttctttcaagaagtttgcaaacaggggatagcagagcacagatgtatccagagaataaaataaatgtcatttaatatgcacaaatagcatagttttaatattgatgccacttatatcttagtactatggataagcaattcactaaagtgtgttatgtatgacctacatttaatcttataacaagttatgtccattttagaagggaggagatgagatgcagacaagttatggccccagatatgagaggtcatcaggaggataatgctttgtctcaaaacctgtgtttcccaaaaagctacaatgcctagggaaagcaaagacagagaaagagaaaatcaaaaatgtacttaacagtggggcagatgctggcctctatgagaaattacctagaaactaaacatccactttctcggccttcctgggacagtggccttggaagagtttctgccgggaagcctactaatgggatttaaattaggtcagatgaagctggttttgctctgcttcacctaattccatcttcctgcctttgaacacagatgcagtggccatagctgctgccaccatcttgcaacatgagaaaaaaaaaaaagagaattccatgcatagaccttggctcagttgagttgtgaacatagcatagccagcagctgtcttcctcccatgtttattgttaggagaaaaaaaaactaaagccctgatggtttaagccattggaaaatcagattttttgttatttgaagcttaatggaaacttaagtaacaaaatctatctttaacctaaactattgaggctatgatgctattgtattcttcctctttttcaatattttagcttccttgatttgtataactccacttacttttgattttggaataactgtctggttagtcacactttattttctctgtagactgttctttcacttcctacatcttaacgctatttcccaaagttcccttcttgtctcgtaattttctcactgccttcagcatttgtactgcatactctctcttcgtgacctcatccttctccttgttgttaaagaggcatgtagtgttgccataaaaatgccttaaccatgacatcatatgcagtgacttcccaagctgtatttctagatctttccctcgagctccagactgaaacatatccaataattgcatcaaattcaaaatatccaataactgtttttcatctttccctacaaatcttgttttctaatctattcacttgcccaggtcagaaatctataagtcattttggacttctctagattgtctttttatttctagtcagacaccacattctgttcaattgtaataacccttgactctatttattccatctttatagccactaacttagcctaagcttttgcagtatttctcatctgaattactgcagtcagacccttaatggatctccctccctcagttctctcattccagtcaattcccctacattcttatgagagtgattttccttaatagaaacgtattggaggcatttgtccactgagatccttcaggatttttccagagttttaaagatttagtgcaaacgtttagcatggcatttcctgaccttggtttagttatctaatctcttctgtatctatcctatcacttgcattcatttccatttatccagttaataaatagctattgagtaaatgatatgtatggaaaccaggctaactaactgctggggctacagactttgtcctggccctcgttgaacttactgtcaagtaggagagacagataataaagtcagcaaaataagttcagcctgtgattagtaaaataaagaaaatagatttctgtctttgagaataatggtaggggagagtgatttatattacatcatctgtgaaggtctctctgaaaaggtaatatttaagctgaggcttgagagatgaggatttagcaatgtgaagtgttgaggattgaaatgtcctagacataaagaacagaaaaataaagaatataaatttagatatattaccactgaactgtacacctaaaaatgataaagatggtaaattttatatgtatattgtacctccaaaaaaagaacagcaattataaatgtcatgaagaggtaaagaatctggaagtttctagaagtgatcaggccagtggggtaggagaataaggaatgagaaaggtggtgttaaaatgaactatttgaaattcttaattcccccaaaacatgacacactgactattgcttcttgcttatatgagcttgctattattattgttgttattattgttactttattataattaatattacctaaaaagcttcctccttttgtctttgtcaggttaaatgttactcttcttttaaattcctttgggatttaaatggatgaatgaatgaacaattggcattgtattattattattactataaataattgagaaaatattaaaagagtcagaaaaggagagtgggaaaaaggcctctgaggtaggtgtgagatttcacttggcttcacagtcacaccgtgaggcttacctcctgcccactgtagacaagaggcaggagaagtgaagtaacacattcacattggcacatgagtaagtgaaagagctaggtaatgactccctgcctggctggctgcaaagcaagtgcaaactttaatttaaaaaacagacctaaataataagtaacatttaatctgacatacatggacatttgcactatgggctgcagatatgttggtgttgttatggtttgattaattgtctgggtggcttactgtcacttcatgaaggtgtctgctaaaatgtcacttcctgaaaaatgtttttcctgaacctgtcttaaggaaacttcaccaccactgctctggacccttttatcaggttttttttgtttgtttgtttgtttgtttttaatatctgacaatttctattcactttcctactatttataagagcagagcctggagctcaaaaactttatggaaccaatgacttgaatacttgaataagaaagctaatcatagcttcttccaccctcacagttttatcttaccaattaaaaatgaatggatatttttctccttttataaaattgagtgcgcttctgacagcacagctttagattaatctatttgaatctcttacaataaataatcagcttccatgccctatctgcccaaatattgtattttaggttgcttgtaagccgtgaaattcaggaaagtatactaagtaacatgtggcttattgttagtctatacaagaaagacctcgattttggctgccttttgtttatctcaaccacttttatcttaagcctttgctatctacacaaagggcacatgtcaacacatgcaataaggtagatccagaagttccctccgtgcaactgtgaggctgatgtgaaatgtactgacaactgtccctaaccctggtgccaaaaacatagtcccatctcgctgctgctgccggcagggtgggctgtactttgctgcaagtattcctacatacttctaatttgaatttttgcaaagcatttaaagtatttctgtaaacatatcagaaatacaggaaagcttgccacaccctgtttaagaggttattgtctctgatactgtagtacattttaatagggttgttttccatctattcttattccctcccttaacctcatatcaatttgagatccatcgatgtgtcacattcgggatttgttaccaagagaaacttaactgtcaggtttcctgttcttttttagaagacgaagaatgctctgtagcttttacttattatatgtgatagatgaaggaaaacagttgagtgcaacaaatgtataaaagcagaatggtaaatctttgaaaagctctttggtgccaccatgtggataagatttggtagttttgaaactatgctgggacattctgttcttcaaacaattctacttgcatacacaatttttgttccactaccttcctaaaatctagttctcccattacccttgaaaagatgaatttttattataaagtaaatcaagggaagtctcagaaattgatctgaataacatttaacttttcagccagagctcacttgctctttttttctccctttgaatgtgaaatagggggtaagacctcatttataagcttcatttgaggattttcaataaaagaacattatatctgaactaaatcaataacttttacttgggttttcatcctcatacacagcctcaggcctgagtacctctgcattctaatcaaagaacatcgtctttttatttacaaacattaatatggcttactagaaactattctaagcaatccacaaaaaccaacatttgctctttttgacaaccctttgtggtaggtactgtcatcatcataagcattaccaccaccaccagcagcagattctgtgctcttaacctctgtgctccattcacctggtgctcatttcaatcagccgatgatttgaggagcctctcacttaacactcatgttctcaatctataggctcaaccctgttcagttttctaggtgatcctgactcaggcagataggttctatgcccacagccatggcatcattgtgtacattgggtctattattagtccatttgctccaaacctagattctgtagtgccatgggcatgccctgtaaatccccaaatgtactggcaatctttttctccctccctattgtgttggcccaaccggtatgaactcctgcctcagtaacctagcacaccatttacatactgggggagaacacaaccccggattctgacctcctctgaaaggctgaactatgatgctcgtggctaagtagcataaatatttccattgaaatgcccctgcttccaggttaaacctaggagagccaggtttaagtatagccagagttatttgtgagattcattaatctgcacacattccctgtacaaacagccacacacttgggtccattctgcgagcccctgggccccatcctaactcctcctcagtgcatgttattaagatcacaggaggttttcaacccaaatcagtccagctcttttccattgctctgctatataataactgtacttcttttggtattcccctattcctatggtgctcttgcactctcatacacacatcaagtatctcccctcagtttctttaaaaaggtgccaatctgttccacatttgacaaagctttctctgataattggtctgcagcagagagtttactaatttcttcaatcataggaaattgaatgaatcgttttcagcaaaaatcccccagttatttgagcaggaacatgctttggtcactactgaccttgagcttgtaaataatccttaatgttagtctttggtttcatgtgtgtctgcagaattgggagacactgtcggtacttttttacattgttttaatttaaaaaacacaaggacattgctttagagcctggaaccattctgtgaaaacagaagacaacttaatatggagtctttaataatttagttgaatatatttaatttaattttctcctgaagacatcaatatattttaagtttttctctaaagaagtggagggtctttccattgcatgcacgtaattcaaatatggctggtgtgtgcttctaagtgtctatccaacctgatgttgaatggctgggaattcatacatggacctttgttttttacaattagtaggtgtagtcttgtgataaatgaatgttttttgaaaactgagtattaaaaaggcattaaagggcaatataccatacatatatttgtttaaggtctttatataagggaaaagctcagtgtagtgtagaggaaagatttggagtcatagaattgagttccaattctgctctcaactgtattaacaacttaataatatttttatttcagtgaaaactttttatgtaaatggagaaaataatgctgtccttctagaagtggggtgtgtgtgtgtgtgtttgtttaaagatgataaatctaaagtgccacattcgggactcatacattttaattgttttataatgattatttgtgttatttttaactcaataaaacccaaacaatatctatcttttcttttcctgtgtcttttccagattttcttcttccttctcttttccccccccttttcttcctgcttctttctcccaaaaagcagtaaagtatggagaagaagcaatacatatcacattcttacagaccaactgcttcatttcattttgaccctctctggccaaagtgcatttataatttacagtaatgcaataataaatttaggataatttacaaaggcaattttggttagagtaattaaatatgaactcagagtaattataaattcaaaatgatttttaaactgtgagttagagaaaaatcagcaaaatatttagcaaaatcgtaattcaaaatgaaggaacctttgcatattttcatttaaaatttaaaatcagtttagatatctgacagttttctccaatgtgtcccaacattgcccataggtagaccacagaatccccaatcagtgtcttgctccactcttaaccattaggaaactgcagaaagcagagtaattcggtccacttgggcatctggatcgcctgccctggacactgagcattagagagctctgctctgctctcttcccagcaatattttcctctatctgtatgtccactaccaatgaggaacctattgtgtatatacttagatcctccgcccttcttgtcaacctgtgtttctcaaaccctctggggtcaaggttcatttttctctttactgttttgaggatcaatatgttgataaaaatacaataaaaataaatttctaaaaagacaaaatgtaatttaaaagaaatataagcatctaggtttttttttttttattagcttcaacagacatgtaagtactcaatcgagttgctgtgaagtttctgagtactcagtcaattgctgtgaagtttctaagctcttattctcaattttgtatatatcttgttgcggtctagaaacagtttccagacaagctgtttatggacatgctttgagtagcagtgttctaaatcacactcccaatattcaggccccccgaatttcctgcacaaaggtcccaagccagccacaattgcctagagcatctcctccaggatcattctcccaagagtggtgaaggaatcccttggccctcgggataacctagggtaaactgttggtggatgttgtgggcttgtggacagaacttggacgtatgggccaatctgtccctgcagggagacatgggcacctcatgcaggactgggatgggaatgggaagaaaggggcccaggatcctagcaattcctcctcttaccctcttgctccattcccaggaaacatttgagtggagatgcgattgctgttttgtcagctttttctatatttctgaaggccctgttgttccttgagcctggactccctggatctgctagactaatcctgagctttgctcctgcctcccactttgcccttccccagggctgcgggttttcatgttcagtgcatttgctccatattactcctgtttccttttctgaaaatgaatcttttaaactattaggataaagtgtgcctatcctaaattcatggatttctaagatttttataggaatgacacagagtttctgaattctagccactgtaacatctcattgccatgccacctctgaaatgtctgtgttgatgaccctgatttaggacccagatctgccacgaatccttggttcagtttagctcagcagaaatgtgttgcatatctgcagttgagcaggcaccacgttgcgttctgggattacgatgctgcataagaccaaacccatccactcaaagagtgtaacatctaataggctttttttttcttttttgtaaatgtggaatctgaaatccagagagttgaagcaatttgcccccaatcccacagctagtgcaaagaagaagttgcttcaaaccagattttttggctcagtgtccagggacctttccagtatatcattcttcctcatatgtctcagaacaaagctagtagacatttctgaaaaacgttcacctttgctgcattgctgctccatacatcaaagagatttacacaatcttgaggttctataagatctattgaatccctcccaatgtgtaggaggcacagagaattggaaacagttaaggggtctgagtttaattctgaggaacttaaatttatagtttttctttgatcaacttaacctgttgccttcagtttccttgtctgtgaagtaggaatcatctatgtcatagagttggtatgaaaattaattatatacgtgaaagtattggtaccattggtgctacctcatattaggaactcagtgcatgagaattccttcccctttcttgtctgttttgtgaaactcaaatcctttagtcactagatgtaaatgtacacattaaaagtattcattagaaggtgcaaattcactatagccactgcctagttaaaattcactataaccagtgcctagttcaaaacttgattttttaaaacgattttttgaaacaatttcagtttaacagaaaaattgagcagacactgcagagttcctatataatcctgaatgctctgcatacagtttcttctattattagcatcttatattagcacaatgtatttccggtaattattgaaccaatgttgatgtgttagtctgttctcatgttgctaataaaaacatacctgagagttggtaatctataaaggaaagaggtttaatggactcacagttccacgtggctggggaagcctcacaatcattgtggaagacaaaggaaaagcaaagggatgcctcacgtagtggcaggcaagagagagcgtatgcaggggaactcctctttataaaaccatcagatctcatgagacttattcactatcatgagaacaacatacgaaagacccgcccccataattcagttacctcccactggatccctctcatgtcagtcacatgggaattatgggagctacaattcaagatgagatttgggtagggacacagccaaaccatattagttgataaaccattaactaaaatccaaagtttattaagatttttttcttttagtttttaccgaatgtcttttttatgttccgggatcccatttagactaccatgttatacttagctgtcatgtcttcttaggttctgcttgactgcttgactcccagactttctttgtttttgatgatagttttgaggaatactggtcaggtgttttgtaagattcttttctgttgtattttgtctgatatttttctcatgattagactgcagatagagttttttggaaggaacatcacggaggtaaggcaatttttagcacatcacaacaaaggatacatatatcctttatgtataactgttgatttataactgttggtgctgatctggatcaaccagctgaagtagtgtttgtcagatttttccactgtaatgttattcttcgctgctcttctttgtgtattgtgctctttgaaaggaaatcattatatacagcccacattcaaaaagagtgagtagttatgttctctcctttagagaggagtatctacataatttatctggaatcctcctcccgcatttataagtttattaaaccacttgtttatatcagtatggaatgatgggtatttgttttatttgggggttattagccatgatatattttacttattttgttactcaaatacttccagctttggccactcagagctccttcagtgggttcctgtgcacttcgacgtctctccgtcaatgtacatgtgtgtatgtgtgtatattttgtttgtttagcattttcttactttgtggcagtacaagatgctccaggttcagtttggatatttcctactccagtatacaatcagctatttctgcaagcatccctagttgtttctaaaggagaatggcatttgaaactaagatctggacactaggcatgcttgtttctactgcagtaccatttcctttaggcatttggattttaatgtccacattcatggtgttattattatcacagtttatcctactttacagaaaactaaaagtggtataataagatgccactgagtgcattttggaaattttttattcacataactttttccagttttttgtgatttgattgatgaaagtgtcattaacttcctaaaaattatgatgtacatcaaagaggtgaagtgattatctttacagcaaataaatgtttatatacacatttttcccatttacctaaccattttcttcctagcattataaccatcccattttctctaggactgaggcagttcacagttttaaaaccaagaaagtcctgggcaagaattaatcagccactctattcacagctctgataaccattataattaggtattaaatagagacacttagagatatgcgggtgtgtgttcatacatgtatatgaatgaacacatacacacacacaaaagttgacattatgtctgaatattttcatcatagtatccctaacttattgactggttcactctattaatatttgtaagttaaatgagtgacaaggttaattgaatgaattcatagcctgtttgattaacgcaataaatatatggtcgtacatcatataagtatttacacattacatgtctgtttttagaatacttttcacctactttctcattatcattgtatctccactttccctaaactgtagtaatgttgtaatatttgggatagtttaaaagctttgtttttatagccatgtctatagtgggttcactcccccaattacacaaagcactctcatactagtaaacaaagtgttggaatttgcatttgtggatgtgaacatttttttctgtttttggttatttgtctccatttttttaaataaatttactgttccggtttttttgttaatttttgtatttgtatttgtcttactagtcacagctcttttcatagtaatggtattagcctattttctaacatatactaacctttttctcttagattgtggtttgaattgtttgctatgtagaagatttatattttgggattttgggggtttgtgtgtttccagtagtgagatttatttattatttcttcataacttctggctctggtgtcatttgtaaaacttaaaaaatgctatttgttaaaaaaaacagcatgaaaagtggtccatgtggttgtctgtatattacccaagtcatgaatacctagcaatatcagttatcagaaatgacaaatatcataaagtcacatcaggagagcatagtaaaggcaggagagcatacttaagttgtaacactttccctgtgacaaactcccccttttgtaggctttgttgctggcatataccgtatttatctatgagccaggacaagaccactaatgaatcttataaagcttgagaaagtgactatgcaaaagaaaatagatccagcctgttactctactccagaagagagatgtgcaaggactttaaaaataaacagtcttcaatattcctttccggagataatacgattcttttatgtgagatatgtaactttcttttcctttaattactacaaaaataatttgaattttagacaactctgtgctatttgggagtattactttgtgtgagttggtgcaaaatggaaaattacaaacatcatttaaatgtcctctgaataaactaggtataaaaagagtaagaaaaccaagttcaatatccttggaacaacattgctaatgttatttttaaatgcatgtttatgaatccatagtgacactgcacaaagaaaaaaatcaccactgcatgtaaattgcttgcattttccagtaaataccactttagttttcgtagtaaaatttactgtgcaaaatggattatactcactcttccctttgaaggtggttgcaaagtgtgttttgtgatccaagttcatggattgcagaagctcttgaaaagattacgggtttatgagttgctttaggtaaagaagttaatcaaatactagaaaaaataaaatatctaggtaaacacacaatttcaatataaaaaatttaaggtaggcagagttatgcttgtcttatagaattacagtctgagacctgaaagcctcaattttcataagaactaaaaatgaatcatttcagaatcaagtttaacacagtaaacttagttgcaaataaaggaaaaacataaaatatatacttaaagaaataaacacccttgaactttttactgtgttctttcacaaaataattgatgctaaacataatcacaaaatttgggcagaaagctcatgtgacattatcctgactcttaatgataataataatgataaccatagaatccaccggatgttgaaaatgtgcaagacactgacacaggtacctcgcatgtggtaactaactgcatcctcttagcaaccttaggaaggaactgctattactatccccattttagatgagaaaatttagacacacaatggtgaaataagttatccaaagtcacacactaactgaagtaggcagaaattcaatgtagatataataggtaatatccatttttatcacttatagaatcctgttgatcccatacaataatgtacagggaaaaaaagccttttgaaaaattgtaatgcccaacaacatagctaaagcattaacatcattataggttttttagtctctcaaatattttcctaattcatgcaaaattattacttaaggtcagaaatccgcagtttttactttaaacaattttcttcagatttatatatatatatatatatataatacacaaatcttgccatttatatttcaatggctacagaacttgtagcctaccagccaccttctctcgttggtctaaaaagtatagaatcttgagtcaaggggtcttctcttccaaattcatctccacaatttataagcttttacagaataactaaattgttaggccttagcgtcctcatctgtaaaatgggatccactaatagtacctatgacactgaattactataaagattagtgtttgttagcatcaattttcaaagataattagttgaagcatattgtgcctggcacacagtaagaactcagtaagccttagctgttgctgttgttattaatataagtacgagtatcagtattactctcagaataggtattattgttggtgttggaagtagtcttataagaacaaactaaaagttctccctacactcaaattctgagctaatattataggaatgaaatcacaaaggccatctgacaacataaatcttcctgacttgagattgcttttcagaatctagaaggacacataagagatggatctcctgcatggaagagtggtcactaaactttagattacatcttccctatttctccagaatgactgtgcctccagcccttcaatctccctcagtaataggctgtttaacttacttgtggaatattgtatagattctcaggtatttaaggctggaaagaaccttagaagtgaattattaggttggtacaaatgtacttgtagtttttgccctatttttaatggcaaaaaccacaattacctttgcaccaacctactagttcaactggtgggctctacagagggctgtaaagtcaggatttgctgctatggaaagagctaagactacagtcagattgttcctcccttctttccttttttttttttttttcattttctttgtttggaaacatttgcatattttctaaaatcttataaaatatgctggtagatttgaacccacagaacagtttccccagaattatccaggaggatatggtacaggcactgtacatggcattttacgacctcaataaaatatcttcctgaaacctgcccttgaggaatgatggcataaattactgtaaaatgaggctttagaggcagaaaccacttatttccttatgtgctactatatgttcagtccttgtcacagtgcctgacagctaataggtatttcaaaaccatataatcaatatgtgtgcttttttaagcagcactttttcatgaagttgcactttaagatatttgtagttttttacggaaatatttctaaaatgaattgttacttttttgctctactcttttattaaactgagtttacctaatttagctagtcccagaggactgttagagattctttctctcctgttagctcttatttcccagttgtatcagctttaaagagccccctttcctgctatcatgttaaatacattgaaaaaaaaaaaaacagaacgtccttatgcgtagcatgggcatctgcatacaatagactatcaatgtcagtatgtatttatataccatcttattccagaaaagaatgacacctgcttaaatgctcaataaaggtattgcagagttaaattaaatgtgattaatcagtttaaacagtgtactacaaatataagtcaatacgttctaagagagcctgactatagaactttcgtcttttttttttttttttttttttttttttttacttattattatactttaagttttagggtacatgtgcacattgtgcagcttagttacatatgtatacatgtgccatgctggtgcgctgcacccactaactcgtcatctagcattaggtatatctcccaatgctgtccctcccccctccccccaccccacaacagtccccagagtgtgatgttcctcttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatataccccgtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgcctagtcagttttcccagcaccatttattaagtagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgactcggtgatgcaggctcttttttggttccatatgaactttaaagtagttttttccaattctgtgaagaaagtcattggtagcttgatggggatggcattgaatctataaattaccttgggcagtatggccattttcacgatattgattgttcctacccatgagcatggaatgttcttccatttgtttgtatcctcttttatttccttgagcagtggattgtagttctcctgcaagaggtccttcacatcccttgtaagttggattcctaggtattttattttctttgaagcaattgtgaatgggagttcactcatgatttggctctctgtttgtctgttgttggtgtataagaatgcttgtgatttttgtacactgattttgtatcctgagactttgctgaagttgcttatcagcttaaggagattttgggctgagacaatggggttttctaggtatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtggatttgtcatagatagctcttattattttgaaatacgtcccatcaatacctaatttattgagagtttttagcatgaagcgttgttgaattttgtcaaaggccttttctgcatctattgagataatcatgtggtttttgtctttggctctgtctttatgctggattacatttattgatttgcgtatattgaaccagccttgcatcccagggatgaagcccacttgatcatggtggataagccttttgatgtgctgctggattcgttttgccagcattttattgaggatttttgcattaatgttcatcaaggatattggtctaaaattctcttttttggttgtgtctctgcccggctttggtatcagagtgatgctggcctcataaaatgagttagggaggattccctctttttctattgattggaatagtttcagaaggaatggtaccagttcttccttgtacctctggtagaattcggctgtgaatccatttggtcctggactctttttggttggtaagctattgattattgccacaatttcagagtctgttattggtctattcagagattcaacttcttcctggtttagtcttgggagggtgtatgtgtcgaggaatttatccatttcttctagattttgtagtttatttgcatagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggacagttctgtagatgtctattaggtccacttggtgcagagctgagttcaattcctgggtatccttgttgactttctgtctcattgatctgtctaatgttgacagtggggtgttaaagtctcccattattaatgtgtggcagtccaagtctctttgtaggtcactcaggacttgctttatgaatctgggtgctccgtgttgggtgcatatatatttaggatagttagctcttcttgttgaattgatccctttaccattatgtaatggccttctttgtctcttttgatttttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagttacttcctagtctcgatggtctttacattttggcatgattttgcagcagctggtgccggttgttcctttccatgtttagcgcttccttcaggagctcttttagggcaggcctgatggtgacaaaatctctcagcatttgcttgtctgtaaagtattctatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacaatttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcttgcagagtgttttccaacttggttccattctccccatcactttcaggtacaccaatcagacgtagatttggtcttttcacatagtcccatatttcttggaggctttgctcatttctttttattactttttctctaaacttcccttctcgcttcatttcattcatttcatcttccattgctgataccctttcttccagttgatcgcatcggctcctgaggcttctgcattcttcacgtagttctcgagccttggtttgcagctccatcagctcctttaggcacttctctgtattggttattctagttatacattcttctaaattgttttcaaagttttcaacttctttgcctttggtttgaatgtcctcccgtagctcagagtaatttgatcatctgaagccttcttctctcagctcgtcaaagtcattctccatccagttttgttccattgctggtgaggaactgcattcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgctggagtaccctgccgtgtgaggtgtcagtgtgcccctgctggggggtgcctcccagttaggctgctcgggggtcaggggacagggacccacttgaggaggcagtctgcccgttctcagatctccagctgcgtgctgggagaaccactgctctcttcaaagctgtcagacagggacatttaagtctgcagaggttactgctgtctttttgtttgtgccctgcccccagaggtggagcctacagaggcaggcaggcctccttgagctgtggtgggctccacccagttcgagcttcctggctgctctgtttacctaagcacgcctgggcaatggtgggtgcccctcccccagccttgctgcccccttgcagtctgatctcagactgccgtgctagcaatcagggagactccgtgggcgtgggcgtaggactctctgagccaggtgcaggatataatctcgtggtctgccattttttaagcccgtcggaaaagcgcagtattcgggtgggagccacccaattttccaggtgccggctgtcccccctttctttgactaggaaagggaactccctgaccccttgcacttccggagtgaggcaatgcctcaccctgcttcggctggcgcacagtgcacgcacccactgacctgcgcccactgtctggcactccctagtgagatgaacccggtacctcagatggaaatgcagaaatcacctgtcttcggcgtcgctcacgctgggagctgtagaccggagctgttcctattcagccatcttggctcctcccccgactatagaactttcatacagtacatgaacttcataaaaacaatttctctgcttaaaaggctttttctaatttacttcaaggtttcctatcctaatgtagacttaggttagctgtagccttgtaggatttaaagagagaatagattgtaagagatgagttctaaattcagacagattctcaagggcatgattcttatgaatatgtataatgtcaactctagcctatgtggatttctagtcctttgcagtgctaatttagccattattttcaagctctttttctatgaaaccaatttactatgactttttggtaaggcttttataacatttgctaattacaaggtgacatctgcataattattaattatgaagttacatctgcataatgaatattaccaataatttaacttaaatgtttcagttaaaactttaaatgcatggaattaaccagaagtcacaatgagttgctactgtatcagttatagaattgagaaggaaacaattcaagacaaacatagtagtgaatgaaaatttgagctttaacactgcatgaatgagaggaaagatgagtttgatgccacaaagaaaaaggggtcatacgtggtaataacctggtagagagttaagagaaagtctcatcccaaagtatatttcagcatgaagggcttgttaaaatttattctaggaagaatataaaagtgtttgctttattggtaatgttaaagaaatctacactgtgattttctttgagctcagaattcagcctcagatatgagcatcgtttactaggccaggctatgttctaagtatttaaaaattttggaatcttatctgagccactaaattttgagcagattttacagagagtggcatcatttcctagaaaaacagcagcaacaaatgtggggaaaagagggatgtcctcagggttagtgtgtccagggatcaggacaacgctccacagagtcgaggggcattagtacatataattattccagggaagtctctctcagaggccataagaccaatttctatttagtttccttgctgtcatatggaagagattgaagtctgctggcatcaatgaggtaaggactctgccatcataaagtcctgtggattatggaaagcccatgtagaaaataatgggaaataaaggaaacaacaatactgtttaatttgaaaaatagacatatctgtgtctcaagatgtaagaattgacgagtacacaccaagtcgttgttatctacgtggaaaaaaatagtaaatgtatttattattagaggatgtgaagtttggttgtgacaaattaaagactgcacctttttgagatagtcatgtaacattttcagtgactatctcttaaggcattgtgcacaccatactgcttaaaattcaagatccttgtgactgaaagccagttctgattataatagacacaattctcaatgctaagttctaacaaattaaatgtgtccctgaatgtgacagtaaaacttctaagttttattccattttcaaagattagctcagttccacttgtcagctgggacatgctgttagatttgttgttttattgtattgtttaaatgttcagtgggcacaagtttttcataggtaaagaattaatgtgtcatgttatcgtgacacattaattttagatacatcagtctaaaagcatgaaagtttattttgatccagttcaccgcataaaataatcactacccattttcacttcaaagggcatatcttgatatgtatagaaggatagtgttgaaaataattgtgtttatgaaattaataaatctccaaagtagtggtccaaaaaatattttaccccttaggtcatcctactgtcctgtaagttaccaacagtaagtagaattaaatttacatactcttaatattgagatgattgctgaccttgagaataattattttagagaggtagggagaggaagttgtcaattggggtgcattaaggggagagtatgagatgagaacatgaaatgaaagaatacaaacagcaattcgaagaagtttttctctaaataggagcaggaaaatcatgtgggagttgatggtgaggagggatgttggtacaaatagttaccctttcacatgatgaggactatcacaaatatgctgtgggaaaaaaagagtgagaggaaaaaaaatttaaaatatccttgagcaaatcaaagagcatggaatccaagcctaagcagaaggatttgtttcaacaggaagggaccaatggccccatcatgaacgtggaaagtctgaccatcctaggtacatgaggttggtaggtctgatagtgggagatgagatacttctctttcgactggtactattgtctgtgtgaaataatcacttgaataaacaagtcttgacagaaaagagttgaagttttcactttgggttattgttagtctttagagatcatcatattcaacatccctctctgtccaggaatcagatgaatagtgctcagatattttgaacatggccatccagcaatgagcagcttagtttttcaaggacagccctttctgtgtttagacatcactaatttttagaaaaccttttcttactgtactagttctctactgcagctctaacaaattaccacaactgagctgctagaaacaacccaagtgcattatcatacaattctgtaagtcagaagcctaacgtgggttttactgggctaaagtcaaagtttcagtaagttttgtgttcctttttggaggctataggaaagaatccttttccttgtcttttctgatttttaaaggccatgcacattccttggcgcatggccccctttttcatcttcaatgccagcaccattgcatctctctgtgtgtttctgctatggtcatatcttcctctgactgactgcacttagaaaaggttctctgcttttaaggatgcatgtgattagattgagcacttctggataatcaggacatctccccatctcaaggtccacaaccttaatgccatctgcaaaggcctctttttgtcttgtaagattacatattcacagtctacaaggattaggacatggacgtctttggggaacattagtctgcctaccacacttgttttaggtttaaatcttttgcacactgcctcttgacttaccctatcgaattgtgaaacaaaatagagtcattctttccttttccatagaataatcctgtcagatgtttcaatgtaaccttcaggggctcttgtcttttacctcccaaaatttctcctaaacttctgtgcccataagtaaacataagtcatactgacatcattgacatcatatagtctttttatacatatagagaaatgcattcatagataatttgaaagtcacagagtacacagaaactggagtttatttgaatagtgttacagtatatcttagaattatgtcatagtgtccttttcaaaatatgaaaaacaagtttacatgtaaaattatgttgaaaagaaagtgatgaaactgtctttcaagcaagttgattttaatttggttcaatttcacagtccttaattgaacattactggtaccttatgaaacaatctctaccctaatgacctggggctaattgggatgatgggcacaaatggttttattgtattatagtaaatgaaatgatatagtaattataggatgcaataggaaaatagcttcgggcagaagtaaagaactcttcctggaattgtctcctgtgctaaattttagtagatgagaagttaggaaagtgtactgtatggcaagcactttccagacaacagaaatagaagaagtaaaaacactgtgaagcaccaaacattatagagagagtgtatttggtaagtatcaagaagctcatgaatagtactagtagtagctttaaattctgattagcatttactatttatcagctaacttttctaagtgctttattattttaaccttcatagagatcccataaagtagataccataattacctaaattcattagttcagggaactgaggcacaaagaggttaagcaacttgccaacaatgtatagcaaatccaaggtttaaaactctggaagtctgaaatcaaagattctgttacaccatacaagctctcaggatgaccagaatataaagaataaagcaaagagtggtgaatgataaggaatgtcagcaggagtttttgttagagctggaaccttaaccagtggtggaggggctcccttgatggggttaaacagaagagtgtcatggtcaagtcacatgtcactgtggttgtcattgtggttgtggttatgtggagggagtgggaagtgataaaaagagaaacacgctaaaaggtaattcagagacaggggcacttatccaagtaaaatatgacaaaaatatagcagagttagcaaagaaaaaaaaggctgaaaatgataaatatttaggaagtaaaataacaggatgtgatatttgtatacaggagtatgtgatataataaaaatgagataagagataacactcagtactatagtttgacttttgaacttttgtaatttactaagttagagaacacttaataagagcggaaaatacgtttaagttgaacatactgagataaagctgcatgtgagaattccaggctgtgccactaggcggcggcatttgtgcgcctgcattgtgcgaattccgcccaagctttactctctgcatgatttgtcagtgaaattctgaatgtctaaagacctctcattctccacttctgttgtattattagtttctgaccacacgatggagtcatttcttcacatttcctcacactgattttgtttattaagaaaatcaatccagtcaaacactagctggaataaaagacatttaaattttcagaatattcctctaaaaatttaggttctctttgacaaggaacataaaaattaattcagtgagtattcagaaccagcttcagattatttaaaatgaaaattgagattcctgaaaaacattaattaatccaggaatattgattttaaaaattgtttagagacactgaaaaagcataaatatataactacttgagaaactttgttaagtctgaatcaaatttggaattcatttaaagcaggtgattgactgtacacaagtatattgtcaagctgcattctattttgtgtatgatcctgccaagttttaataaatattagtcttcaacctttaatcaataatgttttagaagagagtaacaataaatggtattggtagagcaccttacagtttgctgcgctttcacagccttatttcgtgtgacactgacagaccagtcaattaaacccctattccaaggaaaatgtaaagaactgattctagacaaagaaaaaattagtactattatctcccttcaccttacacatttatactgcctctggtacactcttgctctttaacaatgtatcttcaatttaatatccaaaatctgttacaacgcttttaaattactgcaacaatagaagcatatggttcttaacctttcagggttggattgaatgacctaaaaagggcttctgaagtcttcaacttagcattcgtctttccaggtcaaataatccctcctattttttctcgcagggtgatcagtctttttggaatgatctctctcttagaccatgataattttccagttctttgttcagaatctgggtacctgaaatccctatcccagatgatgtttttatactaaggcatagctgggaggaagcctcaatggaaatactgtcattcttaattttacagtcatctagtgtgcctttcactgctctccagagagaggtcttatcgagtggctaggattccaaattcatggacaattttcagtttttatctcctagggtctctttaatacatacagcatttctttcttcctgcagaagaaagaaacactttcttcctgtgttctcctagatttcttcgtgcatttctggccactctttctcagcttcttttcccctgtctctttcacttctttctctgtattctgttaaataccagatttatttctctagctcagacctattctatgagctgaggtcttatagataaaattgaattattgatgtttttcactttcccaccataatgaatgatatgaccatccattctttcactgttcaaatgagaaatctcacacccgtctgtttcctctctcttctttaatgcccatatttaaattcaatccttcaatgtaccctatcaaatctatttcaaattgtaccccactaaattcatgtctatttccattgtcaaaagttgatccactctaaaattctccatttggaccgttatattagactcctgattgctgtttcgtctttctcttttgccgtctttcaatctattctctggaatctcaaagtaatcttttaaaaatataaatacaactaatgccactcattgtgtaatacctttcaatgacttactgttagatgcagagtacaatcctaactactaaacttgatacagtttggctggtatttttcgctcctcttttcttaagtaactctttcctcttttcattattccatagtcaccaacatttatgcaacttctcagcccatgaatattttcttcctgcattcacacatcttaattttaattagttcttagtttccctggctcttcctcatctttcaagtttcagatttagtaacacctcctcaaaaaggccttcctcactccctatcccattatgatccccaataggcatgattgtgtattttcttcacggtgcttcctaatttgtgaacatttatttgcttgtctatttcccttgttagaatataaattcctttgagggtagacaaacttacttttacctactacattatttaagtcctacagagtaggtgattattaatattcaccaaaagagtaaatgaatatatttttacatcaactcatgttgcagttaaattctgaagaaatcatcacagaaaatggtaagtaaaatcataacattttgttgagaaatatcgggggatagagtgctgatggggaggaccatcacggtagggtgctgctgaaggaaacaccaagtaagaagggtggatagaggggcctagcaggaataacagtagcagtctccatgagcatctacaatctcagattgaaatactgatggaagttattttggaaaataatttttgtttattaaaaccaaaaattgttaatggtaaaaaacaaaaatattaatggtgaaagatcttatttcagatggtctgtccagtaaaaaaaaatgtggaggataatcttttgaaacagataatctaataggcatagatacaaaaaataactgccattatagacatctcaactatctggatgcctgattgactcagcaaaaagcacagcatttaattacacctagaaccttgactcaggattataatacactggaagtggctacagaaaatctaggctgttattgaaattgaatcctctaggtgacttccctagtttttctctgttgtgcatatcaccttctaatatactaggtattttatttatctgactattgactgtcctgccttattgaatgtatgctccaagaaggcagaaacctttgtctattttgttaactttagtatctccttcacctagatagcaggggctcaataaacttttctttaatggacagaaataaaagtgactacaatattgtgctggaaataatgtgaaagtgtgggaaaaatacttccaaaatgcatatattctgagacttagatactacttctgggcattcaccctaggaaaataagtgagcaatacaaatatataaggatattcattgtgacacttctataataatagtgaataagacttaatcctcaataatggcagattcattaaacaaattctggaaattccatggaatgcaaacctaagcaaacaatgaaaatggtacagtggagatgtaaagatatgttacatatattgctcagggtaaattcagctcatatgacagaacagtctgtgtaatatgtataataatatacaatagagcatatatttgtgtgtgtgtatatacacacagtatttcatagactaaagcttgaaaggttatgcactacaatactgaaagtggttttcaagtggaattatgtgtgattattttccccttttgtgtgttttctaattttcctacaatgagtatgcatttttggatgaaaaaccaaaaggatatatggttttctaagagaaactttactccagaaattttataaatgactatgctgacatccaaaaatgttaaatgacatgctaaaggtcatgcagcattttaattttcctttcaaagagcatcaactctgagtaactgagaaaagaaataagggcttgaaactccaagcttaattctgattaccaagagaaaacatcatttaagcaaagggaagtttaggacaatcaggctatatgatttagaattttttccagctaagattagcacaacaaatgacaaaaataatattaaaaacaaagatagactcttaattggaaatggaattcagaatgagtagaaggctctgaaaatggaatatttgacattacaaatgtttcactaattagtaacaggaaagccaccctaaatacagcttggctacctagtgtgctctccaaagaactcttagtgtaactgggacctactagtgtggagggttgagtcataattcaggacaggtacatgaagatagccagggaggccaccaaactttaaaaaacttcaaacaacaacaagaagaaaccctatattcaaccaagaaaaagggaagtatgatgagtcagtttgattgcttagaatatgcatagtttcaaaaggaattttgggtgggtaagtgggaaggatgatgcagtttctccgctgcttccatgtttctcctcaataatgctcatctttaaattaggacgttgaggaaactgaaggcccaaatgttttttggcctcactaaactagaaactgttaaatgaagttgatttgagaaaactaaacaccaaaatatttttgctgacattaccaaactaaaaactgttaaatgacagtggtaatggctgtattccctgtgcccagctcaatggctgttggagagtaggtactccataaacatctgtgaaggagagtagaaatgtgaagattatcagaaaaagcaaaataatttaaccaattcatctgcattttccaaagaatttaaacttggaatgcaagaagaaaaacttgcaaattagattagattttataaaattaaggagatttggagagcatcagaagattgaaacataaacgtttttattatcaggatgcattgcatgaacaacagacaggtgaacctgacactaaaaccaggtaaaaattctagaaggcatatagttattttagaaacatcgtggaagaaaagtgtgatcataaggagattaccaacaagtcccaaaccctatttcatgttttgatagtgtcactaggttgataaattttataaatgcctttataatgtttctgcatttcagcaaggtctttgcctatcttagcaaagtctgtctttcagaaatccctcttattgtccaagaaaagaaatatggactgtatgaaaatggtattagcttagttcatgttgttctcttaaggtgactcccgcccaaaaatcattcagtttattttttgtgggttcatatttgagttctgacttgatcttttaaaagccttttagtgtttggaaattgaagaagtattaatctctgagtgtcactttctcgtttgaaaaacaaaaataccaacaaaactgcttaaggctgtcatgggatgaaagataaattatatgaaaatcttttgaaacctgtgtaacactgctcaaatacatgagtataattatcataattttcaagatagcactgttttcaagatggtagcttcagaaggtaaacagggtcaaaaagacagttttttttttgatatgaagatctgtacataagtgtagactgaggtatagaattcaggatagaggaagactgaaagtactggaaagaaagagggtcaggaacagagtcttgggagaaagtcagtagtagaaactattcattgatttctccaacatccttctttttgatataattgatggcattaggacttacattctgcggattcatatggtcctggaaaaattatacacaaaattatttgtatgatttgaacaactgttacttaaaggtgaagacattttattaatctaaattggcattacttatttatattattaaacaaattccatattattaagcaaattccaaactgctatgttctaaaagcttgtttccaccccacccccctgccaaattcatacgttgaaattgtaactcctaaaatgatattaggaagggcatcctttgggaagtgattaggttatgaggctggaggcctattgaaaggggttagtgtccttataaaatagctcattatcccctcccaccatgcgagaggacagctggaagatgccgtctatgaacaagaaggcaggacctcataagacacagaatctgccagtggcttgacttggacctcccaggctccagaactgtaagaaatagaaataaaataaaatgtttattgtttataagctacccagttgagagtattttgctgtagcagcccaaatgaactaagacacatatcttagacttccatttccatctttaaaatgggaagaaatttttttccaactaaatatttgctatgtttaaagcagatgataatattagaagtccattctagaaactctgagtatttggatataaaagcagtgttgcaccatgtcccattttatttgtatctttgattgtggcaattaacaacctgctttgtcatatcctacaaaaaaataacagttgtcaattgagatatttggttgtgactttatatagacctgtgtgtgtgtgtgtgtgtgtgtgtgtgtgtagttttctttatttttctgtctgaactttacatttagtatattccagtacagtggtgaccttgacttattccggatgagatcagggctaaattctactattttgtaaagtaccccaccaagttttgtagaaagccttataaatatctccaaacaacattattttgaataggaaatgaaggagagcttttcccagaggaatatacagtgttttcatttcagcaacattgaattgccactgcacatagccccatggccttgagtaagtaactgactcaatatgatgctattttgagaacatgactttataatgacttcatgctatgtgtatcatgtttccattcagaatggaatagattcagtttaaatatctatcccacaaatgtttatgatagcaactaactgcaattggctgcatttttttctggccataaaatttgagggtttagccatagatacagatttaccataaactaatttctttactacaattgatagaattgaggttttttttttaatattgcatgcagtttattaaaatgttaagaggctgagtctttagtaaatctccatttaatgtacttttccagtggtatactatgtttgtattattcagaatgtcctggttcagcaatagagtttatagctagatgagattacaggctgataacacccagatagagtttggacagtaggagataactatttatcacatcaggcaaataaaatggaaactggctctccgctacttcctttcccccctgactttaaaaaaaaatttttagctgcacaatttaaaatagaaaaaggctgtcccaataaaaacacatttttgtatttatttgatagtgaattgaaatacagcaacttttaagaaaaaagaagtcctgagtagtttcacgcataaacattccttttggtaaaatgttatttatttttaatttgagagataatagtaacaaatcagacgtgtttaaagcaacaaaatagtaacagtaacaacaaaacattgtaaaagaggctatgagtcaatactaactaaagattaaattacatatgacatttgggaaatgaggaccaaacagcttactttttgtatatatgcaaactgtatgggtcatatcacttctaaattaggaaaaatgtgtatgcctatctctcatgtgtttttactattaagacagaggtattctgccaccatagaaagatccatcaaagtctatgcaatcaaccaaacttagacttgaatccagtcctacttataattgtttggcttgggaaaagatacttaatttttctcaagtcttgacttcacgaaattacaggtttgtaccttaggaaatgttgactgatgttaaaatgatataatgaatataaataacttagtacagttcctgtcaaacaaaatacctcattacttagtaaatgtcataactgtacttataaagatcacagattaaactaagcatcaacctgacagtgttaacttttatattgttagattagattagaatttgtattattaaatttcgtattcatgatctccacatctaaataagagtacacattataacatgctctagtcacacggatttatgtgttgaccctaaacatatctcttcacttatgcttttctttctttcctccctacttttgaccaatatcttttgtctgccaataatactcttcccctgtctttgtgtctgcctttcaaaggcctgtgctctgcatttatgaaaaccccgatgaaccactatattttccatgaagctttttagaaaacacttctaaaataaacctgtccctctctgccattcctacagtatttgtcattttatttaacttctgaagctatttatgaaatattcgtcctattggactgtgagttgctggcatcaaaatacatttactgtactctattttgcattatccatagcttataacacagtctcatgtattcagtacatttattaataagggcttagcagcccttattatatttatatattcaatacatttattaataagggctaagaagtcaggaaatattctaggattaaagtttaaacaatgggaaaaattgataaaagactgaggaagggctggtcagaaagatagaagagaagccatagtatagtgtgtcccagagagaaagagaacttcaaggagttggaggaggtcaacacgctaaattgacaaccactccgatttttcttgaactcattctattgatatccaaatggtggaaaaatgataaactgctatgttcctttaggttgattccacggcatttattgagttgaagcctttaatcctgtaaactacactcaggattctagttctgaccttgaaaagcccacacctagtcacgtagttagggagaacctgctgtttgccagataatggtggtaaaaaaaggtattcaagatagtaatcattctttattcctgccattataaagtgaacgtcctgattgctgagggtgatgaggataactgattgaacatttacagtgcgttaagtagcaggctaagtactttacatattttttttattttattctcacatttctatgagaaggtgttctacaaaaacaaaatggaggcatgaaaaagcgaaacaatattgaattgctacaatatgctggaaaaaggtaaaataagtccaattatcttctgctttacatcccttccaattgtttagaacacctgccatatcttttaagtactgtcttctatagaagaactatttccaggttcatcagccattttttttaatgaaaaagtttccaggctttttgctttctggataaatttatcggaatatggtaatgtggacaaaaacctcttttaaaacatttttggaggtagttttccaagcacaatagaataatcagctttcttactgtagcaacttcagttctactgacattacattcagctttttgataggtacagatactattgagagatttacaaaaaaaaatcataaaaacctctagatattttcatatgaagtgaaattatgtcatcttgcccttggatataaagtattttgaggtaattctttctttagatccaggagatataataaaatgatactgaaagtatagatttagaagggaacttatgtaacatacggctcttagcatggtgcgcagaatggaaatattcaatcaatgtcagcttctcttcctattagctttgtgctctagagatgaggaaactgagctcagctttctcattttcaaccattaacttcatgctttataacacaatatgtgaacttacagtatctttggttttcttaatctgaacataattaaaaccccttggctttttgaacttctggttaatcctaatgtgagactgtcagacaccagtattttggttcttccattctgtcccaatcttgtttatttgacctctttctataatgtaaagtgtcattttccaacaagatttcatatgaaaatcctctattaccacacactttctttagaggctctgctcctttcttacttatcagaattttctaattaccaggatttaattttgtgcatatctacaaaaagccaccttcctttttaacagcactgtctagagccattattcttatatttgctctgaaatgtcttatatctactctcctaaaatgtggaatttatcacccttatcagtgattcctttctggatgatataaattcagaaaagaaacatacttttcccctgttgtttggtaaatacaagcaagttgctttagtatcatagaatagagtaattcttcctgtgagagatggaatgtacgcaggacaagtcaggaaatgaacacattttttataacaataaaagtatccaaaagcaacccgaatagtagctctccccttattacatcttgatactgtcagctgagtgatctgtattaggacaatatcactgtgtcctccatctagctggacagcctataatatactaccacaagaataacaccacactttctcctttcatcatcatccaaatgttactctgcttttttccacctacagattcttggatattttacaagcatttatcttattgacaaacagggctattccacacttacttttagactggtttctttttgatgaagaaaatccttctattgtcataaaaatttattactgggactgatacatatttttcaaatgtgaggagggaaaccatataccagcattaaagcacatctttaaatctgtttatgggtaaaataacagtatcatgtttcttgcagaaaaactccctcatggcttatttctcaccccttcacctaaatggaatagctgtttatgttgatgttctaactattctgctgtggctggtcttcacctatggaagcttagactcagtgtcatatctgaaaactaataacagaaaattagtcaaactaccttcctatcagaaaatatacatacagttatgtagatgcttggtaaaatgttattatactatttaggttcttatccttaatgttccaaaattctgtgagtccgtgattctagcatgtgagagagacaacatatgtttcatttgatgttgcagacattttatctaaacaaaaactattgacttcatcaattcaagttttgtttattctaggacagttttgccctttcaaacctgtgttttcaggtatttaaggaaatgaggagttagatttgaaactattgcagttgttcatagtagaggaagtagtagtagtagtagtaatagtagtgaatgcatccaaggtcaggtgacgtttcctagaagatttttatgcattttctcctgtgctcccatcaggcctgcaagaataaccaaacacaagtccaaccactggctgcttgcagaatccaattaacaagagtgagttatggtagaaagaaagtgactttatttaccaaaactagtaatggggaagtggccagatttacatctaaagtaatcacttcaaagtttaggctggagagaggggctttaaagggggaatttggagtggaaggcatgagggaaaggtactcagtacaaggtctgcatatcttgttctggtggctatttctagctgtggtcctccgggagtgtggactgggattatctcaacaatagctgggttgctgactaactgccttgaggtaatctctggaattttgcagctgggtctccatgcatggtctgtttcaaggttatcccctggaacttctaagtaagctcataattagtacaggcatacggttaaataaatgtgcatggtttaagggagtgtatggtaagaaagagagggatgtggtgcttcaaagaaagtacatttaaaagctagaacaaatagacttaacagatatttacagaacattctacccaaaaactgcagaatatacattctatttatcagcacatgaaactttctccaagatagaccatatgacaggccacaaaacaattctcaataaatttaggaaaattgaaatcatatcaagtactctttcagaccacagtggaattaatttggaaatgaactaccaaaagaaccttcaaaactatgcaaatacatggaaattaaataacctgctcctgaatgttaattgggtcaacaatgaaatctagatggaaattaaaaaattctttgaactgaatgataatagtgacacaacctatcaaaacttctgggacacagcaagtgtggtgctaagagcaaatttcatagccttaaatacctgcatcaaagtctgaaagagcacaaatggacaatctaagctcacacctgaaagaactagagaaagaagaataaaccaaacccaaacccagtggaagaaaagaaataaccaagatcagagaagaaccaaatgaaattgaaacaataaaaaatgcaaaagataaatgaaacaaaaagcttgttctttgaaataaataaataaaattgatagaccattaacaagattaaccaagaaaaaagagaaagccaaataaactcaattagaaacaaagtaggagattaatagcagaaatttgctggagcattatggtgtagggaactaaaaggttctgagaaagtctgtcctcaaccctatgcagtgtacagtggcaataaaatccttagcaaccaagttaaacaatgagcagaataccagttatattgtatatgagagtcttatctgtattaagaagttaactaaactatgttgttatggagtcctgagaaaagacatctataacagaaatacgagtatctaatgcacgcataaatatatatatatatatatatatatatatatatatatatatatatatatattctctcacaatataacccatatatatgtacacacacacacacagacacacacacacacacacacacacacacacacacacagatgggatggagactcaatatttaatgtattatattaggcctcatgagtcaaaaggtctttttaggatataaaggcatgcaaatgtgcactttctgtaaactgggcagaactagtccatggttggtggtcttttctcgggagaaacttactggaattaatattttatttaattaaagctacagttgcttgtgcaataaggggctgtggggcagttaacttattgactgctagagaaaaagaaaaaacatatggcagttagaacatagagaaaaagaaaaaccatatggcagttagaacatagtttattctttaagtgtaggagcctgtgacttacccctgcctggcatggtcttaggtcctgtttataattttgtgttttgttacaacaagccttttctgtcaaccttatgatctccattttaatgttaatgctgatcagttgtgtctaaatcaaaaaaagtgaggaaaggtatagtgaaacttgtctgactcttttcttgctgtcatggcctgaactggttttttaggtttctttgggatttcctttagccaagataaggggtccattcagtctgctgggggacttagaattaatttattttttgtttatattctcccttttttgtcaaagtataccagaggcagtgctgatggccaaccttctattttgtcccatatcaatgctgaggtggtgtgatacctgcccctggtccatcatacaccttggtggaatccttatggccaaggaccttagagtcaaaagaattaaagccaattaaatgctctaagcaagacaggcatgaaggtgggaaggcactcattaatccttaaaacccttttaatcaatataataggcaaaatccagaagccaaaaaataaggtcataaagtggacttatctataaattctgtgcatttagctactgtgatgtgatcttggcttgtagaaattagctgtccaaaacacaaatagtttgttcagctgtttaggcatctgtgtgcccatccctgacttggagggtctgaataaatttgtatagctttgataagccccagctataaatgagagacttaatttaggatttgatcttcaagatgtttgtcaaagatgttaaaaggctcaaaatatattattgcaacagaaacataggtcattgtaaaacaatagttactcatttaacccaagtaataatcaaaagactttaaaggcaatacaggaggttacatagatgtaaaacattaattcttttaaatatcagttttttaaggaattaaaaacctaataaagagtataggaattattttgataaaacctaaaatgttgtctcttaagcgagttatcagaaaggcaaagaaaaacctgcaatgtgactgcttcttatgggaagcccatttacataacctgaaaattaaatctgatgaaaaagtacttgaatttaatcagacatcagaagattgtgttaagattatgagtatagcaggggaatatataattcttagtaactgcataagaagttttctgattacattcaaaaatttagacatatcaagaaaagccaagatgacaaaatcaggttatactggaggaaaacattgcttttctagaccctcgagataaaatgttttcacatcaggccacaacaatagttacaactggaggaaaaaacttacagaagctgatgaaaaagctgaaggaaagagtcacctcaagctttctcaaggagagaaaaagctaaaaacagtgtgacaccacagaagctgaacttctgaggtatgattctgagaagttttcaaaacaggatataaaattaaaaatcaaaatctgaattttattaagagccaattaatatcttaagaaaatctcattataacacaggggaccaatcttataaagaccattataactagttcccttctaattatagtcaactgaattatatacaaaacttcttttataatttttctttcatgaaccttgtcacagcttacatagaccatttatgacatgcttggactttctgacttgtattacattttcctcttttctacataaccagtaattttattttaagacaagaatttatcattcatataaactcttttttcatataaaattattatcttttctttataacctttttatttaaaatatattttatattgataactttctttatatctctctcccctgcttactggtttatttttaccttttttaaataagtaactttaaaataacctccaaattatataaaagtattcttttttaacataagaatacaacttacagaattatatattaactagaattattaattttagtaaccttcaattttagtaaaaatttagggggtaagaaatcctgaactatttgtcagatgttagcattttatagattaagccattccactattttagaaacaattttcctacatcataatattttcttaattgggaatgactgagacatccaaggagcacttattatttaattcaaaataattttaagatttaaaattatacaaaaagtacacttacaagtatttatgtcattaacatgtactcaatttttccatttttaccagttgatctagattacttttgaaaactgtcatattacacaaagctagtcattatttaaagttatttccctgttaaccatttttaaaatctgaacattaggtgaacacctaagtaagaaacttaagcacgtgtgtattttgctgataactcagaagattcagctgtttttattgaaccaacaatcataaattagtcttatttgtaaaaaaaaaaaaaaaaaaaactcatatacacaaagattactctgtttttggctgggtctcacaacctttatgccaaaacattgataccttaaacatttagcaaaggcaaatataaaacttatttatccagacacaaatgtatgcccatgcttccaaaggcattttttaaaattttattaataattatagttagaaactagttttatttatcaaagattcatgtgaatgaaaagcatttggacttaatttatgagtactcatttacttataagccaatttggtagcatactaaatatgaaacagaacataatacatgtatattacataaatacatctaatcgcatgtatacatgtgtgcacaaagatccaatagcttttaccttggaactctagccatgagatagcatcacaaactcattgacttataaaagatagctggctccaagttatttttctgacaaaattggaacctcttcacatagctaaactttgtttgccctgataggtaatccaaggaaagttttgaaccaaaattttaagtaaagcagcctctatggcaatttgtggggtttttttaaacttgagaaaaaaaactcttttaccttttttttccttttcagtttcaaacaagtttccaatgtttacattctagatagaccataagtaatgagtcttagcaccagcagcttagtaacagcagatttaaagcaggtagaaagaaaacaagatagagagctttagaagattccacttaactctctagttacagattcaccatttgagctctgaatttttcttgctttaatttgtctgtcagttcaaaatgggcataaaataggccatactatgtaaccagctggagtcttaaagaggatgacaaactcgggctaagatgttggaagctgtttttccccttcagggctggtgtccctggattgaataagaaaagcgaaaaagaaaggaatggagagaagaaaggaggtcaggttttacagaagagaggatgaaagagaaaggtaggagaagaagcttttgagccacctcaaggttcagggtcagtaccccccaccatcctactttatctcctgtcagagagagcctcagcaccccacacctacatggtatggggtgaatccctctcatctctgcaagtcaccagttaaggtgaactatttccaggtggagggagctaaggatgcttttggcccaaaggagtaaggctgtaggtggctcctgagataatctggagaatgaagttggaagaaggggaaagagagagagtagggcccacacacaaaggtcacacactcacacatacaaacaagtggcatacctccaaaaaatccccaggtaaagggctgggtagattcccaaatgtatcacctcagtttcaaacagtccccccacccccaaaagtcagctgagtctgaaccaaccaaaaccccaagggtaccacaaatacaaacaaatacaaatgcataaaacactcaaatggtatccctagcagccgagtctaaatagagaagagccccagtgacaacctaaaagaggcagaggatagttgagtgcattccaactaactcacttagttccaaagtttgttgacttctccagtggtcactttctttgcaccagagaagcattgaaggcagcaggcactgcagcaggaagagaaagaggatccacaagacaaaagcatcttggcagctgcagagaaattccctaacgttccagccatggggtcagccatgagcagccagcattcacaggcatccctatgccccatcatacagaaattagactggcaggctggagactccggagcacacagcaatccccatatgggccaccaaaattgtaactaaatgcagatctggccacttgctgcttgcagagcccagtaacaagagtgaggtataataaaaactaagtgaatttatttactaaaactaataatggagaagtagccacattcacatccaaagtaaccacttcatacgttagggataggggtttaaaaagaggaacttggaatgggaggcatgtgggaagggtactgagtacgaggtctgtatatcttgtcccagtggctgtttctagccatgatcctcctgaaatgcaggctggcatcatctcagcaatagccagattgatgataacagccttcatgtaatctctggaaacttgcagatgggtctctaggcatggtctgttttaaggctagcacctgggacttctaaataagctgataatgagtaaaagtatacagttagataaatgtgcatggtgtaagggagtgtatggtgagagaggcatgtggtgtttcaaagaaagtatatttcaaggctatagcttaagactaaagaggagaagaaaaggtttccacaatatgcttaagggttacattttgagactagggaaaaaagggaaaagggggaaaagttttaaaatgcacttttaggctagactctttagcctaaaacaatgacattattattcccatttcacaggtaacaaaacaggttaaatttattattcatacacttaacaaatattgaacatcttgtatgagctaggctttattctagaaatttggtattactaattttaaaatggataaaattcctatcctcgtggactgacattctaataagaaacttctcatttattacaagacataagaaattagtaattaaaattatatgttagaacttgatacattctttagaaaaaagaaaaggtagaacagtgtaaggaagatctgactgctggagtgacagcagggaaagtgtagcaatattactcatgtcatgtttctggcttaaattctactttatctgcaacaggattccatccctgccttcctgtgtattatcttgtctgttaaacctttgctcattcctttatgtttagctttttgaatcattgtgttccaagtttgtcttttttttttctttttttcttcttcttattatttttttgagacagagtcttgctctcttgcccgggctggagtgcagtggttcaattttggctcactgcaacctccacctcacaggttcaagcgattcttgtgccccagtctcctgagtagctgggattacgggtatgcaccaccacacccagctaatttttgtatttttaatagagacagtttccccatgatggccagactggtcttgagctcctggcctcaagtgatccacatccctcagcctcccaaaatgctaggattacaggcataagccactgcacctggccaagtttttcctttgtgtatagcatagaattcagttttgctttataagccaaattgaaattttattattattattaaatgaatacatcctaatcacatttaggatgtgactaatatgttgggtctcaattgtcatggtatcttatgttgtaattactgaatatattatttttactgtgttttccccccactatgttgtgtttttgttgttgtttacatcatttaacttgtttatactacattttaacttgtttatactatatatttatactatatttatgaagatttctattccagctctagtggttatttttggtttaatattttatatagtaatcttaatttttctgtttctgttttctccattttaaaatttttacaatctcttctgtcaattttaattggtatctttcaaatcctatctaagacatggacaatagttaatgaaatgattctactttcctttctccttttccatgttttcttttttaagttttatttttgtgagaatatattatgtttacatattattcttttacccaagattaagactttgtagtctcagttctttgtcttaggtctgctagtaaaaatatgaaatacccccagtcctttggtcagacttggttggatgaagctcatcctctagcagattcctttgaaaggacacataagtgtgtgttttgcacattcaaaacttttttctattcctttcacacttcaaggacttagctgatgtcagaatttctaaatttcttgaaacttctgcttcatgttggttttatttttgagaggtctgattgcctgtctattctcatgcttttgtaccttgtcatttcatttcctggagaccctgaggatactttatgtttttttaagtctaatagttttacttgagtatggtttggaattgctcacaccagttcaattttccttaatacatcctttcaagatgcagattcaggtcttcttttgttttctggaaagtttccttgacctatagttttaaatattagttctctttcatggttttggttttcttagtgaaaggctccagatatgcaaatctcggacatcctttacttagcttccatttcaagcatcttctctctgaccctttttcttttatttttttttaaataaaaatgtcatttacattaccctggttgtttttctctttattcaataccctttataaaattgtcatttgaattcatatttttggtcattttgtaacttacttttcaattctgatatttaatttttttatttctttcttgggttcaattgattctcattttatttcttcctgtttttgtcctttgctgctttcagtgtttatctttctaattcagcatactttgaaaaaatttccaaatgctcatttgaggatatttaatttagtttgggggattgtattataggtctcttaagttctttggttggttttatgggaaaaattttcatcagctgaaatgcgtcaattcaatttaagtgatttttcaaaatagttgtgtgtggatgtggtctgattttttttctatggctatactcttcataaattgagagtgcccacttctttcagttcagcccaaatctgtgtaatttcttttatgaatggtgttttgattgcagtgttgtgggcggagggattggagtgttttattcctttttgttttctttgtttctttcctttccaacttcatacatctgacttcccccttccatctactgtcaataactccctgctgttgccacttctggcaccacttactttcgctaaacccagtgttaggaaccaccaagttctgacctgtgttcagcattttggtatttgtattgaactttctcactttgatgatgattttgtttgtgttttatctaattcatctagaatcctactcttttttagttcttaagtttcctctccttctttctccacacccacaggcaatggaaatacttcctagtgctcctggatgtgtgaatcatctgtggttttgtttgttccccttgttggttttatagttttttgggagaaggatcaatggggagattcaagctcaggacgccaaccttgttctccaagcctataggtctttaagatctggaggtgaacagagaagatgttaatgagaaagttatattaaacaaagccttgaaaaggattagaaagttgtgcagtgggatattggatggggatgcatttcaggcagaggaaacagcatgatggtcttgaggtgtaagcatctctggcatgtttgcggaacagaaatgaggggagctggactatggatgtgcaggtgaatatggaaaagaagagtaagatgaaaggtcagagaagtaagagggtgatgtgtatttgtaaggactgaataaacatgcctgaagatagaaattggagaaggtggtattcaaatctatctacatgatttcacaccttgtgttcttttcacaacataatgttgcaattcataaagagattttattaagttaacctataatgaaatataacccagaatatgcagttttggagctcacaaaagaatcttctagtgtgagagaatgataggtctttgtggactcaatttattatctctagtatttacctttcccttgaagagaactgataaaactcctggtgtcatgaagcttacattccatggagggagatacacaagaaacaatatgtaagtaaaagacacagtatgttatggtgatcattattaaacaggaaagaaggataacgagtgctggagagatgttcagaattttaggcaagacagctatgaaagagcttactgaaaaagtgacatttgaatgaaaatcctggaagatgtgagttagtgcaaggtgcttaatcattttgtacctaattttctcatctgtaatttggggaaggattacattaaatggtccatgtcaaagtatttccctatacagtagtaggtaatgggtgctctttgcatagctgtcttttcaatgtccaggtttaaagttagtaccacagaatattgtgttagggactctccagcagagtgtaaatgcttgagcatgtgcgcacatgcgtgcacacacacacacacacgacattgccgcttcattctggcaaagatcattttggtctctgattaaacattccagtatatcacctgtggaggtagactcctgcagacacattaaagcaagttttcattagcaattagaaaacatcagattccacaggtgccacataaatttgccagtttatcttaattcatcaactgctgtcagcatccatggctcaagctccccatcataaacaaaaaatgaggaagaaaagtttatgttttattcattcagtactaatttgcatgtggtttgattagaaagtaaagcaatgcagtcagtagatggtgccagagggttgcttttcactgcaaggctagaattagtttgctgaagataatcttttgtccaatgattctgattccttttccctggccatgctaaacatttttcacacgggtgaactattaacataagaaaaatctaaaactttagagtatatccacattactatgcatggaataaatcattatacatcttattaaaatatttaaatgtataaatttcaaaagaggaaaatatttaattctcatgttttctaatcataaaaaggatgtcttaagcattttgatgaaattattaatatattatttgaatttatattcaatgcattaagttgaattatgaatatgtatgtgtattatttatatatgtatatataaaatttaaataatactataatatcttaacaaaagtgatacagggaacacatggtggttccatctacctatctgagaagattttctcaccaaatcttttggagttgtttcttctggagggaaaatgatagtcttatttatctatcatccctttaagcataacaccacatggtgctcattcatagagtaaatatttgttaaatgaatttctcacagtgatatcttattctcaagacctccctccctttgtgttatttttataaaaagcttattaatcatattcactcatttattaggttcacataaggattgcatatgttgtcaccaaaactcttctataaatcccttcaggttatagaccatgttaatctttaactttctaaaatttatttaaatcttctcccattttttaggttgcctgttcactctgatggtagtttcttttgctgtgcagaagctcttcagtttaattagatcccatttgtcaactttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcgggtttgtcaaggatcagatagttgtagatatgcggcgttatttctgagggctctgttctgttccattgatctatatctctgttttggtaccagtaccatgctgttttggttcctgtagccttgtagtatagtttgaagtcaggtagtgtgatgcctccagctttgttcttttggcttaggattgacttggtgatgtgggctcttttttggttgcatatgaactttaaagtagttttttccaattctgtgacgaaagtcattggtagcttgatggggatggcattgaatctataaattaccttgggcagtatggccattttcatgatattgattcttcctacccatgagcatggaatgttcttccatttctttgtatcctcttttatttcattgagcagtgctttgtagttctccttgaagaggtccttcacatcccttgtaagttggattcctaggtattttattctctttgaagcaattgtgaatgggagttcactcatgatttggctctctgtttttctgttattggtgtataagagtgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgagtaccctttatttccttctcctgcctaattgccctggagaaaatttttgcaacctactcatctgacaaagggctaatatccagaatctacaatgaactcaaacaaatttacaagaaaaaaacaaacaaccccatcaaaaagtaggcgaaagacgtgaaaagacacttctcaaaagaagacatttatgcagccaaaaaacacatgaaaaaatgctcaccatcactggccatcagagaaatgcaaataaaaaccacaatgagataccatctcacaccagttagaatggcaaacattaaaaagtcaggaaacaacaggtgctggagaggatgtggagaaataggagcacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaatgatgagttcgtgtcctttgtagggacgtggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtgggggtagcggggaaggatagctttaggagatatacctaatgctaaatgatgagttaatgggtgcagcacaccagcatggcacatgtatgcatatgtaactaacctgcacattgtgcacatgtaccctaaaacttaaagtataataataataaaattaaaaaaattaaaataaaataaaatttatttagaccaatgcctggcaataaggatagcatgatatgaatgccataactatgaataatacagttaatatagttaataattatactataattaataacttgtatggaaccacaatattaaatttcttatttctaggcacaagcagtgaagataaaatacttatgactaaattcaatcctaattatgagacaaatagggaaatttgctgaaacacagaaatttacttcaacctccaggttttggcagcaattaaatttagagatagaggcaaatgttttccatagaataaacacagcatttgaatttatttgatcttgaaaagtttaaagtgtcaaaaataagtaacagaatacataaatatgtcatttgatatactttacagactttggaattgacaaaagttaaggtgctgatcaaaaattatgacaatttcataaaacgtgttatatgaaaaaaacttaagagaaatagacttttgagagaaagttgaggaaataaagataattattgaattagatttggagcaaagtaggtaatgtattgagccaattgttggaaaggaacaggatgtcagattctgtagataaagcctgtgaaagaaaagagcagatcaattggattaggataatttaaaagagtagaaaaaacgtccaaatatcttgaatctgagaaaatgagaatatttctacaagtctttgcatagtaaagatcttagaatcttttgccagaatcctcacatttttatttgacatgaaaattgaacatattattaaatccaaaggcctaaaatgtctcataaggattccagtcccctgtgattgcacataggaatctcaagtgtaagacactttgctgtcaaatgtgtttctacaagtaggcacagcactggactataattgtaagaggagggtaaaaatataaatctcttcttccaaagaaacttttgttatcaaacttagcattttaaatcaatcagtctgatacctaaaaacttagaaattatctctctattataaggtttgctgttctaatagtaagcgtaatagatactatatttgatgattccatcacttcgattggtatgattttagttaaatgattgcactattatttatgccacaggatgttcagaacccctgatagtctctttgatactcactgagtaatgatagttttatgctgctatggccttagagtaacttcacccaggaaagtattatagcaatcccctttcaataacttttacaacaagtgaacatatttattcctatgtccctatctgtgcttagatcccatttttaaaatggctctttattagacatgtgtgttttttcatctgaataaatccttgtaaacaacagtgagttaggttttataaccccacattatgaatctaaaacaggctgtataatatgtttaagtccataaagggagtaagaggtaaggctatgattcaattcttggtctgcttaccaccaaaacttttgtccaatctgtctctggggcccatgtattctggttgtctgggacagttctgattgttgcctatccggcttagcatttgtcctcttctgaaatgtctcatttggatgataaattttatggtcactctagaccacactaagaaaccaggattatttaatcaagattcagacattgcatcaatgtactggaaaactagaaatatggtttctactttaaatgcttaaagaaaaatagagaacttggacatctattcaagttaatgtctccaggatacttgcataaatctcactgtgtataccagttagtccaatgctaaaaacaacaaacaaacgaatgggttatgaaacttgagagtgcgtaccagagtataatattagaaatttatgcatgctgtacacatgctttctttagaaagaatttgtccctgggtaagattgattaataaaactactcttcttcagctgctttaaattatatgccactttttaaaaaaccaatattcaacaaaataggttatttctagtcaaaagagttctaagaaaatatcaacatatttatctctacataaatatagacaagctgaggatgagggcaaaaagcacctacatggcccatagagctacacatgcaatgcacgtacacacacacacattctggacctcacctcctacctttcttttgctcattctgtttcagccacagtcagtagcttccttgctttcctgaagcatattaagctcccttctctcatagggcctttgcaatttccagtccctctatttggtatacttttccctctcatttcccaatggcttccttccttccttcaggtctttgccaaaatgtcatcttctagtagagatctctgattaattaaatttaaacagcaaaagccccattaccacacatcttacttttccccattcctccataaaacatacctcctgacatacctccataaaacagaccttctaacatacctccataaaacagaccttctaacatacctccataaaacagaccttctaacatacctccataaaataaggtgtgttagaatgtgtaagttctatggagaatattaaagtaaaaatattttaacttttttatcttaatattctctaatataaagtatttttactttaatattctccatagaacttacaccttctaacataccttattttatacttatttatttcacttattctctgtctgccgctctgaaaggtaagcccattgagaacaaggtttgtattttgttttttggtggtggtggtggtttgttttgttttaatttttgtggatacgtagtatatgtatatataaacacacacacacaaatatatatatacacacatagtagatatccacaaaaatatatacatatatgttacatatatatagtgtatatatgtatccacaaaaattaacacaaaagaagccaccatcaccaacatgtacatgtataaaattaaaacaaaacaaaccaccaccaccaacgtatatgtatatctcatgttccatatatatatatatatatatatatatatatatatatatatatatcatgtaccacatataggtatgctacatgagatattttgatacagacatatgatgtgtaataatcacatcagggtaaatgggatatccgtccactcaagcatttatcattttattgtattacaaacaatccaattattctgttacttatttttaaatgtgcaattaattaatgttgactgtagtcatcctgttgtgttaccaaatactagctcttattcattctaactattttctgtacccattaatcatccccacttcctaccaccactgctctttccctgcctctggtaactatccttctactttacatctccaggagttcaattgttttaatatttagctccacaaataagtgaggacatacaacatttatctttctgtgcctggcttatgtcacttaatgtaatgacctcaagttccatctatgttgttgcaaaaacaggatctcatttttatttgtgactaaattgtacttcattgtgtgtatgtaccacattttctttattcattcatctgtttatgggctcttcagctgcttccaaatcttggctattgtgaatagtgctgcagtaaacaagagaatacagctatctcttcgatataccaatttcctttctttttgggtatatatacctagcggtgggattgctggatcatatggtgggggtgggtctattttcagttttttggggaacctccaaactgttcttcatagtggattgttctaatttatattctcaccaacagtgcacgaagttttcctttctgctacatgctcaccaggattcattattgcctagcttttgggtaaaagtcattttgactggagtgagacaatatctcattgtagttttgatttgcatttctctgaagatcagtgatgtggagcacattttcatatgctgtttcccatttgtatgtcttcttttgagaaatgtctattcagatcttttgcccctttttaaatcagattattagggttttttttttgtttttgtcttgttttgttttgttttttgttgttgtttttttgagtcagagtctccctctgttgcccaagctggagtgcagtggtgcaatctcggctcactgtaactgctgccttccaggttcaagtgattctcctgcctcagcctcccaagtaattgagactacaggtgcacatcaccatgcgcagctaattgttgtatttttagtagagacggggttttgccatgttggccaggctggtctcaaactcctgacctcaagtgatccaccagccttggcctcccaatgtgccagaattacagacatgcaccacggccaaggattattagatttttttttcctatggagtcgtttgagctccttatattctgatgataatcccttgtcaaatggattttttgtttcaatttagtggggaagtgtttggggtctttttactgaaatatataccacagtgtctgccatactgtatatcctcaatgaatataacttgacaaatagaatgaaaaaatagattgtgaataagctgaatttcagcttagagatgacaatttgtctcaatcgctggaagtatgtttcagaaattaagagtaggatcccctgaatcagcaaccttgtttagttacttttaagatcttatgcattacggagaaccagcgatggttaataccttatggcatatatctcaccacagctgaaaatgatgctacctactcgaaatgaatttcataatttgcatctttctcacagttacagaaggatatagaaggtaagttcataatcaaagtcagttattttttgtttgttttgttttgtttttatatgcaagaggacatatttgcagtataactgattataaaagtacaagactggtttttaccctgattgagggcacagctcaatttccttttagttataccatgtgtctttgtagagctgattctgcaggccccaagacaagtccctttctcatattattgaggttctcctttgattgacaagtattgatcagcaactcttttggcaaccttgaaaaatagttgtcttcttgaaatagggttttctacttataggaatatgaccagactcacttaaattaatccataaagatggaaatatagagagaaataatatacctgactgattactgactatgagttaggcatactcagtcctcattcacaccttatgagatgagatatttgtattctgattttataacaagaaaaccagagtttcagaatccaggttcatgatgtttggtaaatagtgagcattcacaaagtgttaagtgcctttatttgtttcaccacctcttccaggtccaacattttattatcatacttgaaaagttaatacaaacataccaagttacccaaaattgagtgtagatttcttgataattagagtaattgttaaagttaaagcattatctacctgagataaatatacttgaaatatatataaaatgagaaaaaatatattttaaaatgcattgggtttaagaagccatatgagataaaacaattggctattttcccattaaatatccaaagtagcctggaaattttctattttgtgagattatgattattataattttatagctggaatcatgctaaaacacatgggacaatggaaaaaatgttttatgaggcaaaatgagctcactttaagcagatgattcagattttatataatgataaaaatttatttcaaagcccacattacatgagtataagaaatttcagctgctgacactgtaaagattgttttcattttacttttaaaacagaccaaaattctgtaggcttccacagatctagtgaatagtaacaaatccagaaattgctgttctgttgcagtggcaatttccttttcaaattgcctaataataggtgttggatttttctccatctcctgtaccgtttaaaaaccatccggaactgtgtctggtatgtagtagttgcttgtttagtatttgtccatttatcaaattagttttcttttactaaaaaacaaaggaatgtgctttcaaggtaaaaatttccacaactcaatagaattgcagttaaaagaaagcttctcttccttcccagaatccaagtcttactctcaaccgaaactggttatggttttttagaatatttcttgttggggctgacagaaagcactcatgtgcatacctttctcctcaaacagtgcattagtaaaggggctttctagatatacgttaccaagttcaaagagaataggaaagcatccatctgcagatgaataccttcagtagatttctacaagataaaactttggtggaagaaagtcgagtgaaaaaacaaatcagagaaagaacactctaatagaagtgcaaagaggccacttgaggaagtcttctctaaaactggggggataaatcaagaaagaagatgggagatccaggaaactgtggacctagctctagatgagatgttgcaacagggctacagagctgtcagtcctgattggagtagattccaccaagtcaatcagtgggctggaggagggaggatttcaggagatagttcaccgtttgatatagattgctgtccttttactttgttaagtacacctatgagaaacaaaaatgaaatcctaagcctgccaactgactgaatggattctgtcttggtcaaggggatctcagggaaagcttggaagttgagttcccagcaataacaggatgggaggttggacaccatctcccatgtgcaatgaaagttttcatgtcccttgcttcaccttttgacaccacagggctgaaaactgtatcctcgaattatgctaacccatttttggaacatgggtcccatagagagacatgaaactcaactgcacatgcccacatttctctacttataaatattcatgactcttcctatagtttattgaatatgtgtatttggccagtctattcaacataaatccctgtcatattcttctgaccctcaaaaagtgtgtttctggcttctggatggaggttacacttcctggcctctcagaatggctacgctgcaggctgcaacctttatgaaaagtaaagctctcctttccaaatttatgaaatttatcattcttcagttgatacatctttttaaatttatgaattgtatctccctcttaaaattagaaaggtgtatgcataggaaattgtggataaactctgtagttttagaaacagcagtaagtgtgctgaggaacaactgagtcatcagtactagtgatcccatagaacacggttccaacagtttgtgtaagatgatggatagacagatagcctgagtggaaaactgacaatccagagctgatggtctctctgcttggagatgaagcctcttcgtatatgagcttacacttataaaaagatataaataaggaaaagtgaagtaaaagaaaaacccatgttgatactctgtggctagaatttgtcatatatggtgttgagagaagaggggacgtattgaaagaggaattggggtagggaaaaaggagggaactacatctcagtctcatattaagccaaattctccttttgccttttgtctcagtttgcggctggatatggctgccgtgaaaacacaagggctctctaatagaaaacaaaacaaaacaaaacaaaaaactgaaaggagcattgctaagttgactctgacttgtttccagggaagacagcttactacaagtgggatagatttttcttcagtgctagtggtttcaggctgtataggcataatgtttaatggcatatttccaggttactgaccaaggagctagttagactaaaacagcattgttgcagagtggattctccaggaaacagacactgagatggaaataagattgtagaatgtttattagaaactgtgtagagatcaacaccttttaaaaaggggtgtggggaagcagcatcaggcagagagagaagtggaactgtgatgtggcatcaacaccttaagctgttgatcaacagcttaagctgacccagaggaagttctggagttgatagggtctggctgcggtgttccccattaggccaaatgtgagagagccattgtacccctccctggatcagacatcagatgagggccacccctgaagagtgagcctttggtcaatggaaggcaatcagaaaaggctgtttgataaagaaaggtagcttgttgcagcactaaaagctgctgaggcccgctcttccttaaaggggacctaagcagtttaataataagcttaagatatcagaagaacttgacaaagatgcagcaaatacaagaaaataaaagaaaggctataaaatatgtgatagtggactaggagtaggtggaggctcagggcaaactgctagaaaggaaatatgatcatgtggctttacctagtcacaataatataaatatcatgtattgcttttgccatttatattcaacctgttgaaatttggaagatttgtgactacaaggctataaatgaatgcatatgatccccatattaatcaaaatttaaaattatagataaccgatattttgaagttgaagatgaaaaggagtgaaaaagagtaggattactaatatcattaaaagataaagttagaaatcagtaaatactgtctatatgaataggacaagaaatagaggtttaagtatattattctgatttacaatgattaccaatagggagagaataatagaataacactttgaagaatagtagaagtatctattccacgaatatttggtaggtggttacatttgaagtgatataggcatggcactttacaattttctcaatttattctactacagttggcctgtttggatataataaccctattgaagaaaagatatttgttctaaattttcaaatttatgtacataaagttgagaattgagagttatttgaattttctcaataatgatatatctcatttatattacttttttatttctctttttgtgtcctaattagtttattaagtagtttatgttatcagttctttcacataaccatatgcttgaattgtattagctttactctatttgtaccttctaaatgttgttaatttctgctttaatcttggttaacttttccccctctgtctcattagaggtatttattttgctttttaaatttaataattcatttaatttatattttcctatttcagtgtgtagcatttaagacaataaactttcttacagtgaatcatttcatagagtttatattttatttccatatttcatagattgtggtttttcatgttttttaactattatatttagatattcttcaattttttttgcttttccccagttttaaggttttcaacttaaagataccttttgaggaggattctatttttaaaatttaacttccactttgatattgttatcaaaaagcaagttatatattatgtgtaaatgtagaattcactgaagttatattgagactattgagacttcatatagaacaaattttgaatatattcccaagagaatttgaaaagaaagtttggattctattttcaggatgtagaatttagtatcttaatatacatataaaatgtcttacattattatttttatttgtttattttatttatttatttattttttgagacagagtcttcctctgtcacccaggttgaagtgcagtagtgcaatctcggctcactgcaagctctgcctcccgggttcacgccattctcctgcctcagtctcccgactagctgggactacaggcgccccccaccatgcccggctaattttttgtatttttagtagagacggggtttcaccgtgttagccaggatggtctcgatctcctgacctcatgatcctcccacctcggcctcccaaagtgctgggattacagacaagagccaccgtgcccagcccacattattattaatatatagagggaccataaattattattatttttgccctgtgatataccatagaatacagtaagatatatgagtcaaagtcacccactcctctgataaatcaatttcattctgctatttcattctcttccaattttgctgtataaattttcaataacaaatctttattgttgattatacagtatgtatactactatcttaatgactaggctttcaaatcaaatgtgctttttattattgtaacaatatctccattctttttgattgaatttaatcaatgtttactttctagattctctgaattattttgatataggcatggctttaatttatggcaatagttttttgacatagtttttttttttcgtgctacattttattttatttattttatttattttttttattatactttaagttttagggtacatgtgcacattgtgcaggttagttacatgtgtatacatgtgccatgctggtgcgctgcacctactaactcgtcatctagcagttttctttcattacatatattttttgataaggaagctccacctaagtgtatggttatttatttcttcttcttgcctcttttcttcccagataaagtggcctggcagtgtagaaggaattatgcaaaaccccttttcacatttctttgagctggagccagctctgcttagtcatagtcacatttttgttactgtttttttttttttccttgtggtcccatacttcttatagttgtccagatttaaggtagcttttctcataatctttaaagacctccaaatttagttctcacagaaaaataaagtcaatacataaaaaagtttgaaagctattcaacgtgtgacctcttttctagctcccttaatattcattcaatttctttgcctcttaaatatgctcatgtctcaatctttaaagtatttcagtggactcttacggctctcaggataatgctgaaactctttcacctggcttatcatgggcttcatggaaggaatgtgctttcatttcctaccttgcttctgaaaacttcccttcttgcactctaccacacattcacactaatatatgctttaggtccttgatcagtttatagatcttatttggatctgtatttgaacaacatataaagaaaaatattttgagaataatcaaggtaatttaataatgattttatgaaattaagacatcattttaatgtttttagatgtgatataatattttgattttgtttaaacaaagaaatcttattctttacatacacatgatgagaggcttatgataatgtctgagatttggttcaaaataatccgaggttggaaagtaggtgaaacaaggctgtctgagcttataattgtttaaactggatgttgaacacgtggtaatcattataccaatctcttgacttttgtatatatttgaaacttttcaaaattaaaaaataacctttttggatcaaattatggaaatgtattttaatatagttttagatcatatataggcatccacaattaatctattactacatatttatataaaatagtataaaaatgcatatataatttttatttatttactttttggattttgaacttttaagttcagggatacatgtgcaggatatgcaggtttgttacatagttaaacgtgtgccatggtgattagctgcacagatcatcccatcacctacagattaagcacagcatccactagctattcttattaatgctctccctcctcccacccctcaacaggctcaagtgtgggttactctcctccctgagtccatgtgttttcattgtacagctcccactaataagtgagaatatgtggtgtttggttttctgttcctgtgttagtttgccaaggataatggattccagctccatccatgtccctgcaaaggacatgagcttgttcttttttatggctgcatactattccatggtatatatgtactatattttctttatccagtctataatcggtgggcattttggttgattccatgactttactattgtgaaaagtgctgcagtgaacatacgtgtgcatgtatctttataatagaatgatgtatattcctttatgtatatacccagtaatgagattgctggagggaatgctgcctctaggtctttgaggaattgccacactgtcttccacaatggttgaactaatttacactcccaccaacaaaagtgttcctttttctccacaacctcaccagcatctgttgctttttggctttttaataatagccattctgactggtgtgtgatggtatttcactgtggctttatttgcatttctgtaatcatcagtgacattgagctttttttcatgtttgttggctgcatgcatgtcttcttttgagaagtgtctgttcatgtcctttgcccactttttaatggggttgtttttttaattgtaaaattgtttatgttccttgtagacactggatattagacctttgtctgatgggtagattgcaaaaatggtctcccattctctaggctgtccattcactctgatgatagtttcctttgctgtgcagagctctttagtttaattagctcccatttttcaatttttgcttttgttgcaattgcttttggcatcttcatcatgaaatctttgctgtgcctatgtcctgaatgctactgcataggttttcttctggggattttatagtttggggttttacatttaggtctttcatccatcctgaattgattttcgtgtatggtgtaaggaaggggtccagtttcaatcttctgcatatgcctagtcagttatcttagcaccatttattaaatagagaatcctttccccattgcttgttttggtcaggtttgtcaaagatcagatggttgtaggtgtgtggacttatttctgggttctctattatgttccattggtctttgtgtctttgtaccagcaccatgctgctttggttactctagccccatagcatagtttgaagtcaggtagcgtgagtgtgatgcctctagattttttttttttttttttttttttcgctttggattgccttgactattcaggttcttttttggttccgtatgaattttaaaataggttttttctagttctgtgaagaatatcagtggtagtttagtgagaatagcattgaatttataaattcccttggacagtatgactattttcatgatattgattcttcctatccatgagcatggaatgtgtttccatttgtttgtgtgatctctgatgtcttttaggtttgtggttctccttgtagagatatttcacttccctgcttagctgtattcctaggtattttattatttttgtggcaattgtgaatgtgagtttattcctgattaggctcttggcttgacagttgttggtgtatctggatgctagtgatttttgaatattgattttgtatatgagactttgctgaagttgcttatcagcttaagaagcttttagggtgagatgatggggttttctagatataggatcgtgtcatctacaaacagggatggtttgacttcctctctttctacttgaatgcctttatttctttctctcgcctgattcccctggccagaacttccaatactatgttgaataaaagtggtgaaagaagacatccttgtcttttgccagttttcaaggggaatgcttccagcttttgcctgttgagcatgatattggttgtgggtttgtcatatatgactcttattattttgaggtatgttccttcaatacctagtttactaagagtttttaacatgaagggatgttgaattttattgaaggctttttctgcatctattgagataatcatgttgtttttgtctttagtcctgtttatgtgatgagtcacttttatttatttgtgtatgttgaaccaaccttgcatgaagtctctttgattgcggtggttaagctttttgatgtgtggctggatttggtttgccagtattttgttgaggatttttgcattgatcttcatcaacaatattggcctgaagttttctttttttgttgtatctctaccaggctttttttaatcaggatgattctggcctcatagaatgagttagggaagagtccctccttttcaattttttggaataatttcagtaggaattgtaccagctcttctttgtaactctagtagtatttgtctggtcctgtgctgtttttttatttatagctgcttattactgcacaatttcagaactcattattggtctagtcagggattcaatttcttcctgcttcagtcttgggagggtgtatgtgtccaggaatttatccatttcttctagattttctagtttatgtgcatagaggtgtttatagtattctctaatggttgtttgtatttctgtggcattagtcgtgatatccccttatcatttctgattgtgtttatttgaatcttctcttttttcttctttattagctagctagaagtctattttattaatttttttcaaaatccaactcctggagaaatacggaacacttcacaaatttgcatgtaatccttgtgcaggggccatgctactcttctctgtatcacttcagttttagtatatgtgctgctaaagcaagcacaaacacaagtcttgactaagccatctaaactatttttcatctctcttatatcataatataaaagatcatagtaaaaaaaatctgtcaacaaagaataaaagacaatactagaccacgtgtttattttatcttgtattttctggatatagattggtcttatcacatagagaactaacagttcccctaatggttcgggtattgatatgcttttagatctgtatatgttttgtcagtaaaacaaagataacagctctttgattctgccaaccaaggttggctctattcttgcatgaagagtcagctttaagtatatttctaaccaccataacatatttttcattgctctgaaatactagcctattttgctcgttattggcttcatgacctgagtcttttacttctgagaccatagtgaagatgctctattgaaaaagggccttcatatttattcatgtgaacaaaatatacatacgaaaatgagtacgcatgtgcacacacatgtatacaggcacacacacaaagataaatatttaacagtgaaccaggctctgcactagaatctgcaggtataacaaagaactctgtacttatgggaggttaaagtttgagagacatgtggaatggaaaggcattgaaaatgatacagagcaatttatcctggccccgcatttgtgccaactgaggagttacaaaaaatactgtttctgggttccactcaaaatcaaataaatcaaaatgtctggttatgggaccaaccgtatgtattttaaaaattttcccaggaggcactaatgtgtaacaaatactgaaaatactcataaagagcacctttatctgagatcaaatgaaatcgtttctgtgccacctttcttccactgcagtcctcttgcttcatactcccagatttagcaagaagaaaatgaattataacattgggataaagggccagttgatggtgcttggagtttattcatgtatttattctgcaaacattcagtgagcacctattatgagctgtgtgctgggcactctggtggtagttgctaatacaaaattaacaagacattgtttctgctatatcaattaggaaagacaagtaagtaatctgtgattacattcctgaatgagaagtgcaacattgtgagggtaaatttaagttaagtaaaagtgtgaaacctggacatgggtttttaaaacaaaaggaagaagttcctttttctcttttctgttttgccatttaattcatttgcagaagaaaacaggtaatttgaccatggattttttgcttattttgaccttctgtttatttttactttttttttctccttgcctcttgtatttcctgtaaactgttagctaaatctagagacttgttcatattcaggttcgagtatgggctggaatacttcatcagtaatgttgagtacttccatcaagagacccatgctacctgttttaagtgtctttttggattttatggaccattattttcattccctaaatccagtattttgtcaagaactttaagtggttattttcttttactccttcttagtatatttgccataattttctatgaagagaaactttctctgattgactagttatgctgcagtacagtgggtataggaaaatcaagataaaggcttgcttctttatcagttttcaaaatgatgagttggtacttgaatatcagttaaagtagactgctgaaggatttttcctgttatcattatgaactaatgtttttaaaaattaatctcctcagtccattacattttttttccctgaataatcccaactttggtcaatgacagccacttcagattggctccagagaactttagacttgaccccggtcatcattgataacttccttgtttctggtatgataaaatgtaaccaacatatcttataccattcctgatctacactgagaaccagtcagcccaacaagtaacttagtgggtgttggtgtttagggactcaatctgaaaacttacctggagttatataacctagggaggatggcagtgcttttctgagaatgagcaagaaaatgggcattccacataggctgaggagtgcatggtggtgtgcaggaaaatcatgccatagagacaacagccttttaaaattctttttccttactatttttaatcctctaaggcatatgtttgcaggctctttctccatggcttacctcctttgatgatgaaaaggtgtgtgataatagcaggcaatcgttttataaattaccacttcatttcatggggttctgtgtctgtcaaggtatatgacaatcaggaaatgcttactgaatagtcactatgctagctttaagggattcaaacaggattaaaaccttatttcacgttgtccttcaggttatttcaatagagtgatgaatgctattgttggagcccagaacaagaaagtaataaattctgcctgagtgaaaaagagaagcagtcatgcagtgagttttcataaaggtcttaaaggaataaaactttggtgtgtgtgtacgtatgtaacaggggatagggagttggggcattatttaaaacagaacagctgtaataaagacaaagacacagtgatttaaaagtggaaaggtagtagatccaggtggttagagtatagagtgcctgggtggaagttccaacattatgctgagaagacactttcagtcagtttgttggtgtagcaaggtcacttataaagttattatctaaacttgaataatcacagttggcattaaatagagaggcatatattatgagacactgtacaaatagaacagtcattctggtgagtggatgtgaggaaagatttaaatatgacaacataattttgttatgatgactgttattagagcttggatgataatggagtgagaccaaagtagggtagttagagctcagaaatagccagacaagacagagaaggatattaaaggatttttttaaaaatcacaaaacataaagaaatcaaaaagtagacaatcaagtatccaagaaatttactggtaaatgtcagataattggcaggaaagctattgaggttaaatgttcaacaacacatccatccatccatccatccatccatccatccatccatccatccatttattcattcattcgtaatcatttactcaatgattatcaaggcctattatgttcatgtgtcttgcaagaaacacatagaaaaataaaacttggtcccaccctttgaaatggtgtaatacagtaatagataactgagattcacagccacaactttcagtctagtgttggttttgtcagatcacccctggacagtccatctcactgggtacactttgactctgtatgttaaaccaaagtaattcggcagtcatcccttttcactaaatgttgacactaggtgatcatgaatagtctctgggcttgggcagggccatttgggaattaccattttggaacacccatgtgcttctgagcatttttttttaatttcaacttttattttagatagagggggtacccgtgcaggtttgttacatgggtatattgcatccaggtagtgagcatagtccccagtagttagttattcagcccacatcttctccctcccccctccccccccccccactctattagttcacagtgtctgttgttcccatctttatgtccatgtgtgctcagtgtttaattcccacttataagtgagagcatgtgatatttggtattctgttcctgcattaatttgcttaagattctggagctgagcatgctgttgatcaagtctgtccacatcaaatgtcaaggattcaaaacaccctatcatataagatggccattcactttttacagtccagacctcaagtcagtggtgtacttccattactaatggagaaggtgtgtcccaactcctgccctagattcataccatagctaagtaaatgaaaaattctcaaaaaattatctacttattaaaataagcataacttattttctgtcaaacaccaagtattttgcatctgtttgtaaatagagcagtttgcaaactacaagtgcgcatttcaaccgattcctagtcttttcactctctctttatgttcatctttcttaatatagtctcaaaacacccccaaggggattggtgctgattcttgcttattttatatcaaaattcttgagagcttgttcctctgaaacagggctctttttttccttcattttaaggcatcttctctgactatttcctgctgaaaaaaaaaaactaataataacctcccacctcttgcactaatttcccactgataatgggatcctggtcatggactttctgcctaagatcacttttaatattttttccctaaaaatacagatgaaggacttcaaagctcttttgttgttttttatacttttcccacttgaggagttacacaactcttgctgctggacattcaactcatattgaacacaatacttgtacacaaattagcaatttctgttgactatcccttgagaaagagaaatgtcagacatctgatctcccccaaacaaagtgatgattataaaaattatgtaaaaaatttcacaatgccttacaccaatgtattatgtacttcttcacatggctatgaagaaatacccaaggctgtgtaatttataaagaaaaagaggtttaatggactcatatttccacatagctgggaaggcctcacaatcatggtggaaggtgaaggaggagcaaagctatgttttacatggcagcaggcaagagtgtgtgtgcaggggaactgccctttataaaaccaccagatcttgtgagcgttaatcactatcatgagaacagcatgggaaagcccacccccatgattcaattgcctcccaccaggtccttctgaagacacattagggattatgggagctataattcaagatgagatttgggtgaggacagagccaaatcatatcattctgcctctggcccctatcaaatgtcatatcctcacatttcaaaacgaatcatgccttcccaacagtcacccgaagtcttaactcatttcatcattaactcaaagtcccacagttcaaagtctcatctgagacaaggccagtcccttctgtttagagcctgtaaaatcaaaagcaagttagttacttcctatatacaatgggggtacaggcattgggtaaatacacctgttccaaatgggagaaactggccaaaacgaagggtctataggccctatgcaagtccaaaatccagcagggcagtcaaatcttaaagctccaaaatgatatcctttgacaccatgtctcacatccaggtcatgctgatgcaagaggtgggctcccacagtcttggccagctctgtctctgtggctttgcgggatacagccctccctgctggctgctgtaataggctggcattgagtgtctgtgtcttttccaggtacacagtgtaaactgttggtggatctaccattctggggtctggaggatgggggccctcttcttgcagctccactaggcagtgccccagtggggactgtgggcgtagggagctctaaccccacatttgccttccacactgccctgtcagaggttctcaatgagggccccatccctgcagcaaacttctgcctgaacatccacgtgtttccatacatcctctgaaatctaggcagaggctcccaaacttcaattcctgacttctgtgcactcacagactcaacaccacatggaagctgccacagcttggggcttccaccctctgaagccctgacctgagctgtaccttggcacagtttagtcaaggctggagcagctgggacacagggcaccaagtaccaaggctacacacagcagtgggggcctgggcccagcccacgaaaccattttttccttctaggcctctgggcctgtgatgggaggggctgctggaaggtctttgacatgccctggaaacattttccccattgtcttggcagttaacatttactcctcattactatgcaaatttatgcagccagcttgattttctcctcagaaaatcagaagatgggtttttcttttctattgcattgtcaggctgcaaattttccaaactgttatgctctgcttcccttttaaacattccaaacattttaaatgttccaaaccatatctttgtgaatgaataaaactaaatgctttaaagagcacccaagtcacatctctaatacttttctgcgtagaaatttcttccaccaaataccctaaatcatctctctcaagttcaaagtttcacagatctctagggcagggtcaaatgctgccagtctcattgctaaagcataacaggagtcacttttactccatttcccaacaagttcctcatctccatcagagaccacctcagcctggactttattgtccatatcattatcagcattttggtcaaagccattcaacaattctctaggaagttccaaactttcccacatcttgtcttatgagccttccaagtttttaggaagttccaaactttcccacattttcctgtcttcttctgagtcctccaactgttccaacctctgcctgttacccagttccaaagtaacttcaacatttttgggtatctttacagcagcaccccattacttcgtactaatttactgtattagtccattttcatattgctatgaagaactacccaagactgggtaatttataaagaaaaagagatttaatggactcacagttccacatgactggggaggtcttataatcatggcagaaggcaaaggaggagcaagggcacatcttacatggtggcaggcaagagaacatgtacaggggaagtgccctttataaaaccttcagatctcatgagacttattcactatcatgagaacagcacaggaaaacctgcccccatgatgcagttacctcccaccaggtccctcccatgacatgtggggattgtgggagctacagttcaagaggagatttgggtgagggcacaaccaaaccatatcaaccaaaaagctccagtttctgtaaatgtgttcatgttattgcactagtcaaatctgcagagaatctacactgtcttccacaaaggctgaactaatttaccctcttaccaacagtgtataagtgttcctttttctccacaaccttgccagcatttgttattttttgactttttaatagtagttattctgactggtgttagatggtatctcattgtgattttgatttgcatttaatgatcagtgatgttaagctttttttcatatgcttggtggccacatgtatgtcttcttttgaaaaatgtctgttcatgttatttgcctactttttaatggggttgtttgttttattgtaaatgtgtttaagttacttgtagatgctgaatattagacctttgtcagatgggtaaactgcaaaaattttctcccattctttaggttgtctgtttactctgttggtagtttcttttgctgtgctgaagctcttcagtttaattaaatctcattttttcaatttttgcttttgttgcaattgctttgggtgtctttgtcatgcaatttttgctcgtacctatatcttgaatgctattgcctaggttgtcttccaggatttttataggtttgggttttacatttacattttacatttaaaatccatcttgagttgatttttgtatatgatgtaaggaaggggtccagttttaatcttctgcatatggctagcctgttatcccagaacaatttattgaatagggaatcctctccccattgctggcttttgtcaggtttgtcaaagatcagataattgtaggtgcacagtcttatttctgggttctctattctgttccattggccctctatgtgtctgttcttccagtaccatgctgctttggttagtctagccctgtagtatactttgaagttgggtagtgcaacgcctccagttttgtttcttttgtttaggattgacttgacaatttaggttcccttttagtttcatatggattttaaaatagttttttctaattctgtgaagaatggcaatggtagtttaatgtgaacagcattgaatctacaaattgctttgggcagtatggctattttcatgatattgatacttcctgtccatgaatatgggattttttttaatttgtgtgatctctgatttctttgagcagtggtttgtagttcactttgtagagatctttcactttcctaattagctgtattcctaagtattttatcctttttgtgacaattgtgaatgggagttcattccttatttggctcttggcttgactgttgttggtgtataagaatgctagtaattttttcacattgattttgtatcctgagactttgctgaagttgcttattagcttaagaagcttttgagctgagatggtggggttttctagatataggaccatgtcttctgcaaacagggatagtttaacttcctctctttgtatttgaatgcctttatttctttctcttgcctgattgccctggccagaacttccaatattatattgaatagaaatggtgagagagggcatccttgtctggtgctagttttcaaggggaatgcttccagcttttgcccatttagtatgatattggctgtgactgccctatctttcaacattactctaaacacagcattcttttgtagttatctctggctcttcctactccttccaaaggccaagatgtacactctggatgattacacagtactttaaaagtacttcaaaggtaattctttttatcattatctcatcaaggctgtataatccaggtggacaggaccatttgtcttttattcttagcatatttttagcatatggagaatactcaataaaatttgataaaatttcctttttagctcttagtgcagtcattacttgcttactaggttattacgcatgaaatccaagattacagaacacttagaagaaggtacatttcttatatttttgaaaccaaattgtatacaaagtaagcacagtttgagttaaagttgtttcttggatttattcttacttatgtttatttaaaatttgattataagaagatatatgccaatagtgcagatgtaaaaaaaaaaaaggaagacttaaaatttactgctatctactgttaagtagctctgagttcttaaaaatgtaattatgtttgtaacttgttaaattgaaggtttttaaaccataaaacccataacaaataagatttatcgtatttccaattccatgctgtttgagaaatacatttttttctgaaggcttagcaaataaatatttaagttgaatataaacttgaatttttcactaaacttttaaaatatgcttattaaatgttcttattccttaaattacaatgtaactttggatgacttgggtggttttgagattatttgaagaatctcttttttcaaaagtatgtattaaggtataaccagtccaccaattctgttacttttctactgatgtttttaagaaatttgacttaatagaggcttacaaatggctccttaaataggagataggcgaactgaatggaatagacctaattccccaaatattagtttaaaatttacttcaaaaagataaaaattagtttatacttgaggaatattttcaaaactgaattataaaatgaaattttaggagttgatttttgacttaggtaaccagtatttgatgattttcatgctcatacaaatattatcaaattgaaacatctctttttctctgaaaggccaactttgtttctctgtggaattcctcactgttttatgtgtttggtcacatccaaaaagtttgtctttttgagttcccccttttctgtagatattctccttggcgtttcaccatagtccatagacgttagatcgtcttctccaccatgtatattattcaggtgatgggtgctctaaaagccctgactttacccctatacaatatatgcatgtaacaaaattgcacgtgtactgcgtagatttgtacaaataaaaagggggaaatatattattggtcaccaacaaaaagagcacatgaattggtgaatcttaactaaaaagagaactgcaaggcaattgatgtgttaattagtgtaatgtggcaatcatttcacaattcatgtgtatgtcaaatcattacactgtatatctcgaatatatccaactgttatttgtcaagtatacctcaacaaggctggaaaaaatgggaaaataaataaataaatgaaatgatgagcaataatattttataaatgtccttacatgaaagaatattttctctttggattttttctgatccaagtaattgcaattgcaaaaaccaggaatcactaatgtagagatatggatggccaatttgggttgcttatactatgactatatcagaaatgcagcttattcctttctccaaatagtccctgagattttgcagatgtccatacagcagaaataggtcttagtttgtggcttgcatgcaaatatacaaagcttgattgtaggcataaccccttttttcctatagatagtttatgagaatgttgcaatcaaaaccatgtcctaacattcccagtgtgctcccaaatcccttgtcccagttagcatttagttatgtgagcaaactgatttcacaatgagtccatgagataactgaatctgtctccagaattttagtgtgatcgtgcttaatagcaaatgaccatttaaggtccccacccaatcctaaaacagccttctggatttcaagaagctatataatagctggttatgccatcattaagcctcaattaaatgattattaaggcctttctgtgcttggagttatggggaaacatagaaatgaatgcaaaagttataatcctttcaaaatattttttattgcttgcgcttgattacatattaaaagattttttttttctttttttgagacagagtctcgctttgtcacccaggctggaatgcagtggcctgatctcagctcactgcaacctctgcctcccgggttcaagcaattcttctgctcagcctcccaagtagctaggactacaggcacatgccaccacacctggctaatttttgtatttttagtatggacggggtttcaccatattggccaggctggtctcgaactcccaacctcatgatccactctcttgggcctcccaaagtgctgggattacaggcatgagccaccctgcccgtaatgcactcttgtactttaaaggaagaaatgaagaattaaaggaatgaagaagccaaaagattttatcaaggcagagctatatctattaagccttcaaagctaaacttgtttttcccgagttgtcaatgtcccagataaaataaaatttgatcttgattagccttttattaaatagaccaataaaaagttaaaattattatgtttgtaaaatgtattttgaataacatggttcagatattttcatatagcagtaagtatagattggaaataatataaacagttaaacctggtcattgtactacttataaccttaaaaggaaataaaagtataaatgggaataggaatagattacctactaagaaatgatatgttataatagcaagaataaataatttgcctatttcttaatgatctgaacaaaatgtgtttttcagagattttttgaatcagaaaagtgtacctataacatattctatctaagaatttaaactggtgataaaactggaaatagaaaagaataaagattgcttctaaatagaaaatgcttaaaaccagcagtatttattgatattttgtgcaataaaagaaaatgaaagatgcagttatttcagctgctttctcaggtaaagctgtttttaaagaaaacttcttaaagctatggctaacccagctcccacgtgaaatgactttttttatgacattttcaatgtaccttcaatgcatgtacttctagtctaaattattagcctaggctactttccctttactcacctcagatagcatttttcaagaaataaacttatgtacatcacaagtggaaaataaaaccacgttctatttcttcatttataggaggttgaacttctctggagtgctagagctatagatttttctggatgtgtgcttcagagtgaagtcaagtgatattacttttctcttaaattaccaaccaattgaaaaaaaatccttagttctaaatttcaaattccaccgatatcataagtcatacaaaagcactttgcttttcaccctttattttttaacattgtctatatgggaatggacaactcttgattactacagctaaattgtcagttttatgaattacttcctataaaaatgacctcctttgccctgcaagtatagtttttttgttgtttttttgtttttgtttttgtttttgagatggagtctcactttgtcacccaagctggagtgcagtggcgatatctcagctcactgcaacctccacaccccaggttcaagcgattctcctgcctcagcctcccaggtagctgagattttaggtatgcaccaccacacccggataatttttttcacatttttagtagacacagggtttcaccatgttggccaggctggtttcaaactcctgatctaaaatgatccacccacctcggcctcccaaagtgctaggattacaggcgtgagccactgtgcccagccaagtgtagcgttttttaatgcaaacaagcatatgataaggaatttaaaaggaggctgcaaaaggtcagaaaaattgtacaaacctatttcaacatggagttctttcttgagtctctttattactttcacatttcctgcagaaagctaaaagttcactagcaacagtgcataaaagaaataatagtaaggcggtgtaatcactaaggagctgaagcactggcatctcttaaaatgctggattacctcagtgctgatcagtggaaaatcaaaaaggatgagaaggatgacaaacacttttgagctctgaatgaagaggatactgccttgctgaaaaatcgtggtcagagcacttattctaggcagattaagcaggttgagaatgacattcaacaacttcttaagaaaattaattatctcagtagtgttaaagagtctgacactagcctggccaccaccagcactctgggatttggctgcaaataagcaaatgctccagggtgaacaatgtttacaggttgcaaggtgtagaaagatagtaaatgctgattctgagaactcaaaatacattgtcaatgtggagcagattgctaagtttatggcagacctcagtgatctactgacattgaggcagggatgaaatttgatgtggaagaatgtaagtattaaattcatattcccatactttctaagattgatccaacaattaccatgatgccagtggagtaaaaacctgatgtcatatacagtgatgttgttggctgtagggaacagattgagacattgtaagtagttgaaaccccactacttcatccagagagatttgttaaccttggcatggagcctcccaagagtgtgctctttggtccactaggtgcaagacactctgtgcttaggtggttgctaaataggactgatgcttgcttcattgagttattggatattaacttttacagaaatatatctgcaaaggggctggaatgattcatgagctcttcccaatggccagaacaagaaacgcctgccttatcttctttgatgaaactgatgctattggaagagctcagtttgatgatggtgctggaggtgacaatgaagtacagagaaaaatgtgagaactaattcatcagttggatggctttgaccctcaaggcaatattaagtgctgatggccactaacagacctgatactttggattcagcactgatgaagccagggaaattggatagaaagattgaatttagtttacctgatctagagggtcagactcacatctttattttttttcttttttttaaaattatactttaagttttagggtacatgtgcacaacgtgcaggtttgttacatgtatatacatgtgccatgttggtgtgctgcacccattaactcgtcatttaatattaggtatatctcctaatgctatccctccccactccccccaccccacgacaggccccggtgtgtgatgttcccttcctgtgtccatgtgttctcattgttcaattcccacctatgagtgagaacatgcggtgtttggttttttgtccttgcgatagtttgctgagaatgatggttttcagcttcatccatgtccctacaaaggtcatgaactcatcttttttatggctgcatagtattccatggtatatatgtgccacattttcttaacccagtctatcattgttggacatttggcttggttccaagtctttgctattgtgaatagtgccccaataaacatacgtgtgcatgtgtctttatagcagcatgatttataatcctttgggtatatacccagtaatgggatggctgggtcaaatggtatttctagtactagatccctgaggaatcgccacactgacttccacaatgattgaactagtttacagtcccacaacagtttaaaagtgttcctatttctccacatcctctccagcacctgttgtttcctgactttttaatgactgccattctaactggtgtgagatggtatctcattgtggttttgatttgcatttctctgatggccagtgatgatgggcattttttcatgtgtcttttggctgcataaatgtcttcttttgagaagtgtctgttcatatccttcgcccacttgttgatggggttgtttgttttttttcttgtaaatttgttggagttcattgtagattctggatattagcccttcgtcagatgagtaggttgcaaaaattttctcccattctgtaggttgcttgttcactctgttggtagtttcttttgctgtgcagaagctctttagtttcattagatcccatttgtcaattttggcttttgttgccattgcttttggtgttttagacatgaagtccttgcccattcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccaggaccatttattaaatagggaatcctttccccatttcttgattttgtcaggtttgtcaaagatcagatagttgtagatatgtggcattatttctatgggctctgttctgttccattggtctatatctctgttttggtaccagtaccatggtgttttggttcccgtagccttgtagtatagtttgaagtcaggtagcatgatgtctccagctttgctctttttgcttaggattatcttggcaatgtgggctcattttgcttccatatgaacattaaagtagttttttccaattctgtgaagaaagttattggtagcttgatggggatggcattgaatctataaattaccttgggcagtacagccattttcactgtattcctatccatgagcatggaatgcccttccatttgcttgtgtcctcttttattttgttgagcagtggtttgtagttctcctcgaagaggtccttcacatcccttgtaaattggattcctaggtattttattctctttgaagcaattgtgaatgggagttcactcatgatttgactctctgtctgttattggtgtataggaatgcttgtgatttttgcacattgattttgtatcctaactgtttgccgcagttgcttatcagcttaaggagagtttgggctgagacaatggggttttctaaatgtacaatcatgtcatctgcaaacagggacaatttgacttcctcttttcctaattgaataccctttatttcctttttccgcctgattgccctggccagaacttccaacactatgttgaatcggagtggtgagagagggcatccctgtcttgtgccagttttcaaagggaatgcttacagtttttgcccattcagtatgatattggctgtgggtttgtcatagatagctcttatcattttgagatacgtcccatcaatacctaatttattgagagtttttagcatgaagggctgttggattttgtcaaaggccttttctgcatctattgagatgatcatgtggcttttgtctttggttctgtttatatgctggattacgtttattgatttgtgtgtgttgaaccagccttgcatcccagggatgaagcccacttgatcatggtggataagctttttgatgtgctgctggatttggtttgccattattgtattgaggatttttgcatcaatgttcatcagggttattggtctaaaattctctttttttgttgtgtctctgccaggctttggtatcaggatgatgctggcctcataaaatgagttagggaggattccttctttttctattgattggaatagtttcagaaggaatggtactagcttttccttttacctctggtagaattcggctgcgaatccatctggtcctggacgttttttggttggtaggctattaattattgcctcaatttcagagcctgttattggtctattcagagattcaacttcttcctggtttagtgttgggagagtgtatgtgtcgaggaatttatccatttcttctagattttctagtctatttgtgtagaggtgtttatagtattctctgatggtattttgtatttctgtgggatcagtggtgatatcccctttatcagtttttattgcgtctttttgattcgtctctcttttcttctttattagtcttgctagcggtctatcaattttgttgatcttttcaaaaaaccagctcctggattcattgattttttgatgggtttttttttgtctctatttccttcagttctgctctgaccttagttatttcttgccttctgctagcttttgaatgtgtttgctcttgcttctctagttcttttaattgtgatgttagggtgtcaattttagatctttcctgctttctcctgtgggcatttagtgctataaatttccctctacacactgctttgaatgttttccagagattctggtatgttgtgtctctgttctcattgatttcaaacaccatctttatctctgccttcattttgttatgtacccagtagtcattcaggagcaggtttttcagtttccatgtagttgagtggttttgagtgagtttcttaatcctgagttctagtttgattgcactgtggtctgagagacagtttcttataatttctgttcttttgcatttgctgaggagagctttacttccaagtatgtggtcaattttggaataggtgtggtgtggtgctgaaaagaatgtatattctgttgatttggggtggagagttctgtagatgtctattaggtctgcttggtgcagagctgagttcaattcctggataaccttgttaactttctgtctcgttgatctttctaatgttgacagtggggtgttaaagtctcccattattatagtgtagcagtctaagtctatttgtaggtctctaaggatttgctttatgaatctgggtgctcctgtattgggtgcatataagattcatacttgttcaatggatgttgaaagataccagatttgcatggttagcacaactacatctatacagcactggggctgagattagacgcttttgtgtagaagctaggtttttttgttttgttgttttgtttttggttttggttttggttttggttttgaaactgagtctcacactgtcacccaggctggagtgcagtggcacaatcccggttcactgcaacctccgcctcctgatttcaagcgattctcctgccacatcctcctgagttgctgggattataggcatgtgccaccatgcccagcttattctgtatattaagtagagaccaagtttcactatattagccagactgatctcgaactcccgatcaggaactctcgatccctcaggtgatccacccacctcagcctcccaaagtggtgggattacaggcgttgagccatgcctggctgtagctggtatgtttttgatcagagcatggtaaaaaaatgctactgaggattgcttggaagacgtaaataagatcattaactattatgccaaattcagcactactcactgctaacatgacatgactgagccctgaaggctttcaaatgaaaacacatcttttcattggaatcctaactttgtatggagttgttaataaccacttcacaaaaaagacttcaacattataaaataataatagtaattgtcatttactgaatacgtgatacttgtgccaagttactgtgctgaccatttatgtttatttgataaatatttattgagtacccactatgaattaggatgaggaagatgatcactgccttcaaggagcatataatcaaatataaacagatatgcccaaggcaatgataaggagactcagtgggaattatgaaagcaccgactagcctgaggtaaagctttctggaaaagtttttgattgagctccatattaaagaaattagaagattgcatttgaagatgaagagaaatgacatcctaagcaatgaatttgtgtggacaaaagcattgatgagaaaacactatctgtgttcaaagaactacaaagaagttagtatttgaaaggtcagaactgagaagacctgaggctggaaaggtatgcagaattaaaatcgtgtaagaattggcatgacattttaagatacccaaacttttttctgtaggtgagagaaatcaatcaagactttgaaaggccatacatggcatatatgcataccttacatacatgtcagggtacagtttgtatttatgaagatgtattagttcaggctgccctgtcaaattgtcatagatagggaagtttaagcaacagcaatttattttttgcacagtttaggaggtagagaaatcaatcatccaggggctggcaaagcaagttttacctgaggcctcctctcagctggtaggcagtcgccattttgctgtgtgctcacgtgacttctttgtgggagcaaagagagagcaagctctctggtgtctttccttatgaaggcactaatcctattatgaggattctaccctcatgacctcgtctaactcattacctcccaaaggccccatttccaaatacaatcacattggaggctggggttttgacatgggaatgtattgagacacaaacattgagtccataacaggggagaaggaaagaaacagaagagcagccgtgaggtgaaatcagtgggtttgaatggtcatttgattgattgattgattgattgtagctcagagagaagatacagtctacttttttctctacccattgtaacccatcaactctatgccaccaggtgaggctactgcactagtcttcatcctagttcccttcctgctctttacccaacccccaccatcgtctccactaccagccctcattccaccaccctcctcagcactattcagctcctttctagtacctgattctctcccaatttaggacatttgcacattctagtggagaaaataggtaagtatacaaataaatgcaactcagtatgctaagtactactgaatcacagaagttactaatggtagtatagtcagttctgttataaatatgacatacatgttcctgaaaaattatcacaccatgtagaattacacaatttaaaaaacacagggctaatgatcaaatgggcttggagttcagcattcaaaaattttgtcactgccatatttttaaaaataagaatctaatgaaaatgacaatgtttgtgtgtgtgtgaatagttaagaaacacatacatgatacaataatgtgggtatttttaccataaaatctggtttgcttttggaagtgagtattaaaagggttgcagcttgtgaattattaggaagtaggaggacagtgagctgaaatcagaggaaaggttgtattaggtgcagataggtgtggcttataaaacacccagtgaatggagagagctggtgcatgtttgtggtatgtgtggattagggtacattttgtgtatctccacttagcttggacacagctggtgcagtttttttgcattccccacatgtttctcatggaggaaatcatgcataagtaaccttaatttttttctttttatcaattcctttagaacaaatttactttttcaaaacaggcattatagcaaaactgacaataattgtgccatgaacagttggaaaaattatcacaaaagtggtgaagtaaactgagccttctaacatgaaaagctatatatcagcagaaaagaggaaagggaaccaggccaaggaaacaacatgcatagaggggaccaagtgtgaaagagaacatcatgtttggcaaactgccagcatgttatttagctatattaatacatcatattgtttgtttgtttgtttgtttgttttgagactgggttcagctctgtcgcccaacctggagtgcagtggtgcaatctcagttcactgcaacctccacctcccgggttcaagcaattctcctgcctcagcctcctgagtgtttgggattacaggtgcatgccaccacgcccagctaatttttgtatttttagtagagactgggtttcaccatgttggccaggctggtctcaaactcctgacctcaaatgatcctcccatctcggcctcccaaagtgctgggattttaggcatgaaccaccacacccaaccattacatcataatgtttttaaaagttttatcaaacatattttcatcatcataagtgttgtaattcacttccttttccaacatttgattatttatttcttattccccccaatgacgggaaaaataatttgacttcatttgatgtctaaaaccttcattttatatatgtgcctttctttttgtgtaacccacctaataacatggcaacattgtaaaaatttcaaatactttcactctaactgaattaactttgccttgacattaaatattacaaatagtctttccatgttagaaaatatctttcacatactttgaaataacaaaaatggcaacttcatgaattctaatccaggggtaatcatgttttcattttttgtgttctgatatattacaaacttgatggtttaaattaatgttaattagaatttttaattcagccaaagaaatattgttccttgaggtttaacctattctatttcaaattaacaaaatacaaaatgtattcttatattacatggattcattaaatcaattaatagtcacttattaaatgcctaccatatgcataaaatgatcttagggtctatgagtctatttcatttcatttcatgtcttataatttccaatgttccctcttgttgagtattgtatatctgtactcagaacactcttgatagaagcacatcgaatgggaaaaaatacccgagtgaaaacaacattattatttcactcaactgattaggttaattgatttcctgatagacgtaggccttattccacatggatgatcaaatttattatagtttccgatcctttgagaacactgaaatctaagttttacagtgacttactgctttatatagacaagtatcttgtttagctcagttacttgaaacacaaaaaattgtaataatttaaaaaatgtgttgcataattggcaaaattactgaacctattcaaactacttgtagtacactgaattttttagggttctatgaagtactctacagaagttttctagaaacttcttttattttctgcaaaaattctgtaattttttttgtttggggtattcactctctcactacatcttgaagacagttgtgtcattgaaattgctgagattgttaatgtaatgactgttataatgcaagctctgttaggtaaatcctttgattcttatttttatttctcatgatcccatccacctttttgctcagttcattttttgggcactttacagacagaaataatatgagaaagataatatactcataatcagttaattctactctttttggggataaataaaagaaaaagaatttaaatggacaaatggacactcaaagtatttcatttatttaattcctcccccaattgccattgatgaactaagctacttctcactcctcatagtttttttttttctttagcttaggaacgcatatttgtaatatgaaacaatgctggataagacttgcctttctgtgttaaataatatgtaatattcatcagtatagaatttatttggaagaggccttggaattccataatctagaatgttaggtgacaaaataacaggatacaaataaaggcaaatatgtatccaataagataatttcaaaatatactacaatgttgtagtaatcgaaacagcctgatgctggcataaaaacagatatatagattgaaggaacaaaagagagaacccagaaatacaaccacacatatgtgatcaattaaagtgtcccaagaacacacaatggggaaaggaaaatcacttcgataagtgttgctgggaaaactggacatcttaatgcagcagaagaaaaaaacttgattcttgttttaccctatatacaaaaatcaactcaaaattgattaaagatttaaacataagacctgaaactgtaaaactagtagaaaaaaacatagggaaaaagctttttttacattaatctgggcaatgcttttttactataaccccaaaagcaaaggcaacaagagtaaaagtagaaaaataggattgcatcaaactaagaagctttttcacagcaagggaaacaatcatggagtgaagagtcaacctatgaaatgggagaaaatatttgcaaacaatacatctcaaaatgggttaatatctaaaatacgtaagaaactcaatagcgaacagcaaataatctgattaagaaatggttaaagggatgtcgaaagaatttctcaagagaagacatacaaagggccaacaggtatacgaaaaaaaatttcaacatcgctaactatcaggaaaatgcaaatccaaaccgcaataagatattaactcatacactattagactgactcatacacattggaatgactttttttctttttttttttaaatttattattatactttaagttttagggtacatgtgcacaatgtgcaggttagttacatatgtatacatgtgccatgctggtgcgctgcacccactaactcgtcatctagcattaggtatatctgccaatgctatccctcccccaacccccgaccgcacaacagtccccagagtgtgatgttccccttcctgtgtccatgtgttctcattgttcaattcccacctatgagtaagaatatgcggtgtttggttttttgttcttgcgatagtttactgagaatgatgatttccaatttcatccatgtccctacaaaggtcatgaactcatcatttttatggctgcatagtattccatggggtatatgtgccacattttcttaatccagtctatcattgttggacatttggcttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaagggttgaactagtttacagtcccaccaacagtgtaaaagtgttcctatttctccacatcctctccagcacctgttgtttcctgactttttaatgtttgccattctaactggtgtgagatgatatctcattatggttttgatttgcatttctctgatggccagtgatggtgaggattttttcatgtgctttttggaatgactattttcaaaaagacaaaagatagcaagtgtcatcaagtgtggaaaaaaaacagttttacagttgatgtgaatataaattggtacagccctgatggaacagtattgaggttcctcaaaaaattaaatctggaacagctacatcatccagtaattacactacttgtatattgaaaggaaatgaaatcagtatgtggaaatatcatcactcctctgttcattgcagcattattcacaacatccaagatatgaaatcaacctaagtttccatcagcgaatgaatggataaagaaaatgtggcacatataaatacagtggaatattattgagccttaaaaaatggaggaaatcttgtcttttataaccacatggatgtatttagaggacatgatgctaaattaaataagcgaggcacagaaagacaaatactacatgatctcatttacatgtggaatctaaaaaaatcaaatccataaaagcagataataggatggtagttggcaggggctgaagaatgggagaaattggaagatattggtcaaagagtataaagttgcagttttgcaggatgaataagtttgggagacctaacctacagaatggtggctatagctagtgctgggagagtagaccttaaatggtctcatcacacaaaaatggtaatggatgtgttaagtggcttcattatggtaatcatttcttaatttgtatgtatatcaaaacatatacaattataaattgtaaatatatacaatttttatctgttaattatacttcaataaagctagaaaatttaaaaacaaaaaaatttaaaaataaatttctaaggtaaaggaactattgtttttaataaaattaactgtttctcacatgcatataacatagaaatccatctttaagtcttatagccaaatattaaatattttaaatcagaaaattaaagagaagaaagtggatgataaattctaaagctggattatgaggacccagattttggagatattggtgatatcatccattaattcacattttaaaataaatttatcagtgaagcaaagttatagaaatgtaactatataggtggaaaatgacataactactttcaaatggtggaattgctaattttttatctttgtaagactgatttttgaggttaaaagaaaaagaaatctagcatctccaagcattttatagtaataacattttccaggcaagtcaaagcactgtttgaagaatttccacatgtctggcatttattaaacctaaaagttaaaattactttctttagttttattagactacaaacattttgtattgtttgtcaggataactttatatgggatctagaaatgataaatgggcttgtgatgaactctcctgaaggaaagccaaagggactttggtttctgtcatatataaaatacggcattctggtttacaaggaggttatctttgtccacagatcactcttgagatagaatctagggcactctggccatctctggctatttgcaagtacagattatatttcagttctctaaatgtttttgctggaagaaaatctgtgcactttaatcatagtttattttcatcattaagtagttgaaatgacagtgaattgagaaagattcaaaaacaaagagtaagacttccaaatcattatctgattatattcctaaggagctaagcacagccccatttaattaaagaaagagcaaatgagcaccttctaaaccaaacatgctgggctttcttcctcccccctcccctcatatcttgtatagaagtggtgaggcctatatcagatggattcctggggtgctaggaaagcaatagaagagagtgagtcccctggaggaaagggaggaaagggatattccaggtagatagaaagcacatgcaaaagaagtgatactaaaataactggagtgagaaaatatagtccaactttctcatgtgcatagatacaaaaatcctaaacaagagcaaaatattagcaaatcaaatgcagtgattcatagaaagtataaaatatcatgatcacattgggtttattctagaaatgcagatatggtaaaacatttaaaaatataccaaaatatttcacaataaatgagaaaaaattatacatcagtagatatatttgaccaaattcaatatccaatcatgatttttaaaaaaaactttggaaaatcaaaatagaagggatgtctttaatgtaacaagtttctgaaaatagaaaaacatgcacatgagtaaaatcatgcttagcaatgaattattgaaactttacgccttgaaatgaagagtgagaaaaagatgcacattctcaccacttatatttagtattacactagatgtcatagccactgaagacagaaataaaaaacatccctatttatagacaacttgattgaacatatagaaaaatcaaaaacaatatggactgctcagttagaattagttaagaagttccagaaggtcaatatacaaagtcatttttcattctatgtaccagcaatagcaatcaaacatagaatatgaaattttaaaggggtatcacttagaatagcttttacaattctaatgtttcagcataaatctaatggaaggtgtgtaagaccactaccctgaaacctgcaaaacctgttcatggatttgaagacctaaatatcatttctcacaaattaatctatagatttagtgaaatatctatttctcacaaattaatctgtagatttagtgaaatatctatttcaactatttctggtattcatccttttgctgcagaaactgaaaagctaaaaatgcaaagtatgtagcattattttgcatgtgtatgttgtaacaggtatggcatagttcaggatctggctgtttttctaaatgcttgagtcttgttggttgtagcagtgacagtgatggcagattatctggatgtgtcaatgtaatcacaagaatccttctactggagaggaaggagaatcaaagtaagaaaagggagacatggtaatggatccacgaagtgggatgatgcactaagttgaaggaagaggccatgagccaagggtggtaggtagcctctagaagttagaaaaggcaagcaaacaaattatctcctgaaatcttcataaataacatagcccaaccacaccttattttaaatgtctaacttccaagatcatcagagtaaatttgtgtggttttaaattatcaaatttttggtaatttgttaaagcaacaatagaaaactaatacactcatttgattcataaatatttgtagagcaactaatatatctcggacactggctggctgttggggataaatgtattagcccattctcacactgctaaaaagaagtgcctgagactgagcaatttataaagcaaagaggtttaattgacttacagtttcacatagctggggaggcctcacaaaacttacaatcatgcagaaggggaagcaaacacgtccttcttcacatgatggcaggaagaagaaatgtcaagcaaaaggggaaaagcccattataaaaccaacagatctcatgagaactcactatcacaagaatagcatggaagtaactgccccatgattcaattaccttccactgggtccctcccacaacacatggggattatgggaaaaacaattgaagatgagattttggtggggacatagccaaaccatattaatataatagcaaatgaaaacttgaagaggagagaatatttttagacgcattttatgaggccagcattactctgataccaaagcctgacaaaggcactacaagaagaaaaattacaggctgatattcctgatgaacatagatgtaaaaattctcaacaaaatagaagcaaataaaattcagcaacattttaaaagaatcagtgatcattatcaagtggaatttatccctgggatataagaatcattcaaatatgtaaatcaataaatgtgattcaccgtattaacataatgaaggagaaaaaccatatgatcacctcaaagatgaagaaaaatacatttcacaaaatttaacattctttcatgattaaaaaaaagctctcaacaaattaggtataaaaataatgtacctctacacaataaaggccatatctgaggaacccacagctaacatttaaccaatggtggaaagttgaaagttcttctatgattaggaacaagaaccccactctctccacttctatgcaacatagcactggaagtcctagccaaagcaattgggtaagacaaagaaataaaaggcatccaaattggaaaggaaggagttgaattttctgtttgcagatgacatgatcttatatagagaaatcctaaagactccaccaaaaatctgattcatatcagtccattagaactgataaacaaattcattaaagttgcaggatacaaaatcaacatgccaagatcagtagcattcactaacaaactattgggaaaaaaagattaagaaaacaatctcgtttacatagcatcataaaaaatatattcatgagtaaatttaagcaaggaggtgaaacacctgtataatgagaactatacaacagggatgaaagaaattgtagaagacacaaataagtagaaaaatgcctgtgtttatggattaaaagaattaatattttttaaatgactactcaaagcaatctgtagattcaatgaaatactcaccataattccaatgacattctccacagaaatagaaaaagcaatcctaaaatatgtatggaaccacagaagaccttgaatagccaaggtaatcttgaacaaaaagaacacagctggaagcatcattttacctaactttaaaatatattacaaagctatagtaatcaaagtggcatggtactgtcataaaaacggacacatttgccaataaattattgtcttatgatatgttctaatctaaccagaaacaccggaataggctgtttgttttttgtatatgttgtatttgatatgtgttttgaacatctacatgggtatagccagtaataatagctaacactatacttgtcattattctaagcactttttatgtattaactcatttaattcttgtaacagtcctgtaaatatataatagttgaggaaacatttatagatgagggaactctggtatgaaaatatgaagtataattaacgtcagatattaacaaatatcaagaagaattaggattaaccagaaatgccttgatttggtatttttattataaaagttttcttttttacattttctgaagccatattgattaatcactgtttcttgataatgtgtcaggtctttacacatatgtttcagcagttaatttttatgttgagtaattttttcagctgtcactaacctgttcatgtcatgggcaccaactcacaaacatacatctcagcttacatttttataatatcctctaagacataagtaatttattctgcttctgctgaaaatttccaaaatgtcatgcccagtgatctccatggaattaattcttgtcatatatttattgacatattacagggttttctatcaccactgactgccacttttcaaaactagaaccattatttcaagtgtcagggtactggttacattcattctctttgatataaacagatattttaactggtagttttatagaaatgttatttttgaaaaccttatgaatcacatatctattataagcaaaattttaagattaagatgatggctattttatctttgtccccttgtatcttggacaagtatatacttagtatttgttgcatgaagtaatgaggtatagaattctatttactaattattgtgttcttaatctgagtaatgagaaattgtttgcaccgtgattacaaattggtagcaaacttagcaaaacaaaaaatgtatcaacattatttgttgaacaccaattatgtatcatcatgctgttcttaaatcaacatattccactgaactttctacccctctcagtaattctctcactaatgcttaattattgttacccatgactccattctttaaacactcctaatacagcactcattccctcagcctcagagaagagtggaccagtcattgtcaagggccatttttttcaatacactgtcaaaggaccacaaatctgctatgaacaggatgatgaatcacatgaatgaatatattctgtaagtttgtgatcacttgattagtgtcagtattccccaataaaataaaagctatatgaacaatcatgtctgtttttacttagcattacatcaaccagatgacaaaatttaagtgcacaaagtatattatttaaaagactgaagttaagttcatttaatttaaatgagggatcatatgttaaatcctaaatgttaaaatttaaaaaaaaaaaggttaatcttatccagatgggaacatagctatttatgctactgaaaacacatgtgatcatcaacccaagaaaaaggcaaccataaaaaagaaatttttttcctcatcgaatcaagattaggtagtcacaagctgaaatcttggttccttctttgttatactattttcctacaaacgtttctttaaatggtcttagaagctgggagccaaaggtttttaaaattgaataatcaccttttcacatgctgtatttgtgttcatattttgtgaatcctctaatgattcatttaagtatttactgtgttctccaggtgggctttctatagctttccaaggcatgatttaaaaatattaaaaataatacaagattttgtgtttgccaaactaaagaagttttgaaaataaaatgtgagactctttttttcccaccataatttctgtttctgtatctaaggccgtttaagtaaacatctaaaaacggtttttataatggtaagagaatcatgaatttcatttacatatttactgttcacatactgctgtgctggtaatggcaaatgcagagtttattcaaatagttgtctttgaaacacatataagaggtcaaagaatatccaggtggttctgagccctttagcagacacaaatacacacaaaatgaggtttcgagatggatttctgaaatgcccttgggctatgtaatgctaaattatacctgaaaattcattctattcaactcagcaggctgaagtagctcatcaatgtagtgtaattataactaaataggaacaggaaaggaattaggaggacaggattgctgtgtataatacttttgtagacaggctgaaatgaattctattaatatataatatttatgcaaattttaaattggaaataattagaaattttggagtaaaaatgttgatactattcttagaaacaaaaatatgctgaatatgatccataaattgaaattgatattttttaaagcccataaagaattacttatcatagtattggtctttgtctattttaagcattatatttttaaactatgaataaatcttcttaatgtctagaccaacattttcaaaattgtttggttatgtgtgtgtatgggcacctaattttctgacataatgttatctctttttaattggaaatttgctctgggtcattctaacctacttgattattttccccgaagaacattctccaagtccataatggaccttagattagtgcaaatattatcatttcagtggacttcatgcaccaattaggctttacttgaatatctttagaatcacaatatatgcacctctagaattctttttaacttttaattcaggagtgaaagtgcaggtttgttatacaggtaaacttgtgtcatgggggtttgctgtacagattatttcatcacccaggtattaagcctagtacctattagttattttttctgattttctctcttctcccaccctccaccctccaaaggccctagtgtctgtttttccccgctatgtgtccatatgttctcatcatttagctcccacttacaagggagaacacactgtattctttttctggagtatgaggataggtaagtatcagaatgcattctctattgaaatctcacatatcaaatatattctcccattgtctgacactttaaaagcatgtatatttgccaaaatgacaataactccaataattccaactaaagtaaaatcctaggtagtgttctctattctcaactgttttctgaatttggtttctttgacaattagttttacaacacatgagatagtggtatcatgaactgggtacagtttttgcagctcacaaacgtacacactccagctctgcttctttcttgcaagctctttgaacttggcccttgaacctcggttcccttatctgtaggatgaggactcctacctcgcatcactgctttaaaattaaagcaacataaacaaaatccctcatacaaagcaagcacttaataattgttcatttttatgattccatttagcttctgcaattaattagggaactattttaattaaaatacctcatctatatttaattcattgcttacattataaagctaacattagtgaactctaggggtgatgatgtaaaattataatatagagtcccaatgataataacatatattctttgaagcagaatatgcaagatatcatacagtggagtgcagaatcccagttcatcgtttttttagcatcatgtatttattacctgcctcacaccaagaagaatttgtgccccactaccacatatataaaataaagtagaaatacaatgaattttatatagataaaacacagcagaggaaagaaaccccacagaatagaaagatgaaaccagatgctctagttcagagtccagaaagaagaaagtaagggcaagtttcaggaaagacagacgttgactaagatagaatcagccaggaaaagaggaaggcagaactctgagaagtcagcagtgtgtacaataggatacttgctactttatgtctctgccttcctctacttcacgtgccacgtgccacttgctggtccccaccattgtcctgagtcttctgtgcttggttaagaattttctctagctacaatctggccactgaggaaggacgcatcctgcaaacacctcagaaccgtgttttgctaggaagctttaccactcacaaccctgtggcttttaagataggtaggtacatagatagatagatagatagatagatagatagatagatagatagatagataggataaatagataacagatgaatagatagatagtagatagataagtgtatacatcctattctgtaaactctttcatagtaaaattctatgcataattttcatgatcacagaaactaatatgacttcaaggatgttttaatttctcatcaggattccctataaactcagtactatcccttcatctcaggacacagtggagatgctctgagacaaaagttgtgagctgctgaggaagtattttttataagtaaaagatctctagggagcatggtacagcaattctcccacatcatgcttgtctagtccactcggctgttataataaaatgccatacattgggtggcttataaacaacagaaatttgtttcccagagttctaaaggctgggaaatctaagatcaaagtgctggcagattcagtatcttgtgagggccttctttctggtcaatagaaggcaacttctctttgtgtcctcaggtggaagaggcaagggatctctctggggtctttttaataaaggcactaatcacatttgtgagggttctgctcccatgacctaattacctcccaaaggccccacctttaaatacatcacaggagggattaggtttcaatgcactaattggagaggaacaaaaacatttagaccatagcaatgcacatctccaataaactatataatcacttccatatgtctgtgaggtagtttgttgcagatgatagtaccttttatgtggctatcatccgaaaagagaccttgtacctttttaggttcaggattattttacgttatacctttaaggtaaaatatagccaacatttattaaaaatatattgaagggaggtgaattatttacataggcataagtaatttccttcatacttttaagtataatcgctaggaaattaaagacatttttcaactcttttgtaaccattaaatacttgaacccatccaaaggatatgataaagaagatagaatttcattatccttaaaacactgcaaatttatccaagtataaatgagaaaatcaggcaaccaagaagataaactaagtctggataatcaaatttaggctacaaaaagataaaactcagataaaattgaaaggaaagcatatagagaaagagaagcaacaaaagcaagaatgctaaaaaacaattaccactaaggagatgcagtaaaaataaaatcaattgtaattgtagttataaaggataaacattttaactgtttaatacatgtaagtattaaatatttcagaatcataataattgtaaagatttctttgacattaatgcataggaaactggacaaagtccaaagaaatgaataaaggcttaataataaaacccaattatagtttaaaaaaaatgaaagtctcttccagatacataaaaaaactgaacaaaactaaggagtacagaattgatttgtttgcttatttcacttttagcaacagtcaagaataaagaagcatctttctggaaatcgttatttttccctaatttgaaccaataccacaaatgaaaacttggaccaaacttaagaaagtcttttatttccttcaattcaaaaaagaacaatgataaataaagtaaaatgaggtgttgaatgaaatgacaagatgtttttaatatgatagccgttaaatattttagtaactatttttagattatctacttacaggacagcacttgacttggggcgaatggatgtgggtccagatctccagacagttgtcaagacagcaagtaatttaatatagatgagtgtcaaagatacagatatatatttgtttaattgctgaaaagatgggttggtgattgtgctggggttgaaaattatttggttgttatccttgaaaaaacctgaggaaagtattcatataaagaattcataggaattgtatgaatagggaggtgtttcaaaagaaggaagaatttatctctaagaggagaaaagccagtgttaccacaggggcagctgataagataaggaggaaagggtaagagaagggtcccacccatacatcaggggcgctgggtgatatgaatgacctaggagaaaggttaactgtgagtaactttacatctaaacctgataaacattttctgttcctacctgagaaaggagagttgagatatcacttcctatcactcttggaagccctgattgaagcccctgctgggagtacatggtccaagttgcatgagttcatatacctcatcttccttcagttatcttttcagcaaacttgtaggagctgtctggtctctatcggacatctgtaaatgaagaatttgggcaacagaactttgctgcatcttttcggttttaatatttaattattctagcaattctctgaaacggaaccatcataaaattcaagttaatgatttctatacactctatatacagtgtcttgacaaaatacttagaaggtttatgaaattcaacacgttttaacttgaaaaccagataaagatgtcaatactccgagtgagctaataattcgatacatttgatcttctggaaatatccagttagggtttcatttggaggaaaggatgagggctggaggatcaggaagagagggggtgaggtgactccagtaagacagggtactcacccctgctgcagagctgagaaggcctgttctgtcatcccaagtcagctctggctccaaacttgaatgtccctgccgggaagccagaagccctgcagtcaactggattcacccctcctagaaggtagtttagcacaactagttgttgtggaaacatgtcccttgtggggtgtcatctcctgtttcctgcacaactactcaaagtatcccttcacctcacatggcatgttatgttgaactgtctctggagaaatattagccagattttaatcaggacactatgtctcgccctctgtgacactttattcagacataacctcttagcttcactttactgaagcatcaaataagaatgatgataagaataataaaaatgaaaccaataataacaatacgtacatcataggactgttttcagtgttcaatgaaataatgcatataacatttagaaaagacctcagcacctaatgaacattctctaaattttagctctttttaaatcacacagcattcactccctgtgtcacattctggcaaacatgatgtccttggtttcagtacattactagtgacaccatagagcccttttaggtaagtttcccctagaagctacccagtgcattgccacttaattcagccctaaatcatattggcctagttcctggtaaaatgctctcaacacaactatgtaagtcatgctgtgtccctgaccattacctctacgtgttctcatttggctaaagtttccccattttcaaaattgggatagagatactcaagtaacagaagattatgtgacataatgtatatttagcatagggctagttgcatagtctctctctctctctctctcacacacacacacacacacacacacactcattctttccctttctctcttcctctttccctctccctcctatctcactctcccctctttcttccttttcttcctctctctccttcctttcttctgttattctattactgttaaaaggacagtttatattatacatttatattaaaagtatatatcttataggcttttatttctactgattccttccatcaataaatgaaaggtatagatacaattatttgatttttaatgagaattaatttatcccaatgtatcaatgctcactagatttgcattttaagtgtggagtataaagattcaatttaagtaaaagaaaaacagattgtagggagtagatgaggagaatgtttgttaattaaggcataaaactgattttgcaaacaaaacaactctagcccatttgggattcttgaagagggcaggaagaagagtggggtgcctggacgtgcccttctcttcagcttctctctctgtcccttatgtctatattttttcttcctacttttcggaatgaaggttccccaggttccactttcaccaaggactctgctccccctcagccactgcccctgcctttctctcacctgcctaccctactgcagcatggtgctcatgaagttggcttgtattcaccgggtatatgtaaggtccccaatccctccaagattcaagccactaggcccagatgtgaggttcaggagtagatgctctaaatgcactgaggcgagaaaagtaacataagaaaggattgaggagctggaaattgcctatatggagcctaagaaactcagccctgatataaggtctggaggagaaaggtgggccaaacattgacgagtacaagtctggctgtttgttttagtgtgtatctgtttatatatacatgtggattttaaggtgtataggtgtgatgatcgatgaggctggagggtgggggcttcttgtacatatgaatgaagtgaattgtcacatggtctttccaaaaactgttcagattgatattaattatacataatggagaattaaaagtgtgaaaagtgaaaaactacaaatttgactgtatataatcaaatagtaatgctaatatcaatgacatttgagtcattagtccattactgcctaatcatcaccacgtttattcatatcataaatatataccacctatatactgcctaaaacagaaaaactgttttaattctattgaattgccacagttttcgtgccttgttggtcttatggcattggtgtctaagaaatcagcaaatagcttttataaaggagacattgcttattaaatatggctttgttcctgtgaatttaaaatacatcattagatcttcatacctgtgaatatgtacaatttcatcaaaatctatatactgagaactcacgtaatgagagaatgcattcaaattaacactgggactaaaagatgtgaaatgacaagtattttaattatataaaaaagttactgtagtcaataaacatgaattggctcttgtctaaatttattgaaaaagaatttgtgattgtatggactttatcattgaaacttgtttattaaaatttattcatggccgggcatggtggctcacacctgtaatcccagcactttgggaggccaaggtgggcggatcacctgaggtcaggagttcgagatcagcctggccaacatggcgaaaccctgtctctaccaaaaatataaaaattagctgggcgtggtggcaggcacctgtaatcccagctactcaggaggctgaggcaggagaatcgcttgaacctgggaggcagagtttgcagtgagcctagatcgcacaactgtactccagcctaggtaacagagcgagactctataccaccagccccccaatacacacagacacacacacacacacacacacacacacacacacacaacaactcatttattccacaaatgtttattaagagcctactttgtgccaggcattgatctaacctctggacatacatctctggaaaaaaaatgaagttttatcctcagaaatgtatgttctaataggaagagaaagacagcagtggaatgtacagtaatgcagacactgactatgccctaaagcaagatataaccataggggtctttgacaaacagtcttaccaaagagtttagttcatcaaaagtcaaggacactgaacagaatattgctgaaaacttatagaatattattcttggtatatgtggttacaaaatataattatttaagtaaaaaaaaatcctttacactgaaacaatgcttctatgaagagttatggagatgatatttcccgctactagtaggtagcctggatttgttcacacttaaaaaagaataactttgaacagctgagtatctccacttctgcttcttggcaaaaaggtgaaacttaatacataacaaggaagtcttatgacatagaaatttttcactagcatgtgggtccttctgtattttaaataacaactaatttcagacacccaagtcagcacccaaaggtgtctttgaaaccatgttctcatttggagtgtttgggagaggcagtgttcctgggcttctgctgaatgccaggcattgctctcagaaaaggacagtacaagctataatgaaggcagagcttccaccttgtccacttgagtgacagtgtgaaacatattcagatagggatatgccccaactactgtcaaagtagagaactgaggactaaactgaggccccaggggttgggggtgggggaagcttctggagaggcttcttgcaagcaggagcagagtgcctgctacatagtaggcactcaacaagcctgagaacctattgtgtgcaccttctatgtaaagttctgtggatataaatgtgaaaatgtgcaatttctgttttgcctgagaagtatagactggggaaatagacaaaactaaaattgagaattgctttaataattgaacatacaaagtgtatcagagattctcagaagaaaagaatttagcagagtttcaaaataatatacaaatttcagtattctatagtggttaaaagatatatgaacctaatttttaatttatataaatactaaacaaggtttttatatttagattttcagttttgcaattcttgctaaatatatgaatctattcttaatccaacattgcttcatggacagcagtttagtagtacagatttcattagagaacttaactgctataggatcgggggaggtgaaggaaatacaattttccctagaagatttacattaaacagagtagttacaggctgtagcatctcccctgtaattttatgagaatggtattaccctggctttcactgtgtgattgctggttaccttctgtcagtgagcaacagtcttactgcaaagcaggagcacaacccgtctctttgtctccgtggtcaaatcaattacttcttagaaagtctaatttttttcaaaatgaccatgtacaagagcaaacgcagacatcagagatgtaagtaaaatctgacccaactttttcatatcactggggtagggaaaacatacttgatttcttaaaagactaatcatgacttcttcagatacatcctggtagtagaaaagatactgtagcttttctcaccctaacctttatctttattcctgtaacatgcatgaaagatgttgagggcagaggggataattcgcttgttaccatggaaacccttggaaaggtttacaaaatcaacagagaaacagatcaaatgcaatttcagtctagctcagcatccttcattcaggcatgatcactggacagttctcttttttgcttttctaggagtgatagattttctttcctggaagtctattgaaaggtttgggaagctagcctaaaacttctcgttattcatccaatttcaattacaactcttagggagtagaaagcagttcagaatggaggggagagagttaattgtgaatgacaagctaaatatttaacaggatattcattgccaaacttcttggtccagagcatgctagtgacataattcactacaggcaccatttcaaagggttaaaaggagtcatctgcagtcttccctaaaggaactgattctggctgaaaaggagcagcacaattaccctggcgtaaagtccagaacaaagattattatggaactgaaagctatcaggatcttgctaaaaatcaaaagattgttataacactattttacggtaaagcaatatgcctctcaagaaaagctttacaatcacctctctctagtaagtttaactctttatcactttatcttttctattgtctaaagtaaataataccatatttagcccaaaatggtctgtcactgtctctatttatcgtcatagacaggtaacggcaacttactctgtactcaaagtctgtactttttcattatttcttttgatgtctttaaatgttatcaaatattttgaaaatcaaagtctatcagtcacaattatcctatcaaaaagccaataaatcatataaagataatttttagtgcgataatttattctttggtctgttttcacctaagatctgaaaactaacatttctcctgttcaaagaagtttcatgcaccacagaaagctctgagggctaggctgccagtttgattctgcaagcttgattgccttttgatgccagttctttcttgtgataaagaaacaatatatgataactgctacttttttcaggtaaaaatgattggtgtgaagtctacacatatattgctgattaattttcttgtgatttcctcttacaagaatgaatctaaattatgcatagatttgaaaaccatcttgtgcctttactcctgtatcttttatatatccctcattttttttccttgtggattatcaatgccttaatgcacatggaaaataagagattcacagaaaaattatactgagtgtctccccttaaaatgtgctcactgaagtctgcgattaagcagcaggaagaaattgtgaattacatgagacaagtcagaagatgtataattatacaggcataaacacagtagggtgtactggaatggttcagttaaaaaaactaatgtgttacttaaatttaattgtatcaactattttatgttgcattaagtttttctatattctaataatataaaatatcagagagcaggaacataataaaattaaagtatatagaaagcttagcaataaaagcaaatagaatccttaaatgaatttcttaaactaacaatatttgcaaaagtagaatgtaatacaatggtttgcattccaatgcgtaaacagaaaaactggaattttcccatcaccaaaatccagggcatttccattttcagtcatatcttttatgcgtgggtttttgatcatataaaaggcataaacttacctagaggcaattgtaatccaattaaggcaataattgtacattcaagaaaacctcactgtaggaaagaaggaaagtcttcttacaattttctttaaaaatgagatagtacataaatcaactttctaatttttctcattatccaaagatttaatatggtatcttttagtaaaaataagtgtttcctttcagaggatctgacaaaaggaatagtaaaggtgcatgtggctatgtcaggagtttgaggaaaaaggagagaacaaaaatacttatgagagagattttaaagtacaaattgtactaaacctttgaagattcatgtggggctttgaaattcattctctactcatattgagattagttatttataattcactatacaagaggaggagagggagggaagagtgcccattgccttgcttctgatagtacaattgctaggtaaaaggaacagcttagtgttcactcaaatagcagatcttacttgtgcaaaactgcattaaatactttcaactgtatacagaatattttgagtggtattaaaaaatgtttgcatatatcagatgctgatattgccagagccaaacaggtacagaccaatttaaggaattctaatacatgcaaacctgtttttttaaaattcggattgatttgggaattaatgtttaacttttgagtccatttaaatactaagtttttatacatatataataacaaaatttatttaactgtgaagtttatgtttaaattttcaaaaatttctgtatacaacaaggaaaacctgtaacctcccttgctgaaactccacatgaccttgagaaaacatttttggagttttataaaagacacatgaaggtacatttttaaaaaatgaatatgtttttaaaacactgacgtagaggaaaaagtagagtagaagccataggattttgaaaatagcacaatacctgtgccatggcaaagaaaacagtgtgaatcgagtttcagatatgtaacatttcatcttattttactgaattggaacagatcatgtattttttattcctaataatatctttgggtgagcttatcgaccttatccatattatcatggaaatacttgagatcacttcagaaatctaaatactagtcatcatagccctcttcttatagtcttggccaattatctattatttctgtgggttgcaatctcttctgtaagtttagtagattgcactgagaaagtgttctgtagggtaccttccatctctaaccctcattgcctccataacacaaccctcatcaggtcattcccctactcaaagacattaatggtttctcattgactagataatggtggctctgggcttgtgtgcttcagatccttgggtgcccatggagttactacaaggttactacatattaatatttacataaatatgaatcattgtataatgaagaaaaatatatgtgtatatggacatacacgtgtatatatacataaacatatacatacatatatgcttttaaagttctaaaatatgtttaataaaaacaaatgtatttaaaaggtggtgtactgcatttgtaatagctttttataccatatattttactttaaaaaaaaactatagtacatgcagccctcattatgttttggtattcttttttttaaaaaaaaaacttcatactcccgaaggttgagaatcactgaactagaaagtgagtacaagcaagaccttataatgtagaaatttacatgattgtcatctgcccactactttcttctcttcctggtaccacctatattctaccctttatcaagctaccaattgtcagccaggcgcagtgtctcatgcctgtaatcccagcaatttgggaggccaaggcgggaggattacttgagttcaggagttcaagaccagcctgggcatcatggtgaaaccccatctctactaaaaataccaaaattagctgggcgtggtggcagacacctataatcccagctacatgggaggctgaggcacaataatcgcttgaacccaagaggtggaggttgcagtgagccaagattgcaccactgcactccagcatgagtgacagagctagactccatctcaaaaaaacaaacaaataaacaaaaaagctacgaattgtccttgaaattcactatattctcttatctctatgcctttgcctatttatcttcttgttgatagatggccttcacctgcaccttcacacctctctgttgaaggtttcactcacatgccacatccttcctaaatgcctctccagtttctaagtcaaattgctctttcccttctatcttttcagttcatatatttttgtttgtttgtttgtttgtttgttttgagacagagcctcactctgtcaccaagctggagtgcagcggtacaatctcagctcactgcactgcaaactctgcctccaggttcaagcgattctccttccacagcctcctgagtagctgggattacaggtgcccaccaccatggctggctcatttttgtatttttagtagagatagggtttcaccatgttgcccaggctggtcttgaactcctgacctcaggtgatctgcctgccttggcctcccaaagtgctgggattacagttgtgagccactgcactcggcctcagttcatatattgtaatttttcttaaaatttctatattctgtcttatatatagaaaattatctatttacaccactaatctctaagtttctttcatataaggtattctttattcttgtttgatacattctcagtgcataatatgatgctttgcccatcaaaatccatggctgtctaatgaagtttatcgacttaaatatatatttttgaccacctactactttccagagactgctctaatggtagggctatagcaatgagcaaaacaacattttattgaagataagatgacacacaaataaatatgtaatatgctatgtaatgctaagtgctatggagaaaaataaagcaagtaagggagaaatggagttttggaatgtggagtgaggaatttctattgtctatggggaagtcaggaaaagccacttactaaggggacatttgatcagacaccctaaagaaggaggaaattggttcagtttctctctggatagttacaagtagaaatagcatatgcaaagtccctgaggaacattgggataattgaaggaccaagaaagagtccaataagtagagtgactaaagatgaggtcaaaaaagcatgaggaacattggatagatagagtaggacagacaacagattttaactgaaaagtccatttcatttgtaactgaattaagacataatatgtatatactaacttttagaaatcactatccatatttctaagtgacttgtgcaataatttttaaatgacaagttttaaaagtatttttaaaataatcactctccatacatggcaaggcatgcagtcattgactggaagacaatcaaattttggtcatccagaagtccaaaagatattgtttgaccaggaatattttctgacttatcttcttataaatatccttgtattctttattacaagaattaaaattaagtctacctctctttaaaaatcttcctatgagaaaaagtaaatttacattttgatagaattgttctaaggctttttaaggcattgacagggaaaaacaaggctgttgccagtctcaattgatgtgtaaaattggtctctcagtgatcaacagtgataataggtttgatattttgtaatttttagaatatgacttgtcttagcagtcacatatttattaatgtgttgtgttttatagaagtcttgtttaaaggtacttattgaaattgattacaaattaaatagcaatataaaaatggattatttaaaacaaatacttatgttgataccatgatttctttgtaactgtgaagacagaagaaataatttgttattaattcccaaattacttcatatcttaagtgttgatcttttttgttacctaacgagttgaaaatgtgatctaggttttaaaactttttttaagtttataccagaaaaaacaaactatttttaggcttgattggtaaaggctctctagaggacactattaaattcaatctttgatttctctattattgatgcttgtagggaattctggtatgatatatgcaatgtcttcagccctttttattctcaagttctagtatgaattctataactggtagaaattgagaaattgtaattttatagattcctccatggaatcacatgtgcatggatagaatcagtgcagtctgaatgagcatgcacaatgggactataaatgccagtttgggagcagagacgtacaaaggctgactgataacaccccgatacagattgaccttaaatggaaatgcatattggtctgcctcatatccttaatcacaggcttttacaggctccagcctgtgactggttctgcctgcagaaatatattatctctctctctttctctctctgtgtctctctcagaaaaaaatctgatgatattcatgtatttttctgtttaacaatgccccacacattcaaaggtcacttttgtaccaggtgagcatttgtccatttctctcctgtactttcagaaaacaacttgactatcatatgtcacctgctcttttaatttctcttctaagaatctgtgctgcatttatatctacacttgcataaaaaccgtggcatttactctgtccccaggtgtttaggtaattgttttctgcagagtatactttatcacttcaaaaaatgttacagttaaaaaataatgttaatttgtatctgttgataaaagaattatacatgtgaaacaacaagacacttaggaaaataagattggtgttaaatgaagatattagtctatcattttaacatactgtcatgtggtttgcaaacattttcttccattccatggttgtctcttcactctgttgattatttttctttgctgtgcaaaatctttttagtttgatgcaattctatctgtttttgcttgtattacctgtacttttggggacatatccaaaaagttttggctcaaactaatgtcaagaagcttttcttctatgttttcttctagtagtttcatacttgtaggtctcatatttaattctttagttcattgtatttttgtatatggggtgaaatagagatcaaatttctttcttgtttgtatggatatccagttttccaacaccatttattgaagagactatactttccctattatatgttcttggcactttggtagatcagttgactaaaaatgcttagatttatggctggactttctattctgattaacatattttcaatattaaactcttcatgtatttttaatattaatcataactcaaacagctcaatagcaataaaattaataacttgattgaaaaatggacaaagaatgtgaaaaagtcatatctcaaaagaagacatacaaataatcaacatacatatgaaaaaagttcaaaatcactaatcatcagggaaatacaaattaaaaattaaaaccacaaggatatatcacatcacacctgttagaagaattgttataaaagtgtcagtgagtacataaagtgacaacaagtgtcagtgagtacataaagtaaagggaattattttacactgttggtaggaatgtatattagtacaaccattatggaaaacagtgtgaagtttcctcataaaataaaaatagaactaccaaatgatccagcaatttcatttttgggaatatattcaaagaaaataaaattaattatctcaaagagatatctctacttccatttttatagcagaattactcacaaaagtcaagattggaatcaacataaatgtccatccacagataggataaaatatatgatatatatatatctcatataatatataaatatcatatctcagacatatacatgtttcatatatcatatatatcatatgtaaatgtccatacacagatgaatggattaaaaatatgattatatgagatatatgtatctcatatagatacaacacacacacacatactcacacacacacacacaccccaatggaatactattcaatctataaaaagaaggaaatcctgtcacttatggcaacatggataaacctagaggacattatgctaaatgaataagccaggtacagaaagataaatactgtgtcatctcactaatatttggaatctaaaatagtggaagtcattaacagaagcagagagtagaatgggggttaccagaggttaggtggacaggaagggcaatggaaacatgtttgtcaacagatacaaaattttagttataaaagcaatacgttcaggagatctattgtgcaacatggtgactacagtcataacaatatatcatatgcttgaacattgctaagggagtagattttaaatgttttcacaaaaagacatggtaatggatatgtttcattcattaagttgacttagccactccacaatatgtacatatatgaaaacattatatatatatataatttttattaatcaataaactaaaataaaatactgtcatgaatgcaagcagtttgacatgactaaagaaaagataaccattcataagcatcaatgcagtgtaggaagtagtgttttctatgctctaacatatgccatctttgaaacatcagaaagcaactttcttaaaaaccatgatctgtcataattatgtgttttgggaaatctttttggttgagcaatatgaaatcaccagttttgtaagtcaatggttaaatctaataaataccagctattgcataagtgggcaagaaaaggggagaggtgggtataataagccattatgccagcacaagttggcattaaaagcatagggctgttacagttaaccaagtgtgattatgtaatacactaaaaatatctaattacattagggaatatatgcattgttgctctttaggatatataaggttaaacttcctacaaaaaaaatgaaagtatgttcagtgtcatcaacatagattaactagatgactttattttttcaagtgacatatcagagcttttctagaaagtatctaccttcaactaaacttacaatgtttattataagcatttgaattctaattttacatattttatcattaaaactttgttttcatccaaagggaaaattgagtagttctaaatgaattgggtaatgataataaaattgacaaatatattgaatgtttaccatatgtcaggcactgttttaagcattttgttatagatgactaatgtaatttacataagagagcaataatcaaacatgtaatagaataatgaagtaatttgtgatacttcatttttattataatttcaaaatgttatttatgattttatttctaatctctaggaaattggacacccaaaattaaattaaaatatgaacattgagtggagttaaaaagcaaccttatatatctcctaaggaatctaataaattaactttaaaaagcaaaatataagttttaccaatatccctaccctttaaatcatatagaaacagaaaaaatatcttgaggaaagttttacataaatataggcaaacaaaatatctgcaaatgaatgtatttgtctcatatgctatcttttctgcaaaggaatgaaaggtttccagaacttagaataagtgaagttctctgcagtgattttagtaattcattgtgaatcattacacacttcttgatctagaacagctaagttgtttggcataaccttttgattcattttcctttttctacttattgattttcttagcactatttactgaattacactcttattctaacaatggaatttctgacacctttagttatataggaaaacattatatgtgtgtaaatattgactcaaagtattaatggtctcttattattgacatattatctctagaacttcatttgtatttaaaataaaaattatgtccacatttatttccttagactccgtatagagtatgtggcatatatttttgtaatgttccatgccttgggctacctatcattggaaaatgttatatttcatattagacgattcttttgacccctagtaaacctgaaactgccttagaggaacagctgaatgtatttccttaaataaacacattgttcttcaaattgctagtgtttgtcttcttaataggctccacaggcaatgggaatgttgactttgaagtcacctctactgggttcatgtagataagtctatttcataccttttttcttcccacacttaacagtgtctttcaactcacgtttgttttaagacaactataaatgcatacatactacatggaatatttaatttttatttaatttatagtctcagtaattagtgagaggttggctcacaattacataaaaataaacttagacaaaaatcagaaaaggtttacttttaattgaggtatgaggaaaaattcatttacttggtcacatgcttggccttcataaggtagcaaaagataaatggtcacttgcattgtataagtggtcgtaaaatttttctcagcactgaactgtcctccagagctatttatatgaagctagtcattttctaatgatcacttgtaacatagatgatacactcaattttgataaatgggtccaaactctcctaaagaagctgtaccagtaatactccatgaagctttctagagtttgtttgcttattcactatccagacagaaatattttgcatatttttcaccatcccagttttcaagaacccaagctagagtttgagaaaattctatttgaatggacataaaaatttatttgattttgaaataaaaacaaatcattaaaaattctactttaaaaatatgctttgaaacttgagtatctaggaaaaaagttaataaccaagcacaggaacaaaatacaagaaattgtagcataaagatcatagatatgctttgggaggccaaggcgggcagatcacgagatcagaagtttgagaccagcttgaccaacatggtaaaaccctctctctactaaaaatacaaaaattagccatgcatgatggcacacacctgtaatctcagctactcaggaggctgagacaggagaattgcttgaacccaggaggcggaggttgcagtgagccgagatcacgccattgcactccaacctgggcgacagagcgggactccgtctcaaaaaaagatcatagatgtgtttgttactatgattctctttttggtctctgaaaatgggtccctggaaattagaaccatattaagttaaccatttcttatatattagaaacagttgtttatcaggttaaagatgctatattttttgtactgtataaacagccatctaacatagtcatttgtttggggaagatactagcctttgataatactatttctcttagattactactggcagcaattaatcaacagttgtagtaatttaccctatacttcaagccaaattaacagtcttgccttgcttatatgaatattaaaggataatgtggcattgggcctggaattctcagtaagttgcccacattgttaatatttaccaatattaacttaggaataggctgcaaggtgtaaggaatgtctgttttaatattcattttaaaaatacatgttttaaatattgtaattcagtgtaatcacatcagttatgataatttcattttgggtccaggataattaaatctggaattgcataagatgcactacaatggtaatattatttcattattctttgtaactaacattccaatcactggtatagattgacatttggaatatgactatcatcacacaattctttgccctaggagacttcctaatgggcattttttataccttgctgtagccttttatgtacttaataaccgtacagtttcatgtagcttcataacaaataactatcattgccatatttatgtggtaataaaactagtttaaggtatttttatgaagctatttatggcttttagtcattattgagttttttatgactattataaagtggtatggcttaagaaaaattataaactcccctatgggtatttgtcatgattgaaaataatagaattctttttgttgttatgtcttgggaaattttattatcttctgtctagaaaagcaaaatactagggatcttcaatcagattattaccaaattattaagattttgttctacgtattgaatgaaagcatatattccattacttgtcccaattgaaataaacataaactgccaaatttcctggaaaacagtatatctagaggtcatttcagttgttaagtatgtgttatcaacttaaggttttattagttgctccttgtaggtattctgggtcagtttcattattatttactgaaagcattaatattatttactcatacaaactctatttcttagttgttatagtaaagacagattttttaattattgcataaaattgtatgttaagaaacattctctggccgggcgcggtggctcatgcctgtaatcccagcactttgggaggcctaggtgggcagatcacctgaggtcaggagtccaaaaccagactggccaacatggtgaaacctcatctctactaaaaatacagaaaattagctgggcgtggtggtgcatgcctgtaatcccagctgtgaaggaggctgaggcaggagaatcacttgagctcaagaggcagaggttgcagtgagccgagatcgcaccactgcactctagcctgggtgacagagtgagactctgtttaaaaaaaaaagaaaaagaaagaaaagaaaataaacgtctaattttatgacttttaaaaagcaaggcatttcttgacctggtattatcttactttgaaggttcatttgttgacatctcaccttgcatatttcagattagtatatgatactgaaaattctttctgttctctgaagcactctttccatcattcatacattatgttgtttccatttagaacactctcctctcctcttgtctgagctaattcctactcatccttcaggtgccagcttagataatcacttccttctgatacatttctctaagctgctggtggctggtagagtttatctttgttatggattcctctgtaacctgtatgtattctgtatgtaattgataatttatctagtcatttggctataacccccaaagacagagatcaggtcactattttcattctatatccccagcatggtctggcctaggaagccctcaattaatagacgttgaaggataaacagaacggattgccttatttatgtacctgttgtagcaactagaaattttagtcatttgccccaaatatgttactatgatataggctgtttgtgaactatctcttgcctttttatattcacagatgtgtatgcatgatatcacctgccaagtcctttttgttctcaggttttggagttactttttctactgacaaccctaatttccttatttgatgagaagtatgaaaaggaatctaaaaatacttatatgctgggcaatttaacaatgtttaaggcatactttgaaagtgccatgaaatccatattataattttctcacaagccctattgttgtactaattattaagcaatgatactagtttctagttaattcatggcttattttatttattatactttttaaaaattgacataaaaattgtacatatttatgggttacagtgagatgttttgatacatatatattggataattatcacatcagggtatttagcattttcatcatctctttgtggggagaacattcaaaattctctcttccacctattttgaaatatatcatgcaatattgttaactatagtcaacacaccagaacttactcctcctgtctaactgtgaccatatatacagttaatcaatctctcattataccccagcccctttccactctccaatctttggtagccacaattctactctctacttcaatgagaccagcatttttagattatttatataaacgatatcatatttgtctttctgtcctagctcacttcacttaatgtagtgtcctccaggttcatgcatgttgtcacaaatgataggattccaatcttttttatggctaaataatattccagtgacatactgtgttgaaatagaaaaaaactcatcttaaaaaatgtgtatggaaccacaaaaaacccaaatagccaaagcaatcttaggcaaaaagaacaaactagagtcattacactacctgacttcaaaatatactacaaaactacagtaatccaaacagcatggtactgtcataaaaatagacacatagacaaatagaaaagataacccagaaataaacctgtatacttacagccaactgatttttgacaaaaatgtcaagaacatgtagtggggaaaagacaacctcttcaacaaagggtgctggaaaagctgaatatgtacatttagaagactgaaactagacctctatccctcactgtataaaaaattaactcaaaatgtattaaagacttatgtactataaaaagactagaagaaaaataagggaaatgccttatggcattggtctgggcaaagattttttgaacaagaactcaaaagcataggcatcgaaagcaaaagtagaaaaataggatttcatcaaaccaagaagcttctgcacagcaaaggaaacaatcaacagagtgaagagaaaatctacagaatgatggagaatatttgcaaactatacatttaataaggggttcatatccaaattatatgtagaactcaaacaactcaatagcaaaaaaaaacaatgtgattaataatgaacaaaagatctgaatagacatctctcaaaaagagacatacaaacggatagcagatatatgaaaaaattgtcagcatcacttatcatcagggaaatgcaaatgaaaatcacaatgagatattatctcacccagttaaaatgggtattattaaaaagacaaaaggtaataaatgctggggagcatttggagaaagggaagtgggaatgcaaactagtacagccacaatggaaaacagtatgaagattccttttgagactaaaaataagatggggcaagatggctcagatctgtaatcccagcatttcaggaggctgaggcaggaggatagcttgaggccaggagttcaagggaagcctgggccacatagtgagaccctatctctattaaaaaaaaaaagaaagaaagaaaacaaaacctaaaaataaaactaccatgtgatccagcagtttcattactgagtactggttatatacccaaaagaaatgaaatcatatgtccagagatatctgtattcctatgtttactgcagcactgttcacaatggcccaagatatggaatcaactcagtgttcatcaacagatgaataaacaaaatgtgcagcatatgcacaatgtaatagtttctatttaatttaaagcttccagattattttatcattttaagaaatgaagactcatagctgataacacgttcagaattaaaacttgtctctctatattctgtttcctcccccatcaagggttgtctctgctgctaagtgtctttattccttaaatcaattttgcatcagttagaggaacaaattgtttttccacagatttgtagccattaatctcagcagtaactcagtgaatattttttttaacatcaacatcagaaatacatggacagaagggaataatttgaaccaagtccaggacatactggctgaatctatgaaagttaagacttcatgtcatataataaatctttgtcactaatttatgctactttaaaatttggggatatgattagaatggtcatataacataatgcacactttcttactctgttctttcattgtcttctccattattactgctactcagtaatggtatcaactggaaattcttgaattgtaagtaaaaatgacctcatttccgaagcatttaaagttattgcaggtgaaagctctctcaagggctttcagtgtttcaatacgtggatgtacaatgtctgtcaataatgaatgccacacattaaattaacttgaatagttatagcccaaactttattctcagctttggcaaatttctaacataaaagcttagaatgtaagaattgaaaaaaagctattagaataatacagatactctgaaaggacctctagattgctacacatatttctttcttttctgagtataattgagatttccaaaaatttttactgaatgttcattttatattctggacttggtaatttaaaaaaaaagataaaattgttaaaagagcaatgagtaattcaaagaactgaagacaaaatattgtatggttgataaattcatatcaaccttcttagctgagatgattagaacaccagggtaaagtggccaaggtcatagggttgagctgtctgtggcccaggtagtttatcctctttctgggtcacagaccattttgggcactatgcccagacattctttaaagaaggacctagtcccaacacaacagtggatgaaagagggaaacaggtcagggccaatacacagctgtcagaactacaatgtctcaaggtcagtatattcctagagtgattttatatatatatatatatatatatatatatatgtatgtatataaaatattgtgtatatacatatatacaatgtatattgtatggtatgttttgtgtatgtgtgtatatataatattatacatatcactctagcaatatactcactttacatatggatacacataacactagatatatacatatatatatatagtgtgacaattttgtataaaaaagggagaataactgtgtttgaataacaattatttgtttttgttttaatttataaaggcagtaaaaatcaaccaggttcacttcacttactttttgagcaggtgtcaagttcacacacttgaaatttcacaggacacaaaatatctacaatttcaaaaaaagcttgcttcactgaagtatatgaaggtagtcccaatatttttcattatatccttgcatgcataagtaaaattttagataatttaaaggacattgaaataattaagtatgctgttgtcttttctcttgaggcatcagaatgggtgtaactaaatttatataggaaacttgactttgttcaccatgaaagaaccgaagaatctgagatttgttttattgaggaaggcttaggcttggttcaggccctactgtgagaagaattagtaggaaaagttccagctttatctagtgagattgacattgtgtcatggcatctttcttaatttaataagtataaatcttacacctccactaccagtgcagtactgacttactgtcgatttgaacctaaagttatcacatgcatcacacttaatcatagtggttttcataaacttaaattcagttgggcagaattctctggatatttatattgattctatgctccagtttttataaacataacccagcaatgacatggaataaagcaaaaaagacttcagagttatcgaagctaaacttttgatttcatagaggaaataggtttgttctattgcccaccagaaatggtgactaataaatgtgtctttccatctttcttctatgagtaactaggaatttcttcagcattagttacttcactttttttagaaaaggaatgttgtcactgaaaagttaagatttaataaagattcacatgagaatattcttctcttctgtttaacatcaatctttaagtagttatttttattattgcaatagtctctcttcctaataagtcatttttttctatactcaccattcccccacccaaacctctaatgctccctcattaccctttattctattaaaatgcttatcatgctgtaaattatatttatttctttgggtcactctttccagtaaactataatcattaagagtagttctgttacctttgcatcaccttatctggctctgtacctggttcatagtaggatctcagtgagtatttgatgaacaaataaatgaatgaataaatgaatgaattcagtaatattgttgagtctgtttttattatacttttaaaacttctgcttatattcagtaatgaaacatgaagaaattaaatcagatatttacctttactaataaaattgtaccagagggagccataatattattgtcagtttctaaaatgtgcaaggctacaaagggtgaaacctctttgaattaatgcctcttaatggttggaaatttaatcagtagtcttcattcacaatttaagaactttacattgtctctctttcagtaacagtataaatgacaactttcatatctgaatcataaataattcatcatcatgtattcacccctttagagtgctaagcataccatagaggaatctttgttaaagatatttggctagccatctacttagttatgttagaggaaaaatattcaaagctcttgacctagtattccaatttctggcaaactttaaaagtaccatctttgacattcatttagaattcatctccttgatcacttttggcccacagtcacaggctttgattcagaacttctaaagcaactttgttttgacctctgctctgttattttccaagtcattttaaaaccaagaccagaaaaatatcctgcttcatattttatcaaagttttcaattatcccattggattttatttcatcatcttccccacactatgtacagtaagttgtttaagattttgtaggcaaatttctcatttccatagaatttgtgcttagaaattcaccagataatcatcaaatcaatagtccttaattaaatactaagtatatatactctttatttttcacaatgcttaattaatctctccaaatagaatacttcaatgctatgttcatcatggaagtaataagctctaagaatattttatgttgcaatcactaattaattatgaagcatagcttcattttttccttgatgtgctatcaacctgctgtttatcatagtctgaatcttatggcaggtaaggtggttatatatatttcaattatatgtaattaatgaatattgtataatttttctactgcctaagatctgcctaaatcaatactattttttaattatcttagtaccaatgctattcaagtgttttatgtcaaaaaagtcattttgatagtttaggcagagtcttaggttttttctttcttgatataatgtgactgctaaggccattaaataatatatgaaagtacattgctatgacaaaatatcaaccaagaatggatataggccacacttatttctttttccattactatagaaatttgatttgtggtaatggcagttaattattttgaacaatgaatccaatcagtctagtcagtttaccaaggaaaaaggaatgtattaaacagtaactttgataatattgggatggactactgaaacagattaagtagactgattcatgctttaatcaaagcaatgttgtgtcctttagtagctgatacatctgttcacacatagaagaatgatgttttgtgagcaaacttaattttcagttcctttaataacaataatttttatattcagcatgttctagttgagttctcacattaggtaatatacgtctgtgagcccttcaatttagaaatatgagttattagtaagaaatatgagttataagtaagagattattaaactaccagaatgcagataaatgaaacccataatgaataatacagattcctatatactcttttcataaacattagaaaagatgaaaagcttaatttagttgaccaatgacccacataaatatattttatggatatttttctggatgtatataggagtcacaaacacatttaatagtattaagcaatcttagtttgaaatcatcagtttcgtttaaatttaaaatgaggactatgaaaacaattatgctttataagcaactgtttatattttcatgagatttaaacaaagcaatttaaatttacaaaaatttaaggcaactaagtatttctttgttataaaagtaaattcagatgtaaaatagcctcaaagcaacttgaatatataaaatcaagaaatccataaacaatcatcattttgaataattgcatttatagccaaacctgctcagtggtaatgtaactaatctagatcacacttatataaaaataaaattgtgtataattttatttttatatataaatatatataattatatctaattttatttttatatattttatttatatatttttaaaaataaaattatatatatttataaatatataattatatataattttatttttgtaggtatagtcctgtgcaatgtcttccttacagataatggttgaaaattagagtataaaagaggtatttttgttactacctagcagttcacttgatgttggtagactataactaaaggataatctgtaacctaatatgatttcaactctattttgactttcaaaagagagaaataaaatagcactatatcatttctaacaagtgtttataaggtagaaattgccttaaattcacatttaaaagaaaccatgcaaaaccttataaaatagcaatatatatatgtacatatatatgatgtagagagaatctattactcttacatggaggcaatttccaataatttgctatatttgtcctgctcttctcagttttatgaagtttttttatggctccagcccaagtattctcagattttaaatgaagagagcattaaattcaccaatttacttagcaaacatttattcaatgggaaatgtactgtgctaggccttgtgagggttgtaaatataaataagggcgatccccatcctcaagaagtttacacagacacaacacaaggtagttaacaaaatgcctttgcagccctcaggaaaataagattagttctgctacagtgtttaaaacttgaaggatgggtagactatcaataaatggaagtggagaataaagtatagaatgaaacagcagatgaagcttggaagacactaagtgtgtttagagaatgaagaggggttaagttaagcaccaaattccccttggaaggctctactgaaaagtgggttatgagacattataataaaaatacacatcggatttggaagatattcaacagtatacttagaagcgtgacattcatgccaagataatgttatcaaatgttgggcatctcttaagatgtatgagacatgattctgcgcttctgaattcatcatcttagctgatcttcacaacaagcctgtaaggagttattaccttcattttataaaaggaaacattaaaccctgaaggtatgcaacgatttcccccaaaattgatgagtgtctgaatcaaaaaacaaaacaacaaaaatctttcttattccagaggactaactcttcactatattttcttttcattttttttattttattttttattattattatatttcaagttttagggtacatgtgcacaatgtgcaggttagttacatatgtatacatgtgacatgctggtgcgctgcacccactaactcgtcatctagcaataggtatatctcccaatgctatccctcctccctccccccaccccacaacagtccccagagtgtgatgttccccttcctgtgtccatgtgttctcattgttcagttcccacctatgagtgagaatatgccgtgtttggtttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacattcgggttggttccaagtccttgctattgtgaatagtgctgcaataaacatacatgtgcatgtgtctttatagcagcatgatttatcgtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatggtgagcattttttcgtgtgttttttggctacatagatgtcttcttttgagaagtgtctgctcatgtccttcgcctactttttgatggggttgtttctttttctcttgtaaatttgtttgagttcattgtagattctggatattagccctttgtcagatgagaaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtgtgaggtttaagtctttaatccatcttgaattgatttttgtataaggtgtaaggaagggatccagtttcagctttctacatatggctagccagttttcccagcaccatttattaaatagggaatcctttccccattacttgtttttctcaggtttgtcaaagataagataattgtagatatgcagcattatttctgagggctctgttctgttccattgatctatatctctgttttggtaccagtaccatgctgttttggttactgtagccttgtagtgtggtttgaagtcaggtagcgtgatgcctccagctttgttcttttggcttaggattgacttagcaatgtgggctcttttttggttgcatatgaacttgaaagtagttttttccaattctgtgaagaaagtcattggtagtttgatggggatggcattgaatctatgaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggaacctaggtattttattttctttgaagcaattgtgaatgggagttcactcatgatttggctgtctgtttgtctgttcttggtgtataagaatgcttgtgatttttgtacactgattttgtatcctgagactttgctgaagttgcttatcagcttaaggagattttgggctcaaagaagtgtgtagagggaaatttatagcacttaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccagaagctggttttttgaaaggatcaatgaaattgttagaccgctagcaagactagtaaagaaaaaaagagagaagaatcaaatagacgcaataaaaaatgataaaggggatatcaccactgatcccacagaaatacaaactaccatcagagaatactacaaacacctctacgcaaataaactagaaaatctagaagaaatggataaattcctcgacatatacactctcccaagactaaaccaggaagaatttgaatctctgaatagaccaataacaggatctgaaattgtggcaataatcaatcgcttaccaaccaaaaagagtccaggaccagatggattcacagctgaattctaccagaggtacaaggaggaactggtaccattccttctgaaactattccaatcaatagaaaaagagggaatcttccctaactcattttatgagaccaacatcatcctgataccaaagctgggcggagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacacaaatcaataaatgtaatccagcatataaatagaaccaaagacaaaaaccacatgattatctcaacagatgcagaaaaggcctttgacaaaattcaacaacacttcatgctaaaaactctcaataaatgaggtattgatgggatgtatctcaaaataataagagctatctatgacatacccacagccaatatcatactgaatgggcaaaaactggaagcattccctttgaaaactggcacaagacagggatgccctctctcaccactcctattcaacatagtgttggaagttctggccaggacaattaggcaggagaaggaaataaagggtattcaattaggaaaagaggaagtcaaattgtccctgttggcagacgacatgattgtatatctagaagaccccattgtctcagcccaaaaactcttcactatatttcattccacttaccatgaatgaggatctgtacaacgttctgagcagcaccatgggacataacaaaactcgtaatttggggacattaatctaacagcagcatgtcacatgatttgaaagccacaagactagaagcaatgacaccgttcatcatggtagaggaattaaaaaacaaaggctgatacttgatgatgggaatgagaatgtaaagaaaactaaaataaaagagataatgaaaaaatatgctgtgatggaatttaggttagtgaataagaaagaggaggaggagaaagaaggaaaaggtggtgcagaaggaagaaaaggtgcagaagaaataggggatagaggagaagagaatgtgagaaagaggggcagaaacatttttttggtgaaaatcccatttggcaaaatgtaaactaacaactaagccacttggatgattttatttactttttatgataactctatgcattagatactattactatctctaatctatcgaatgggaactgaagacttggaaagcctcccttgcccgtggagacagagtctgtagaataggaggctgagatctgtacccacagaattgaattcagcaaaactcatgttcatttggccctccctgtctgtaactgtgagatcagcagggatggttaaccctcttttgaggataaggatcagagaagtattttatttaagggcatagagtaaagttttctgctgtaaaaaatcttcctctattttggggtacagagaggcagcatacatattgattatgcaagcagtaaatctggtaattatctttgaaacgtctttctctttaccttccatttttaatcgatcaccaaacgtcagtgattttatctcttaaattgttctataatccatccaattctctccactttcactgctaccttgctattgcaaacattaacatcttgtatctgggctactgcagttgccttctaaatggtgcctcctacatctgttattttcctgctacagtttgttttgtatactatagccaggatgatgtttttaaaatccaaacctagtcttcacattctgccccctaaaataaaagtaaaatagtaatgtaaaaaaactatcgctttctattgccctttaaaaaaaccaaagtccttcagtgaccaaaagatatttcataggcagcagtgccaacctctgtatcttccctcatttttccatgtagcgctcacactggtgttgcttcatgtgcttggataagctgggactttgttcatgctgttccctttcctaaaacattctctagtcctcatccctacccttccccctttatttgtttaataaacgtttgtccttcagacctcaggtgaaatgtgacttcctcaggagtcttccttgatcctgcaaacagagaaaattcctcttctatagattcttatggctctgtgcttttcctgtggaatccttatccctttcatacatatatattaataagtgtgctttttgttcagtatctgtacctcttgttagtctaaaagcaccatgaggaagatatcacgatttttttgctcttttatgctgagaatttacatccaacatagaacaggtattcagtaaatatttgttgaatgaaccatgaatgattaatagcctcatctgtgcttaaattctagcttctccatttactaaatgcatggacttgggtaattttcgtaagctccacaagcttctctttttccattggatgaagaaggatagtcacaatctaataagtaagattattcatctaaagtttttgacatatagaaagtactgaaataattagctattattcaactacaaaaacttcagggtcacaaagaacaaaactaatgttttttgagggagaaatgtcatttcagtacaaatttaagaaatataaaatacattttaatgttcaggtagtacctgaaaaggataaaacatgtaatttatctgagaagtctaattttattatcataattattaaataattatatatatatatatacacacacacacacatatatataattttttttagatggagtcttgctctgtcacccaggctggagtgcagtggcgctatcttggctcactgcagcctctgcctcccagattcaagcgattctcctgtctcagcctcccgagtagctgggattacagggctcaccaccacgcctggctaattttttgtgtttctagtagagatggggtttcaccatgttggccatgctggtctagaactcctgacctccagtgactacccacctcagcctcccaaagtgctgggattacaggcatgagccaccatgcctggcctaagtaattatttttgaaaattagtatgcattttaccttggtcctcttgtggcccagagtcagatattagttgtttgggaaagtcatagtgaccgataaaagtggaaaatgtggcccagcatactattaaattccctttttcctgtgctgatgcttactgctgtcaggtaaatggagattatgaagagggcacaaacgaatcactagcttctggctcaggaagcagatatagagcaataggcccttcgttatactcagctttagttctgtcacctgtcatcagcatctgtcatttgtttcagaccactaggatatactttctcatccacctgtaccatctccaaaatttccttatgctaccaagttaaaaaataaaactagatgaactgtaaggttcctttccattctgacagtctattattttatccctcatccatctacctcatcaaggagagttggtcaccacaatgctttgaggacatacaatggaaaagtaaataatattattaatagtattgatactaggagcacaaagttaaagtcctaaatatggagaatgagggaaaataataacatgtcatttataagaaaagagttaaaatttagcctgagctttaaagtgctggtcttgaaatctagtgaaccagaaaatttgaatccctccctgttcctgccagtctgttttctcatctgtatgttagtaataataacaggatttacattatatggttgttttggtaaatgggaaagtatctgtcaaatcttttgcactgtgactgggacacagtgatcactggtgaatggtggttagcattgctactgcatgaaatacctgacccatcactatcagccaagtccagagatgctactgatttgcatgtgcagaaaatgctaccaatttctgaattgtatgttcaaagaagactaacaagaaaatagtaaaaaggcagaaagaatacttcctattgctacaaaaggaatgttagttctgtatacaaagtattattttgttgcaaatatacacaaccttttcacgtggggctatggctgctaataaggcttttactctttgtgtaaaaaatgcgtgatttatgcagacagactgtaatatgaaaaccctgcatagtctatttgaatcagcaagtgggcagccacatttatctctgtttactgctgaatagctttcattgttaattccattttctattcctgttgtgcatatcaccccttaatttaaatctttgacaagctaatttaataaaggggatggtttttagagtggaaaaaataaatatctttactcatctttttaaaaattataattagcttaaacaaagaccttaggtatagttcctgtgtttattagccataagagaatatttatgctaaaagattagtttttcttaaatttttaaggtacaactttataaaataattccttcactatttcttcattgttaacatttcattcatataaaggagttgtattttgggtcttggaatgaaaatatccagcttccagagcaaaaaattttcagtcaatcagtatagagaaacagaattttagaagcaataaagtcctagaatgctaaaatgcattgtactacctggtgatattctgttcttgacagtcactaaagacatgttgactattcttatgagatagttctgttctgagtccctgcatcttggttgttctaactgaaaatggcattatctatgaaataggaaaaaaaatctatgaggtatacattagcatgaattctgacgctacagataaatgtaaaaaacatggatagtgtggaaaaatattacagtaaaggagttatgataaggtgcaccaaagtacctaggaataaaaatggaaagaaccaacaattaaataaattagtttcaaatttaaaacatgggtttgcagaagactaatatgaataatactgctataaatcatgatttaaaacatgaatatatatatatgtcactgaataaaatgaaatatatagatatgtttgtgtgtgtgtgtgtgtgtgtgtgtgtgtgtgtattccatttacctgaaagttcagtcacattttattggccacaaatggtcagaagcacagtttcatttgccatattgatggactgttcgttaccaacttagacacttctcagtaccaagccgaataccccaaggagtagcctgggtatcagcagactagataatgaattcttgacacttattcctccagtactgttccaagttcttcatgctgtatccacaggacctaaaacagtgtctgccacactgggctcatgaaataaaaattaataaaggataaaaggaaaaactcctatccaactaacaatttagtatcttaggttaaaaaacaaagcaacttaaaggcaatttttaaaaatttttctcatattaacattctacaaattctattatgcatggcttcagaaaccacagagagccaaatttagctgtgtcagtcacctccaccccagcagcagagtttcccatgtgctaactgccaactgagcctcaactgaagttcatgtattgagtctcaattactgagtcctaacctagttttagacaaatgttccatttcctttcttaggctggtctgctagcctgaaactcagcccacttaactggaacactgacaatctatctaccctttttactagtacccttatacaatgaggttctctccagccaattattgagcatgtggttgaacttgaatcaaccttcttgcaaggacgattttactatcaactatgggtaaaaaacatgccccattccttaagatcatccaaaccgcgagagagagagagagagagagagagagagagagagagaacgagaacacacaggtccagagatgtcattcaggatgtcatctcagacacagaaatttttatttctgaccatgctccttggagaccagcctcacagttgtctcaaaatactgcaaagtcaaacacatgtgattatgacacattaggttctaagatattctcccagaactgcaacactccaacacagtctctagtcatacttttctagcaatgtgagaaacacaggaggcagatgtgagaccagttaattttaaattcataacgaacaaagaattagaataataagaaaaatattatatctaagtttcttcccagtgcagtaaatatattcatatactgaaagaattaatgctgttttcaaagatgccggaattccacatcagcacaaaaagtatggattaagcttctctgtaaccagccttgggctaggaatttgatacaataatccaacaattctatctattacgttaagaagataaggaaaaaaatcatcttctctttctagtaagtataatttgggggatgactggaaacaagtaaaggacaacataagacagaatataatccagtggaaactttagtggtacctgtgtgttataggaacttagaggttgaaaaagtttcatgagagaggtgcaatataagctacacatgcaaaatatgtaaaaatagctcaggcacctgaaacatcagatttgtgaaagatgtcatcatatttcatactgtctatcatgtgtgagtataataggtaataggtaaacagttcgatgtccattgaactataattactccatttgaaatgcttagaggtctattatcaggtgattcacaattacatttgattgattattctgaatttaatgttttctaaaacaatattcaaccacttcttattgtattccagtgtccagagtttctttctatgcctacctagaggtctttacctgaagtttagaacaatcattgttcttattgttatctacttcatgatagatattatgttaccccttcacctattcctagtatgaaaacacctttaaaagaaatatttcattgtgttttcttttcctaaatcctacttgctattcaacacattttgaaggatgaaactgtaatattactactaaaataatgctgttttcaaagatgcctgaattccacatcagcacaaaaactatgtattaagcatttctgtaaccagccctgggttaggaatttgatacagtagtcaaacaactctatctattaagagctcaaagaagtaatagtgagaaagccaagacagaaattttctgtctgattccacattctgtggtctaaatcaccacacttttatgcagaaatatttttaaaactcaatcactgaaaagctattagctgttattattagcagttacacttaaattttgttgcagtaaaactaaaggtaaataaatccttaatttcattgtaactcataaggtatgttaccaaatataaatattatattgacctttatgcaacattgcttgatattaccctatgtactactaatagtcaaacttttaatggagatattttagattacctcttttctttctttcctgacctaataatctatatcttgcaggttattttacacatttatataatatacacagactagtgctattgggggaactatatattaagtaaaggacattcccatatgaaatgtgtataatttcaagataattagcctaactttaaatctagtttatcaaaatcaatcatgttttcatttaaaaatatattgattgtatgtctgtcacagactaaatgtttgtgtccccaaattttatatggcgaaacctcatcagcaatgtggtggtgtctggaggaggggtattggggaggtgattagtgtataaggacagatcccttatgatgggatttatgcttttaaaaaaagaggctccacagagattccttcctccttctgccaaatgagcacacagtgaaaacatggccctctatgagccaggaagcatgctcttaccagacacagaatcatctgctggcaccttaatcttggacttgcctccagaactgtaagaaataaatttctgttgtttatgagccacccagtccatggtgtttttctatagaagcccaaacagaccaagaccatgtcagacattgtactaggtgttggtgtgtgatcgaattaggtgtgatttcttcccttcaggaacttacaaccaaataaaagattcagataagtaagtcaatgattgtctaagttctgtgattaaatgaagcacacagggctatgggagccaaaggacccccatctaaatcacatagtatagtataattaggaaaggctggaggaggagtgactggtccagttgagttttaaagagtaggaattggaaggaaagaaagatgaaggacattcctagtgggaaagcagcaatagtaagaagtacaaaaaaagtcctcaagagacatagttaagaccatgctatgatcttcaccataatcttaacctcagtcaagaccatagaaccacgctatgatcaaagatttaaaatgctatcctgaaatccatgagtcattgcaggaatgctagtggagaatgggtatagatcttacagacacacttcaaacttagatttgcatcactggcagaaatactctttcagatatttttcttaccctttcttattttttacttttaccttctttctatatgggaaaataagttggaaaagcataattgatattgcctctgcagctacatcttcagcatagcatcgttatatattactatcaacatgagcatcatagataacaatacaatgttattttatactaattgggcatactttagcacattgtaaaccataactctagatatcttgacattagtatgtataaggtcttggaaatagctgtaatactgtgataaatgcagtgaacatcaatggggaagtactaaccgtaactgcccgaacctattgagtgtttaattaatgaatgtttgcaatttttgagagacttaatatcaattattttatcaaccaatgggacttaattcaaaaattaaatatgtattcctaaaccaatcattccatgtgaaactgattaagatgtggaaggcccatgaaatatgaaccatttaacatgtgaatacacgtcatgaagatgacattggaaattccaacaaaaatctaaaataagataatggaaattcaaaattaattaatgtgtccatgattaagatataattttaactcagacaatttacattcatatgttatatcttccttagttcctattaagaattaaactcatttagattattgtatttggctgaaaagattctggtaatgccatggtgttcttttgtaagttcataaacaattatcaaatgcttttgttggttcataaacaattatcaaatacttcacatcgtataatcactggaaagagaaaaaagctatcacagatcttagccaattaaagagcttatagtttagtatcaaaaaaaactaggaaaaattaatgtcaaatagaaacatgtaaaataagataatataaataaatgactaagtgtcaaggaaataaagaatataggaaagatatgaattagaattgttcaaggataaatggttccacctacaccttgaagaaaatagtaccaattgttgagcaggaaagagtgaaaatattttaggtgaaatacttatgtatatatgtatttcatatatatatatccacacatacacaatatatgtatgtatttcatatatatattcacacacaaacatgacagaaaagtcatgaagacaataattatcaatgtagttagatgtagttaggggattgaatttaagtggttcacttgaaagaaacagatgaatcattaataataatgaaagatgaattttgagaaatgaatctgagactctgagtatgatttaatgaaaatctttaaagttaaacttttatacaaactttgatgttaaaactaactagaacaccttaaaaagagtgaaataatatacataagaattggagtcactatatataagaagaaagcagtaaatccaaacattagcccaggtttgctttgtggggtttgcttgagggtggtggctttagcaataacaaagaattatatcattagagagtggttccaaggtaaagcaggaagaaaaaatagaatagaagaataaagcctaagaataaaagtctgatgagataaagaaatgtgaggaaggaagacatgctaatacttatgaacgagcagatggaaaagtgtctttaaggaaggaaggcaactagcttagttttctgcgttatacttcgggtgtgcataacgtccaagagctcaaaaacagtgtgaaagactaaaatatctagattcatccactgggagatgatttcaaaacttggagcaagtcagttactctctgcaggatcaaatgctgagaaatgaggaaaaaagattaagtattgaaggttattgttaaaggtcaggagaagaaaagagaaacaaagagggcggaataaaagcaaccagtgatagagaagagattatacaataaagcataatttattctaaaaagaaagtaatttatttttccctttttcctaatctttagaagctgtgaaaagtcagtcatttaaaggtaactttttattgtggtaagaatacttaacatggatctaccttctgaaagttttaagtgtgcaatacagtattgttagctacacacacaaagttgttcagcagattactagaacttaattattttgcataactgaaacttgatacctatttatgtctataacacatttatatactcctgaatttgcgttataactccagaggttaaaaatgaaccacagttgaattgtgtagtgtggataaaatcgatggctctgcataagtggttgagaaatttctgttattctggcacaaacttttggtaattgtaagctatcaaagtctttgccagactgttcagtgatgaaaagtccctgggaataggtaataagagggttgtgttcttaatgtaactaaagtaccaggtgacatctatttgagttactattataattacgcacttttgtatattaggtactctgagacctgaagagtcttgcaagaaaaaaacaaaggcaagaaggcaggaaggacaggatggagggttttttaatattggagggccagaagaaaaggagttatggtttatcaggccccagtccccaaaatggagttgggagcaacggtcattttagaatgatttgactcctctcctttgtatggcttatcctggatgggactcagtaaagacatggaagagaaagaacatcgtgtctcttggagtagatgaaaaggaagatgatgaccacagtgttggcctctctgaggcactgcttgatgcagcctcctccagggtcactgctcatcactccattcctcagtgcctattcctcaggagtgatatcacacagctagctgtcttagtttgcatgtgctgctgtaacaaatacctcagactggttactttataaataatgcaaatatatttctcatggccctggaggttgggaagtccatgatcaaggtgaaaacaaattcagttccaaaggctgctctccgcttccaagatggtgccttgaatgctgtggactcacatggcagaagagaaactaaagggtaaaagtgattagctggttctctccagcccttttacaaagtcattaatcccgtttgtaatgactgagcacttatgacttaatcaccttctaaagacctgccacctcttaatactatcacattgggtcttaggctcatcatatgaattctggggaacacatacatccaaaccatggatatatttataatttacagaagaaaatatcactttcaaaagaaaaagaatttgctccagagtgtataaaccttttattgtcatagaaggaaatacttactttaacaaaatttaagttttacaatattccatactgcatactgttttcattgttagtagactaaaaatttgggccattaacattcaaggtttggacattagacaggtctattatttccagggccatttttttttttattttggttctctttcctttgagcctgggtgggggatatgggaggaactgagaatgagagaagaaaaagaagaggtgaaaagatacaaaagaaaagtttgtggtcatacaaatgatacatttttaaggagctcaaatgttcttgataacattttctattacaagtttaggtagggaaacactggcaaggctctaaacaagcctcagactacagccttatgaatctaagtggataaaaatccagtcttaccatcaaatatattcatggacatttggttaccatttttatatgtaatagcaaaattttctgccaacaagaatcagtgttcagataaaatagtgtttttaaaaatatgtgagaccttcaaaactatggttaaatttgtttttacctataaaaaagctattagcaaatattagacaattgcaagtgttacaaataaacactacatgaaaatactgtaaatatctgtataatcatggaagttagttggaccaaaaaaattgttttaaaaaaaaattaacctgaaaaagttaactatatgccaaaaaggaagatgaatatatccacataatcgattacctcatttttcaagtttattccattctctgcctcagtcccatgttccatggctgtgactccagaaggagtaagcaagaatcagaggaaactgggaggggtggagaccaactctcacaggtcaatgattttaatgtttaccaagcattaaaagcaaagaaacggaggtataatggaacatcccccaaggggagaataaaattagtcctaaaatagtacattacatattggttttggtgaagtgttgcagagaaacaggctgtccttcaagcagtccggttatgttacccatcaggctgacttgtgcacatacggtttaaatcaagaaaggatagttgtcctaatttctttgtgctcataaggggaacaatagttgaaagcagaagttactactacttattgagatccttgaatgtgagatccttgaataacattaagcatggtatcattcaatttatccatcccttttctgctgcctgacagagtcatttctcttctgttatttcctggcaattttaggaaaatatattatggtcacaatatctactagttttaaaaatgtattcaattatttttgcagcgcttctgatagctgtaacactttgctaacctcagacaaattgactacaggattaatgtaatcatttctacagaaagtatttcacagctttaaaatgacagcattctaaaatacgatagtgattccctgacacaggataaagctaactggagaagtttttcgttctgtgtcctttcctctgcttcagaggtcactttgcatttgagttctccttaggctttcatttgaaactgcatgggatcacagtgattatcaggaaatgaaagatccaaccaatgatgaaatgtcatttagcattcttgctgattgtcttcccctcaccaccaacaaaaaaaaaaagtgtctcttatggagacgctgtcaatttatgctcaacatttgaaaacatattggcctaagaaaagggttctcacatttcagtcacaaattttattcacagctagggagttactgaatacagctacttagtctgcagaagaaaaggctgaaaagtaactgagtagttttatgctttttgagacaaccaagacatcaggtcacatcttatcttaacatgctacaacaaaaaggcacaagacaatgtctagaaattaatatgtactttttagtcaacattaaaaggaaattagagaaatattatgcagccttaaaaaggaaagcaatcctgacacattgctgctaatggataaattttgaagacattacgctaactgaaataaaccagtcaaagaaggatacacattttatgatttcacttatataaggtacctagaatagttaaattcatacagacagaaagcagaatgctggtaggcaggagtttagagagagggaggaatgaggatttattgtttaatggtatggagtttcagtttgggaaaatgaaaaaaattggagacggatagtagcaatgattgcacagcaatgtgtatccacttaatacctctgaactgtacacttaaaatggttaaagtagcaacttttgtgttatgtatttggcaacaatttttaaaaaataaaaataagaggaaatgggcaggagatagttagatattggagaattgtgagaggaatggaatcagaacaggaagcaaacatttgcttagccactgctcactctgtaatgtccataattctaagctcaaagctcctcctgtcatccctagccccacagattctggtctcctctttgactgagataggtacagggaagcagtctgagctccactgtggattgcccagacacaaaccaagtgttgcttattttgccttaaaatgctgcaggattgagcttgacattctcctgtcattgcctttttctctttaggtcccattgaagcaaagcaggaagccactcttaaagagacaaagaaatttggagtagcccagtacactcagagtctaatttcttgacctttgtgggaaacaaactagattccatttaattatacagtagtctcattgaaaacagacctcagaatgtgtattactcaagtattgtttgtggaccacatcttgaaaattgcctatctaaactactcacaaaaagaccaaggccattcagagcttttcaaaggaaggtcattaactgtgttccagaattatcttccattttgctgatactcaaatcagagcaaatcatctaattcggtgaagaatagatctagtaccggtatcaggatgatggtctcgatacagaacttctcatctccaaaaatgatgataaaagacgatatgaaggagttgaagtacagggagttttgctataatatttgtttgaaaccatgaattctgttgcaaagtaattgatatactattgaataatttataaatagcataaattttcagtattcttacacataaattcatctggaaaaacattagttgagcacaaaacactcacctccatgaacccagctgaacagacacatgcaacaccccactcccaaaacaaacacacacacacacacacacagacatacacacacatctgagtattaccttggttcaccagtcatcatggtccatccatatctagtgttaacaatgttctgtatgatttcagatcaccctccctctactccttcacattaatgcacatgctgtaatccttccaaagcccacttccacaagcaaatatcaagtcttcttcaagacgaactgccacgtttatgatagtatttatatagtttttaatggtttaatttatgtaaaattatgctactgttttattaagatcctattttttaaatgcgtctatgatgaaaaaattttagtgctacacaccaaccccagttttttcataagccctagggtttctattgtgtaattaagtgtactacagtgatttttaggcatacatatgtattagagaagaagtgattgtattgtgtaagtttgtgtcacagcattactctctattgattcacagtgcaaagaaaatgtgccttctttatctctaatggcccatagtatattttttttcatgaggtctccacttgcaaggtagcatataagattttactctcatgaagtatctcttattttataaagaaatggccttctaggccctctcctcaagaatctcaaacagaaactgggaaaactgtaattttgtctttggctttgttctagtcattggacctaatgtgtatagatctcactatctatccagtgcttccatccctgtctcctttccatatcccttgggcctaaaagtatatgactttcattcctgtgtttttttagcctggacttctcttacatattattccccttccaaggacagctagcatcatggttcagccagattgatgcaagcaataggcactccaggctatggaagaacctatgattgagttgcagggtatctcttgatattaactaggataaagaattggaggaaattctttcatctctcaacaaagcctggctttaaagattatgttttaccttcagtctcaaaaatcctacactggatatcaaaatttaaaagttgattgtttctttttgcattcctgcaataacaatttgaattctctccaaagacagaagatgcctgtcacaggatggggaaaatcacttgagaggaaatgtaaaaaatagcaaaaacaatcaatgttttccaacagatattagctctatcacatatactatatgaccctcttctctttgagttggcataggtactacattttatatgatacttaaaaatataaacattgaaaaacataaaactgaaattttagtaatgtttaaagcatattgagaaaaatctcaccttcctgaaattctcagattcatgtcagaaaattttgcttgtgtaattttctaccctagaaagagcatagccatttcttcatcacatcaaacccaagtacagtatttggtaaagaggaaataagagaatcagtcatggtccatgaagagaagtcctgtgacctttctagtgtattggactataccaccaaactttactcttgaaatacatattttctcgtaacttgtgagtagaaaaataaatatttatttcataataagaaattacatacaaatgttccactattcccctaagatagttcaacatgaaactagccccatgcataaagttgaagaaatatggaagaaatttgttggagtagacttaaatttcaaatacttaataataaagtcatttaaaataattaatacaatttacttaataaccaaatattatgctactatttaagatgcttactgtctaagttttttatgtagataatgtaaggaaagttactttatgtaaattaatattcaatttattaaagttatacattcaagtcttttcttaggttaggttcaattaattgcaaattaatgatcacatatttatctggaagagtaggaataataagcattgtactctgtaacaaaattaatacaaaagattattttatctgagcataaaaaaagtctgcaagagataaattttcagtgaaaatataccatatgtccagttaaaattagactgtgaagaataagttgaagaatccaatatttctttaaaattgttaggagtatgtttaaacagaaggcatgattgttttctcttttaatgcttttctgaattttgatacccttactctgcagcatccagcagaatgttttatgtaaaaaaaaaatggtgctaataagtgtgtgtggagaaaatgaataaaaatatttttattggaaaaaatatttagattcatcttacatgattttttaaaaccaatttatacattaggtaattgttttgaaataagagcaatacaatgtctcctttgactaacgttcaaattaattttaagagattgaatttctctatatagttaatctcatttacagagagttaattatattatcttaaacacttatgacattaaatatgtaactttagtacatctgattatctcaccattttaaatgtcggaaagtgcagacaagcctagcatacagtcttcctaagaacataagcagttcttgtaaagatttctaaattttatttattacttcagataactcaaataaactaaagcgattacactatatatttttaagttgaacagaaaaataataatagtgacttgacttaatttattatctctctaattatttgttaattttttcaaggttttacacatacttaggaaaagagttactattttagacagaatctaaatcatgtgatagacatttgtcacttaatcacatatttgagccacaccccccaaaaaaataacctgggaccttacattctttcggattcaaaccaagttacaagtaaataccctgaaactttttgtagttggtttctatctgcttgttcaaaaacagaagccaaatccatatatttctgttgggaattagttttgtaagttggtgaatcacttgtctcctttgtcaagtgtcatcttaatactttttaaactgcttttagctgtttgggtaggaaggtagaattcttaggttgcaggtatattccagcaccacttgaattaatttatttaatcttactaactgaaaggattcttcattcttttcatattattttctcttttgactcttggccatgattcaacagagagtatatgaatacaagcatatatttgaaggtaggaatggtaggtctgtagtggaatgttaagcacaattgacctaattgtcaaataaaatgtgcagctttcagttgacatggtatgagcttgaatgatatttggataatatggatgaaagatggataagataggagagtagcagctcagatgaaaaatgggaagatctaattcaagcctggctcttgtatttaatctttggaagatctctcaaggacaagatgatctattgtaatcctgccccattttcctaattctgaaattctttgagttacttaaaaaacaaaggaagctatatattgtcttgaaagtttttgaagccagtaactactattgcaaaagatgaagctaacagtaaaacatctctttcttatgttatcatgctacctgaatgattcactttaaatagatttactttgtatcttaacttcaaactatgctaatatttaatccttgaccagaaccttggaatcttatattggttgaatgcaaatatttactaattagatttatgtacccataatcaacattttctaaatacttttaccaacacatgatgttactatttaacctaatgattatattttgatgtaggttttgatccaatgaaaaatatcaacgagccggcatttccccatcttctcttgttttgtttatgtcctttgtctcttttctactttccttggcaactaaagttcccctaacaccttcttatctgcaattaacttgatcatatttgtttttgctactttctgaaaagagaattttctgtaatggcagcagcactactctgagaattgaattccacattaagttaacctctctgttgtcaaaaaattaaagtactaaagtgtttaaaaaaaacttacatcacaaatgttcaaaaaatgcagattgaaatccagacacaggaatcctttgatgatagataattggaattactgtaaaaaaataagtattattacctttttccaatggttctcagcctaaacactgttattgttgaaaccttttcactttttatccacattattctaatagtgtctgaactgatctctctgcctgatatatttgcttgtaccaattttttttatagacttctggccatatggctttgccttaaatgcaattctgcacctattacactccttttgagtctagtattcatttgtttcacaagtcacttgggagcacctactacatgctgagaatctggcattttctcttaggagaagtcaccaataaatacaatattccacatactatgaaagaggtaaacctaaacatcatagacaagggttcctcgccaagaagtcaggaacaagtgtcccctagaagtgatagcaaaactcagttgaatgagtcagacaaaaatccacaggacataaattagtaagagaaagaatgtagcattgggagagggaaggatctatgtgaagcaggttcactgtgcactggttaccaatttgtctgagtctagggagacaacacatttataagcaacaggcagatgtatcacttacagataggcagcaagaaacaacagaagcccaagatttattgtgagctgaattcaattctgtgaacagaagtccaacattcattgtaagtcagaaagctgcccagggaagatgagctctgggctgctcatggccccacttgaaccacagatgtggaaccctgagaggcagctcatcctggcttatataccttggggtcacataaatcactgagctaaattattgaagggcattctgctctgggagaagcctggaacagaacctagctgctccagccagttagctttatctcaggatgctgcactctcagcacactctgtgattattcttaagaattacacataagaaaggggaaagaactgggtcactccagagccagccagaaaactgtcctgcaatctgtagtacagtaaaagccttgttactttacataatcaggaccagtttctgattaaagagttaaagagaagaattatttcttttacaaaaagatacatcagtcttgtattggatacagattaggcaacaaaacaaaatacagcggtttttaacaagatagaaactacctttacacattagtctgaacgcaacctatctaagaatgatgtggtaacttttgtaaagacccaggtgctttctataaagctgttgtttttaccccttgtgtgatggcctctggctcctggttgaagatgatcaatcagccattccagagggagtgttgtccacctgctctcatgccccctaccatggtttgaatatttgcccccttctgaactcatgttgaaatgtaatcctcaatttgccagtactgagagatgggcatttaagaggaaataagattatgaggtttgtgctcttatgaatggactaatttattcgtagattaatgaattaataggttagtgaattaatgggttattatggaagtgggactgatggctgtatgagaagaggaagggagacctgacctagcatgctcagcccccttaccatgtgatggcctgtaccacctcaagactgtgcatagggtccccactagcaagaaggcccccaccagatgtggccccttgaccttggacttctcagcctccataactgtaagaaataaattatttttcttcatactttacctagtttcatgtattctattataagcaacagaaaatgaactaagactccctctttttcttccctgcatttatcttgctgatgtggggaggataggaaagaaagtgactatagtcactgtctttgtacatacctgctcttgagaaactgttagtcctttatcggccatatcactgtgcttttcacctatttcctgtgaccatgataagtatgagtgatggctttagcaggctcccttgacaagttggtcagcctctggagacactggggctttagtctgacacccagttggtaaacatccctcaaaaatgctctggtttatgctttttttttagactgagtctcattctatcacccaggctagggtgcagtggcatgatcttggctcactgcaacctccgcctcccaggttcaagcagttctcctgcctcagcctcccaagtagctgggattatatgcatgtaccaccatgcctggctaatttttgcatttttagtagagacggggtttcaccatgttggccaggctggtcttgaactcctgaccataggtgatccacccaccttgacctcccaaagtgctgggattacaggcgtgaaccaccacgcctggcctggtttatgcatttttttgtccccaagatgatatggtttggatttgtgtgtctgcccaaatctcatgtcaaattgtaatacccattattggaggtggggactggtgggaggtgactggatcatgggggtggatttctccctttggtgctgttctcatgacagagttcttacaagatatgatgaagtatgtagcacctccccacaaccttcctcctgcctggccatatgaaatcctgactgccccctttgccctgtgccaagattgaaagtttcctgaggcctcccaagaagcacatgccagtatcatgcttcctgtacagcctgtggaaccatgagccaattaaatctcttttcttcataaattacccagtctcaggtagttgtttatagcaatgtgagaacagactaatatagaaaattggtactgagaagtggggcattgctataaagatatctgaacatgtggaagcagctttggaacaggcagaggtcggaacagattggagggctcaacagaagacaggaagatgagggaaggtttggaatttcctagagacttgtcatatcactatcagaaatgctgatagtgatatggacgatgaagtccaggctaaggaggtctcagatggagatgaggagcttattgggaagtggagcaaaggtcactcttgttatgtattagcaaagaatctggcagcattgtgctcctgctctagggatctgcggaactttgaacttgagagtgatgacttaggttatctggcagaagaaaattctaagccacaaagcattcacagtgacctggctgcttctaaccacctatgcttgtatgtgtgagcaaagaagttacctgaaactggaacttatatttaaaagggaagcagagcataaaatttgaaaaatttgcaacctggatatatggtagaaaagaaaagcccattttcagtggaggaattcaagcaggctgcagaaatttgcataactaaaaggaaggcaagtgctgatagccaagacaatgggaaaaaggcctcaaagccatttcagagagctttgcagcagttcctcccactagggaggaggtaaacatgatttcaaagtacaggcccagggcccagttcccctgtgcagcctgggaacactgctccctgcttcccagctgctccatctccagcagtagctgaaagggtcccaggtacagcttgggccactgcttcaaagggtgaaaaccataagctttggcagtttacatgtgataataagcctgcaggtacatggaatataaaagttgaaacttgggagcctctgcctagatttcaacggatgtatggaaaagcctggatgtccaggcagaatactgctgcagggctggagccctcatggagaacctctactaggacagtgtaaaggggcaataagtccccactaaagcactgcttagtggagctgtgagatgaaggccactgccctccagcccccagaatggtagatccactggcagcttgcattgtgtgcctggaaaacccatgggcactcagttccagcccctgagagcagccatgacaacaggggcaaaactgtccaaagccttggaaatccaccccttgcatcagtgtaccctgaatgtgggacatggagtcaaaggagattattttggagttttaagattaatgaattccctgctggctttcagaattgcagggggcctgtggcttctttcttttggccaatttctcccttttggaatggcaatgtttacccaactcttgtaactccattgtactttgaaagtatctaacttgatctttattttacaggctcataggcagaagggacttgccttgtctcagataagactttggaccttggacttttgagttaatgctagaatgggttaagactttgggagactgttgggaaggtatgattatattttgcaatgtgaggttgtgagatttgggaggggcctaggcagaatgataagatttgagtttgtgtccctgcccaaatctcatgtcgaaatgtaattcccagtgttagagatggggcctggtgggcagtgcctggatcatggggatggcagatttccccctttggtgctattctcataataaaagttctcatgagatctgattgtttaaaagtgtatggcacctcttccccaccctttctcctattccagccaggtgaagtgctggctccccatttgccttctgccatgattgaaagtttcttgaggcctccccagaagcatgctagcatcatgccccctgtacagccaattaaaccgcttttccttataaattaccaaatgtgaggtaatgtctttataacaatgtgagaatatctcatagtggttttgatttgcatttctctgatggctagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcacagaagctctttagtttaattagatcccatttgtcaattttgccttttgttgccattgcttttggtgttttggacatgaagtccttgcccacaatgtgcacatgtaccctaaaacttaaagtataataataaaaaaaaaaaatgtgagaatagactaatataccaggttgaacaatttttggcaagtctattgctaccaattacaattttccttcatagataactcatgctggttgtaggtgggcccaggaggaatctgtcctctatacctctctggaattattaattcatactggtgattcttgtccctctctacttagacattccactttgccctctcctcagtttcctttcacttctccaggtagcatcagataagctgcaagattaagtataaatgcaatggtggaactgactatcagtctttctttcatgttgaaatcctcatacttgaagagtgtttttctaaggatcctgcccttggcaggatgttcaccagttgggtaccattctctcctttttcagtgtagagatgaaaggagaggacagttcacaactattgcatgctctcaaaaggcaacttttcacatccaatacctcctcttttactgaatggggacagagagatgaggaggaatgattactgatagatgccaccatgcggtaggtcttgtggggaggtagatggcaataagaagaagaagaacagtaaccattgagtacttatatgccaggttctcttctaagtgttttacacatattaattcatttaattcctccccaaaccactatgaggtggtacaaatttctttttggtagatgtgcttgggtaacttgcccaagtttgcagtcttacaagaagtggagctagaatttgatccaaggcactccagttttaatgcctgtttccatgagcagctatagttatactgatgcttaggtgctatggagcattgagggtcaactgtcaagatgactcaggaagagggcagatatgcaatttgaagtagctgttgaaacatggcaaacacaacatagtatgatgctagagagtggatagatgagaaaataatgctggtgtggcccatcagataaagaagcagtcacatctcctaaaaacagatgctatgtctcacaaaccaaatagcagtctttttgtatatacatggtaggaaaattgttgttaacccgatatcagtgttgtctgccacaaatacacacatgaataacaagctgtcaacagaagcaccttctcaaggcatcaaataaaatgatgtgtagcagttactttaaatctccgtagtcccttttgttcatatttgctgtatcactgtacccacatattcaacaaactctataaccataaataaactggacttcagttcagtcctgtgacatcacataaaatgtttgaattctagacagaattggcaaattgttgtttttacagaatgaatagaatttgcaacatgatcatattagtatgcgtgtgagtgctgtgtctgtataaaagtgccttgttaagtgataagaaatcatctgccaatgttgtttcttaatatttaatcatatatatattaaatatttatacaaaggtgataatagaattatgtggccacagtagaaatacaagagaattctaattctacaatattgtgcctaaaattgtaatccacttaatcatccttcattgcaaatgttttgtaacttgacagctattattaaaaaaggcaaaatgtggcatattgtaaaaaaaaaaaaaatcctcttaccaagtgttcttgacatttgacaatgccattaagctaaaagtatcaaagacagagttttaaatcatgtgaagctgtggttaagctgatcttttccaaaaaggtttacagaaaatgtgttttaacttattgccatgaacaaatggaggcaacctacatttttttgaatttttgagattagtaatatatccataaagtagcagggtcatacattgtctgtaccaatataccatggattatattacccctatggcacctatttctcatcccccccaaaaaaaccaataagattatttgaaatatagagtgataaaatgtttcagacaattttccagatgccgaatttctaagcaaagaaaacaagacacaaagtaaagcaaataacagaggcttgaggtaagcagatataaatttcttcatagatggccatccaaatgaacagaaagagattgtaggatcagtgcaccaaactaccaagacaacttcagtaaatagtttagaacacatagcagcccccactccgtggctaatgataatgaaatcctagtcacaagctgctcctacaattgaaaaatgttgattttgctagctttgaattgtcatctctttaagaataaatattgatgacttagtgccattttaggtagatattttaagaacccactagtaacacacacacctatcttcccaacagccgggctgttaacataataatttatacaacgtcacctgctgatcctggagccccactctgaggagagaagttatgcataattaattatattcatattttaatattcatattgctgattatgattgtcatgatttattatccaaacttcatatgtgaggcaaaagcattataaaagatatgttgtaaaaggtgtttttttttttattagcagaactaattgatttgtagatgaacacttttctttacataatggaagcatattttgattactctgtgaataaaaccacaattactcttctcattttaaaaaggtacaaaattatttgtcttttttgccaatttcttacttgatttagagaccgtgaatgtgaacacaccatttttatttaaaattccctgtcatgctatagcttgcctctctcttaaacagtgataacatgtgtattgacatactaacaagaagaatttgaattaaggaggaaaagaccatctgaaaagaattccatatttctccatgtagaaataaggaactaatctgttatttcttaatatgaataaaatttagagatatttttgataacctatgaatattagattatctgctgttaattaaactcaggcctgatatgatgcctgaaacatcatatgcagcagaagatgccattacaaaatgaaagtacatcatctgtatctactggagtttccttgagatttagcttcaaaaggtaaaaactagttccgatttcacagagaaaataataatggagaccaatttatatacaagtacagtttttcctgttgcaacatttcggtacagacattcattcaaattcttgggaaaaaactgccgatgtgcagtttgtatatctcttatattcatacatggaggagatgatttatatgctagtcaatatttaagctgaatttggggaattctattttagctatgcaggggcggcgaatatgatgtactaacacttccatttaaaagaacttgtgagcactgaatttgtaatctaaatgttagtagaattaaaaagagggatggaggtggaactgggctacctgccatgtaatatagtgtggctagtacatatatttggttagccaaaacaaattaaactcagaaaggaggtaaaagatgctttattgcaatagtcatattcaatctgaaagtcaacataaaagtgtcttagcgtgaatggttattttctttctttaatgaatgtatatggtaggctggaagtcattaagctttaaaaatttagagaatatttctatatggcaaagtaaaaaacctattaattaatctgagtttctggcatgctttgttccattaagtatagacttataggaaaaagcaaaatataggagaaaaaacaacagagagaaaaactagaggttaattgcctttgttgatttccaagtagttttgacagctctgatccattaaaatatgtgtaaaaattgatgaatgtattcttagtaagactgtgttttgagaaggtttttctcaacactgaggttttattccattcgtaatccaaataaaagctgactaaattaaattaatagaaatgtcagcttctgtaagtgtgcattcttatgctaaaaatattgggtaattttctcatagctttccaatggagtttgcacattcacatcagagtttatttggtggaaaggagtaatacctgattagtactttttctttttcttactattttccttctttgggtaggtaaataaaaaccttagagtaattgcatgagttatctattgctgcataacaagttatcccaaaatatcatagcccaaaacaacaaacatttattatttcactatttctgtgggtcaggaacctgagagtagtttacctgaaaggttttgggttagagtctctcctaaggctgccaccaagttgttggttggggctacagtcatgtaaaggtttaggtggaggaggattattctaagttcacctatgtggttgctggtgggccctggttcttcaccacgtggccttcccacagggtgcctgatgacatgacagccagctccctcagatagggggagaaaatgaagggtaaacacaagtgcacccaagatgaaagacaccatctttttatgacctaatctaggaagtgacatcccattttctgtcacattcaattcattagaagagaatcactaagtccaacccacacttaagtggaggtagttaagttctacttcttgaaggaaggctattgtattaattttctattgctgttgcaacaaattaccacaagtttagtaactttaaagactcaaatttagtatcttaaagttctgtagatcagaagtccaacataaaggtattagtagggctatattcctttctggaggctccagggaagaattcattttcttgtcttttccaacttctggcagcctcctgtattcctttccttgtggccccttgttccatattcaaagccaacaatggtgggttgagtctcatatcatggcactatgacctcctcttcttccctcctcttccaaacgtaaagacacttctgattacatgtgaatgtacccagattatccaggtaaatctccctattttaaagtcaatttaatttccctttactttgtaatgtaacatatttacaggttccaggaattggaatgttcacatctttgggggactgttattctttctactacagttgtcaaataatttgtggatatattttttaaacctctacagtaataatgtacctagaatcatcctcctgcccaaatacacacactcaaggtccagtcctttcagaatatttattaaagtctagtggatcactaacccaggtaacaaactgcctgcactagttattcagtatccaaaagagatcaacatccatacctttctctttctcaggtatctatggttgcccagattaagtaagataaaatttttaccttaaagtaggagaaagtaactgggtttagtttaagaaatatatacatctggtgtcagaaagaatttgttataatctgagttttgctagaatactgccatgtggtcttatgcaggttactcatctcttttgcctaaggttttcttacttataaaatgagggaaataatattgatgttgcacagatattgtacagattcatttataattcagaaattgattatttcatcttctctgttgtccaaaatctactgttttataaaatgactgctattgatactgttacgtatctgtgatgtgatctttttcttctaaatcttgaggttactgataaacaatatctttttaaaaacatagtctagacctccaccagtgatttatatgtctcagccctttcaggcaggtacccagcataaacatcaagactcctttttgaggaatcacatgttgccccatttgcctatcttataggccattgctagacatagtaattatgccaaaacccttttaatatttattcataaacaagccccaagctaatttatccatgtacccttagatattatttttcaaactgaaacttctcattgttactaactataaaattaaaaattataaaattgattgttatttgtgaatgacactgtaaatttagtttaaaattcaacattgaagataaaattagattttttttccatgttgatatgaatacaaatttgggtggaacagagcatggtggtaaaaataatgttcttactaaattaggagacctatagaacaaaaatgtacttgaagttggttatgttatacaaataatttattgttgcatccaaagagctgtgatattctaccaattcatacaagcagagatataagtatcacattttataaatattttatgtatatacagtcatgaaacagaaatacaaaaatttttgtgataatctgatattgagacgaaaagaaaatatcagcgtatttccacagaatctatctctttactacctatcacagttggattttaaaaatgtttacatttaccacataaattatttacattttgtttacattttattagaaattagttggaaatctctaatcaaaatgttaagcaaaattcagatttttaagtttgtaaagaatttcagttattaaaagtaaatctcatgaatgaaaagacaaatttattctcataaaagcaaagaagggagtaaataaacattgagagatctgaaggaatacaagatttaatttgaatgccaattattaggctctgaaatatctcaatttgaaggaaaaggttttaatggagcttctatttataattagatagttatcttctgtatcagaatagaatgaaattgagaatgcctgtaactgcatgatatctacatttgctgagacattcagaagaaaattaaaacatttttgacagttttaatcatagaaaatatgttaaaagcactctgtgaatggaggtaaaaagaccacacttataaaaatattggggctaaaatatgtacacatttcactacaaaaatagaatagggaatctcttccatttatcataattggctctcagcttattttcctcagcacctgtgagaggaagtattttctcaattaaaaatgtaatacttacaaagcaaagtcattggaaaagagtcaacaatgtcaaaactattaatgaaaaaatgcaactttaaagacctttaaaattgtatgaaaaattagaaataatacagaaaaattaattttcagaaaaatataactgaccaggatatgatacataagtcaaaaaaactaagcaaagtgtctggaaaatcattcagttcatttatatttaatattcagagagtcaacctaaatttgttttaattacactttaaatatgtttattaaaagaatttatggaacctatagaaccagtgataattacattatccaatgaattaattaaaattttgaaattatataattttaataattttaatgccccctttaactgtaaagtgaccacatagatactaaattgcaagatcatcctaactagaaccttgttcatgaccactttttaccttccacagcaatgttgagtcacagaagctcagataatacactcattaattcattgattaactcattcccatatttaacaaacacttattaagctccatctatgagtcaaatattgttctaggttcattgaatatatttttgagcaaaacaggcaaacatgggagggggtccagtaatatacaacatacataataaattttaaaatagcattgtgtattaggagttataaatcctttggaaaacatacattcaagaacggtaagggggcttatgagtgtgaggagtggtagggagatgacaatttgcaatattaaataggtgagaaggtgacacttgagcaaagatttggaggaatttagggagttagccgtgcattatctatggagagagcaggccaggggagacgaaactgctacagggaagggcaacaaagcaccaggcatgtttgagaggcagcaaggagaccagaatagctaaagaggaataaaggggcagtagcaggatatgagacatgaagggcaagagagggaatgcagtgggatagaaagaggagagatacagatggcgcacttcaaaaatcctctaaacactcttgtttacacaacagctagaagaatttttatctcattggatgttttgtgttcttacttttatattagcttggctttgttattaaatatcatatatcccatttctctcctgtctttggtgaaggatcttagatcttttgtatttccttgatgccttgctctttcaggtttgtattctcagtcaaaagagctctttgaagttttgcttccttatagaattcttaagaatcacatttaatttaatggctttttactttacatatgctcatagacactttatgaaaagaatctttttgaaaataaaatcactaaatatttggtaatttcccaacaaattatataggccttgccataagcaatggattttttaagttaaaaagtcagctttatccacagaatatgatgtttggagtgacagctgaactcagggtcctggcatcactaattattagctgcattaccttgtgcaaataagactttctgaacttcaatatctataactgggaatcaataataagacccacaccacaagatcattgtcagatttttctaaatgtgtgtgaaaatttgatcaactatgaaatgacatacaaatgttaccaaccattattatcatcagtgcattaatatagcattattccattctgagctttagaatggaataattagaaaagcatttttcaaatgtctttcctgaaagctttattcttctgctcagaattcctagtattctcttttcaaaacatcttaaaacaataaaatatttaaagatataattgaaggaaaagatttaagctaaatgtgttatattctagggttgtatacttctctccacatgaaacacatttagtttcctaacattagctctggcatttcattatatttatgaattataaaatacctcacatagcagcctcggttttttaaatgtggaatacaaagtcatcacaaaaaggacctaagaaaattaagtccatatatacgcgtatgaaaagagagaaatgagaaaagtgaaggaacaagaaaagaaataccaaaatcttggggtctcctttgcttcaccaaggtaaaacctgagagttctcaaggaaactgatgatcccgactttctgttggttgaatgttaccaacaggatattctttaaggaatgttttgtcctcaagtatgaaactaaataaactcttgggatgcaatgaaattaatagtgctaagtctgttcactaatgatgaatatatagctgagatttttcaccatgtgatttttagtcttgattttcttaacagttgtattcaccgttgatgtcaataatcactgagcatatttgtcaaattgttaagcaaagttctaaacatattcaggaggctactggtgaacacttgtctggattttcttctattcattgggtttctataggctttatctcttgataaaatatacctccttcatttttaacttttgtagagagaaagatgttcatggaatatagaaaatattttttcagaaaacttattcaagataacagaggacacaaaataactttttttaaaatccaaattataagctttaggaattaagtaaatacaaacttgttaattaacggcattatcatttcgtgtttgctttgtatcctatatgaaacgtgcttctgttctcagctaaaatttttagactagacatagatgaagcatgcaccaaagccacaaggattcgtcaactttcatggccacttatgcttcaaggcaaatcaaaggtgttttgacaattagctaatagaacaaacaaacaaaagaacagagacagatctctatgactcaactgatagagctgaggcatttgccgagtttcctggtagatgtggttcgataaaacgtctaacgttagaatctgtgtcttgggaagaaaccacctcatataccaagaacgaaccctgagggtggtctcactgatagttctcagtgtactgccatgttcccaaagtgtgaaggctacatctttattatgatgcctgttacattttctatagttagcggcaggtttgcttttctctgtgatatccttgagcatacaaaaatgttcatgtttgtttacccaaactttagcatggcaccgggcatatgttgtatgttcaaataattatttgatcaatgaaaatgaatgctccctgacattttaattttattcctaatataacctttgaatgaaatatataataaatatagaaaggcatccaaatatatatgtgctttttttcacttcagtttctattagggaaaaaacagtctaaatctaaataagtcacatacaatgatcaagcttaccaaataactagtaagaagttcaagtttccactttgatttgcccttgcagacacagcctgggagcatggagaattttctggtaacaaatgggaatctggccaaccaatgatctctacattagcattctaataaccagaggccaacgtgccatagtgctgtgtcagaactaatttatgaaactaggtccaaaggctcattaaaatggtcacaattcagtgactgcccagtaaaattagactacagtttcattcttataacaccgaatattttaacatactattaaggacatacttcaagtgttaaaactagctttgatgctgtgaagggaaaaacaacaacattagaaagctatttacttttgtagaagattggctccaatctcagattttcgctcaaaatgctacaaatgtccatattttagagccctgggtgtgctgtacttgcttttgcaactctggtacatttgtgggtttttttgttttgttttgtttcctcagagtaaaagcactgctgtgtagctcttgtaaaccacagggctgtgaacccacctggccaggaaattgcaggcagcacagttgggagttgaattttcttctcctctgctgccagacagatctctctacagcactcctttaatcatgcatcctcccctgtgatgccagagctcctgggacacagagtgcattgctttacaggctgctttccacagccaaactgggtttgagtggcatagaaggtgtgacattcaaaatcttatgaagaacaaggagaggtagtggggaaagttctagattaggagtctggtgcagctgcagttcaatctgctgctaactctcagacagtcctgtctgctgctggggcagggtatcacctcttttgctggttcaatgcttggcacgtgggctttgctcaataggaaaggtggttatagtgaactgaactaacagtacaaataagaaagccatttaatttctcagtatctcaaacatctatatatacgaagtgggaagaatggctcctgctgtgcttatttcacagggttgttctgaggatctcaactaataataactaccaaaacactttttggtggtatggtgcttatacttgggtaatgtatggttatgtccgttcacttgtcaaacataacagactgttttctttatctcctgaatttttattcaatggaacagtaatgaatccctaaatcttctaaatgtgaacagtaaaagagacagaatgacttttcctggcagtctgcatgccatgactgaattatttagacttctatttaaacctgatgaggaaaaaaaaaaaaccctaagaataaagatttgtcttttaaccaattatttcagaaaaatgtttcttttagacttattcacatttagaagatactattgatagtgtggatgtcctattataaattagataccatttccatatcaaagttaaatatatctgaaaaatgacagagccagcagggattgctagtggtagagtaagttgcaaatgtcagtttattgtagcagtgtaaattatatttaatttaaaagactacgtttaacttttaaaatgagggtactccaagttgaatccatggcaaataaataaatataaaatattttcctaaacatgtcagggtatctcataaagcagtatcctagaggagctctgatttgctggatgctaatagatatatcgtccaaaatatcctaaattcatgtatatgtaagaacatttgagttaaatgcaagtgaatctttttttgcagttttatctgttaagtgtaaatagccaagaaaaggatataatgtagcatttttactaacagttttactgtgataaatttgtttcacgatacctaataacatctcccagccaggcgtggtggctcacacctgtaatcctagcactttgggaggccaaggtgggtggatcacgagttcaggagatcaagaccatcctggctaacacggtgaaaccccatctctactaaaataaataaataaataaataaataaataaataaataaataaaattagccaggcatggtggcacacgcctgtaatcccagctacttgggaggctgtggcaggagaatagcttgaacccgagaggcagaggttgcagtgagctgagatcgcgccactgcactccagcctggcgacagagtgagactgtctcaaaaaaaaaaaaaaaaaaaaaaaaaaaactcccaaaacattgttctgataaacaccattttataaaatgtgttggcaacatgtgtttggttagacttactggagcccaaagttatgccttttggtctgtataaatttaattaacaatagacttattgagcatctattgcataaacaacagtgcgtggggtgctgaagggcataagaaactgagtgaaattatgactgccctttagaagtccaaagtcaaagggcacccatactcagtgtcatggaaatggtataataaagtaggtgcgaggtgggagagtcacatctatttgggtgcagaattgaaagtatcttcccaagagtcaaaagcatgaaataatagaaatccattgtgatcacctttaatagtatgcttacaaagattggtcaaataaatgtagttacatggctggttagtattctggtggatgacactttggaatagcacccgtctccatttgcttcatctcatttgcctcaagttagaataggttcagctcattgacttttttcagttccataagtttatagttatatctgtcacggcatcatggtattgcttattcagttttaaattaaagaagaaacaaaaattggctaaatttttgagagcagttaatacatttttaattaacttactgtgaaaagatacagttagtagcccaacaggatatttttcaattgtttgaacctgaggtttaatatcagagggataattttggagcaaattttactttttttatacttttttcatgctaacttgaaatattgaaacttcagaatgagatgggtctattctctgcttagagagaatcatgacaaaatgcaaatggcccttctcccttcaagtgggggcgtgccaggcatcaattagccacaggtagagttctcttaacctgtggtttgttctcttctgctttatccctatggctggaatggagtgagagtagctagcttctccacgcagatgtgatgtgtagtgcacccaaacataaataagtcttatcaaaagaattcatttaaatggtgcctgtttggttttatcaatcctcactcagaagaacataattctaatagccagataacaacgtggaccagcctggtatataggcatctgtaaaggtacttctgcacaatgactacaaatttaactaggctttttgaaatatgccaaaagcatttattgggagtgattaaacccacatcatttcttgagaacagtttaagagctctgaacgttgatattttgtataaatctctttgtaaatccagaaaacaaagaaataacaccttactttttgtgtctcatgttttactacaaagcccctagcttatgagagcgtagaaaattgaaccttggtcattcttccatttactctactttgtgagtaacttacacagtgccaggataatcagggaacaaaacctcaggagacttctctgttgttggtgaccacagagttactgctaggatgccatactgtgtgtctggtcccttcaaggccaacagctcttgaggcatgagaacctaagccttggcttccaatgaagctggattgtcctgaatacccaattaatcttgtatttataaagttcaatacaaagggactgctcgttcattcgaatcttggcaaagcttatgttcactatgattacctgagctctttgcccactgtaccctcctccatggaatcctttctgcccctttcacccttctccctgtctactaaaaccaggttttagatgataaacaacatagcactgcagaatatgtaaatatgcatacagatatccttcacttaggatggggctgcatcccaaaaagcccagggtaagttcaaaacgctataaattgaaagtgtgtggctgactaggagctatggctcacttccactgcccagcaaagcgagagaagtatagtttctacagaatgcaaattgctttcctaccattaaaaactcaaaaatcgttaagtcgaactgtcataactcggcgaccatctgtatttaagcataaatttccatacatccaaaagaaaattctgcatttgaacacgtttcattgtatataagtggcaaagtattttctttggcattttttaatacctttgaaaggaggttaatgtgtggaaatactgagtttaacaacatttcatgaaaggtttttcattgtatgaatatgctgtcaatctaagtgtgttttcagaatcactgacagtatattatttttaagaacaagataaatgctacaatattttgtcaataaacttaagtctcaagctttttatttattgatgagaataattttacatgttcattttatgtcattaagtctaagctagaaatatataaaagatgtctgatgatattttcatgcgcatgtgccctctaccatcattacagagcttaaaaaacttgtagaaatctgtttttattttacatgctttttttgttacaactgtgtcacatctaaaagattcagacagcctcgatctggctgtgccttattctaagtcatacaagagtcactattttcctgagtgattcttgggtctttcctctactcagaaccctaaattacatcccactcaaatcagctttgaagctctaatggggtttctaatgatcttctcacacccaataatccacccacaacatgttctcttttcttaaatataccagctcacaatctgctaaaaccacttgttcactaaaacctaatgtctctggcccagcacggtggctcacacctctgtaatcctagcactgtgggaagccgaggctggaggatcacttgaggtcaggagttggagaccagtctggctaacatggtgaaaccctgtctctgctaaaaatacaaaaattagtagggcagggtggtaggtgactgcaattccagctacttgggaggctgaggcaggagaatcacttgaacccaggaggcagaagttgcagtgagccatgggcgacagagtgagactctgtctcagagaaaaacaaaaacaaacaaaaaaaccctattttctctgatgtgaatatttatcaacacataatttacagttttcattcctattttcttaaattccttattagttataaattacatacagaataaagtaagtaagttatgaggaataatgctgtaatttacagccatgctcttaccacccaatttaagaaatactaccttactattaactttaatgtcttctgggtgtcgtttccaagtcccacactttttctactcctttagaggtaaacttcatcctgaattccttgtttatctctgccttctttttttagaaaaatgtttatttccataggttttggcgaacaggtggtatttggttacataaattctttggtggtgatttgagagaatctgatgcacccaccaccctagcagtatacactaaacccaatttttagtcttttacccttcaccccctcccaccttttcccccgagtccccaaagtccattgtatcattcttatgccttcatatctccatagcttagctcccacttatgagtgagaacacacgatgtttggttttctattcctgtgttgctttacttagaataacagcctccagttccatccagattgctgcaaatggcagtaatttgttcctttttatggctgagtagtagtccatcatatatatatacacaccataatttctttattcacttgctgattgatgggcctttgggctcgttccatatttttgcaattgtgaattgtgctgctataaatatgcacgtgcaagtatctttttcgtataatgacttcttttcctctgggtagatacccagtagtggggctgctggatcaaatggtagttctacttttagtttcttaaggaatcaccacactgttttccatagggttgtactagtttacattcccccaccagtgtagaagtgttccctttttaccagattcatgccaacattcattattttttgatttttttattatggccattctcatgggggtaaggtggtatagcaccgtggttttgatttgcatttccctgatcattagtgaagttgagcattttttcaaatgtttgttggtcatttgtatatcttcttttgagaattgtttattcatatgcttagcccactttttgatgtgattatttgtttttttcttgctaatttgtttgagttctttgtagattctcgattttagtcctttgacagatgtataaattgtgaagattttctcccactctgtgggttgtctgtttactctgctgtttcttttgctgcacagaagcttttttttctagttttatcccatgtatttttctttttatacaatatatcattcaattttgcaattaaatttacatgaaagaattcatactgtcagtatttttccagggcattatttttgttcagtgttaggtttctgaggttatcaatatttcaatatttcctatggccctaattcattttctctctctctctctgtctctgtcatttctctactgttgtatagtattccttttggtaaatatgctaccatttgtttatcctattaaaaatacaatgggtatttgtgttttttccaggaatcttttcaattccaatgtactacaatgaacaaacttgtatataccgtatggtacacatgtgtaaaaggttttttaagtgtgtacttcctggatcacagagtttgaacattttaagtttattagaaactgatgaattatttttcaaaatagtttttaccatgtacatttatatctgcattctacacaaattctatttgctcagaaatgccagcatttgatattaccaggctttgtaaaatgtaaattcaatgggttttatttgtatctcatgatgttttaacttgcatttcccactactaatgaggttgagcattttttcatgtgtttattcaccactcatgttttcccttgtgtaaagtgcttttactaggctttttattaattttctatttggtgttttgactctctttactatgatatgcatgagtttcctatatattcaagaaacaaatcctttgtcaaatttatggttcttttcactgtctttatgtggctttttatgaccagaaattcttaattttaatgaagcagaatttatcaattttgtattttaaggttagcgattttttatgtctggtttaagattatcctcccatattcttagctcaaaaagatattctattttattgctttctaaacattttatattttttcctttcatatttaggcaatagtaattgatttttttggtatggtgtaggtagatgttcaatttcatatttgtccttgtggataaccaatcattccatcattatttatttaagaatcagtctttccctcactgatctgctatgtcggctccatgtgtttatatatgtcaattgtatgcatgtacagttttgtcatatatacgtgtgtgtatttcatgttcattggtccctttcctatctctctaccattactacagccttaattaccacagctttaaaataaatattgataaggcaactttaccaacttcataccttttttccaagtgtatcatggctatgtttggcctttgttctattgtacaaattcagaatcagcttgtcaagcttcaggcatatacataaaaaatattggggattttattggaattacatggaatccataattatcttgaagataactgacatatttattatattgagtcttctaatttttctgtttatataaggtaactgtaaaatttttcaatacagttttataatttttttcattaaggtctttcaagtgttgtaatagattaccccttaatactttgtcttttatagtatgtaaataatatactttagactgtattttatacatatgattgttgtatagagatatacaattgaattttgtatactggctttgcattcaataaacttattaaactctcttattaattgtaataatctgtggatgctttacaattttttacatgaacccacatatcatcagcaattagtgacagttttatttcttctctctcatttctaaaattgctttcctgtcttactgcactgactaggacatctagtacaatattatataaagtttaatatagtgggtgtccttttaaattatctgatcttaaagcaagtgtgcccaatgtctcactagacatcatttcttgaagcattaggtataatgtttaatatagatttttgtaaatcttctttattaagtaaggaatttttcttctcttcctagttgctaaggcttttgtcacatatttgtcacctatgttgaatcagatgattttatgtctcacattctttaacctgggcatagtgacctgtgcccgctgaaccacaaggatgtaaaaactaaaactcatgttctggcagcaacaagtatctttaaggaacaagccaggtgcagtgttctttttccatttgatttcctgtttccactcaggtggaatgttcttcaaatcccttactttcttgctagttttatgttgcattctttaaaaggatacatttatattttatccagaatttttggttgttttcagtggtggatagctcagtgtatttagtccactgtgcaagaaatagaagttttccctttcctttctgtcaaaataatatccctcatttcttgaagcacatctcctttagatttccctttctatcatcatttggaaattttaactttgttcaatctagttatttatattactttccaaaccttctcctcccaactttccaatttcttaacagttttacatatttctttaagattgaggttggtcagttgtatgcatagactgttttgtcacatacttaaacctctttttgtgtatcccagagacaataatattttcagtttatgaaggcaaagtatgtgctctcttctcattttgacaaccttggaattcaataactacatattccagttgctgagtgcattttgttgctcctttagtaaacctggtatgatttatgatcaaatccttctagcttccttttctatataaatggaaaatatatcataggaaatttaataagtcctcctatgaacagaactctatttcatacaaatgtttatgcatactgaaaaattcttagcgaaaaatgaaaatcagaagaacatttcattctctttttgtttcatgaagcatttctggccagtcacagcggctcacacctataatcccaacacttcgggaggctgaggcaggagaattgcttgaggccagaagtttgagacagcctgggcctcctagccagacctcatttctacagaaaattttaaaaattagccaggcatagtggcacatgcctgtagtcctagctacttcagaggcagaggaaggaggattgtttgagaccaggagttcaaggttacagtgagcaacgatttccccactgcactccagcctgggcgacagagcaaaaccctgtcttttagggaaaaaagaaaagcatttttgattctcctcactttgctcaacattttgattgtttatagtactcatcgttttctaatatggtatatagtttttaattattatgtttgtttctcactgtcttcccccagtaaaatgtaagttccacaagggcagagatataatctgttttgtgcatgacatatcccaaacagtgcctgacatagagtaaatgctcaataaacatatgttgaatgaatcaatggtgtacaatatttgcataaacaaatagtaaaaagaaaaataaaagttcatgatttacttttctcagatggtttcgtattttcttaatcagtactgttttattttatgctttcagatatcaacatggcaggagagcccaaaccatacagaccaaaacctggaaacaagaggcccctttctgcactttacaggtaagtagataagcactgttttactctatatattagtgaaattttcttgcagctttataaggcaatataacttgtaaggcatccactatttaaaataataatccttattggaataaagtacaacaaatgttgttggtcaacatataaatatatcttgctgcattggcaaggatctcaatgcctaaccttctcatatctgcttatacaacccttctacgagatacttatctaataaaaatcactaatgactctacctgacaagtaggtggaaaggccaatgttggttaactttttttattttattttattttttgagatggagtctctctctgttgcccaggctggagtgcagtggcacaatctcagctcattgcaacttctgcctcccaggttcaagcgattctcctgcctcagcctcccgagaagctgggattgcaggtgcccaccaccacacccagctatcattattattattatttttagtagagacacggtttcaccatgttggccaggttgatctcgaacttctgacctcaggtgatctgcctgtctcagcctcccaaagtgctgggattacaggcatgagccaccacgcccagcccttggttgactattaactgcatgccatgttctttagctattttacatatgttgtttaatttaattttcacaagactcttgcaatgtagatattcctgttctcataatgcagctcaggaacctgagatgcagtttcttagtgattttttcaaggtcacaccactggttaacaatggcaccaatactcaaactcatgccctctgtaccttaaattccactcagtcagtcagccttctttattacaaagtacatgtttctctcatgaccatttttcccagacaacaaatatagtccttctcttctccagagagacagatccaattcctttaacctttcctgaagtgcttgggtctgagtcacttaacactctggtctttcccctctacgtgccccaatttgtcagtgtctatatctatgcggagaatccaggtgaagagatttagcacctttgttgttctgtatatacttctattatgttaagtagaattgagttgattttggggaagagtacaagagtaaacttatataactttcagttctttaagaacagccacttctgaaaaaattatgttctgctgttaaaccatatgtcccacttcatgtgcttttgccattagtttttgtactgtaagtgctgactttgtgtctattgctgtttaattctcttttgttagatatagccaattgttccaggctattgagatctcctgtcatcctatttatttggttttctcccagatacatatcatcagtccatcagtatctgcatctgaagagttaacataaaagtgttgagcaaggcttcctttttctctgatatcatttggataaaggagaattaagttatatgtgttaaaattgattattttctgatttagtatagtaagaagagtgctcaaaaatagcctggagcactttccttgtttttgttctctgaaaactagcatatcttcttttcagccacttatagcctcattttttgaactctaagatgagggtcagaactagatcacttctgaggtcctagtcatgcctagtaccccagggctctctactgtatggtattcagagatttttaaagctatactgaaaaatacatcataatttctcttattttggttgtttttgttttaataaaacattttcttaaaaatggaaagcaatagagtataacaaatgttgatagtgggtcatggggtaatattgacattaaagagcagagatgatgttatcaacaagaagcaaatgacacattctgtaccttgtttgaggtaaaggagatgatttataaaaccgagaaatttttatcagattcatttgtaaatgtatacattagagctgcagctaatgcagaacatttgaaaagtcttattttcaattactgctaaaacaagctgccaatggcttttttttatcatcaaagagttgctactgtctgtgcaatgatgttaattttcatattttctcttttcttggattgttttgattttcttatgagaatggaagctcatgacatgaatgtcattttcactattatttctctattactgttatattcaattgtgttcaaaagaactagaagcagaatttcatttaaatatgctatattgcatacaagccacattagtgagaaagtgcttatttatcctccttttatctgtttacacaaattaaggctgtacactgaaattgcaaaacagtaataaaggggatacaaaaacgtgaatgtatagctgaggaagcccttttatacacattttctcattctcacgtaagcttaagaaaaaaattaccttaattttatgtggacaaactatgctttcatagtcattcacctgttcatcagataactctacaaaattggtagtatatactatgctgtataaatgagaaacctgagtttccaagacaataaagggtttgttcaagacaagatcacaggattaggaaatgtgctcggttttcagccttcacgtctagtattctcaccactagattatagctccctgtatttagtcacttgctaccatctaaacaacacagatagggaaagtagagattttctgagcatcaaaccaatcatcaatactattactgtccatgaataccatgccagcaagtggcagaggaaatactatacaataaacactacataagaaaaaacagatataccacctatctgtgtgatcatagggcacaggttttaagcttcaagtaagtaagttctttttgtaacatagtagttgtataattttcctgagaggatagagttgcataaatgaggtaaaagcatttagttcaatgtagagaatatggtggcggcttggaaaagggatggtttttgctttcctgttctttgcatctctgagtctgtgttttgttttgttttgttttattttgcttttgagacagagtctcaatcggtcgctcaggctggagtgcagtgtcgtgatctcagctcagtgcaagctccgccttccaggttcatgccatacccctgcctcagcctcccgagtagctgggactacaggtgccggccaccacacctggctaattttttgtatttttagtagaggcagcatttcaccgtgttagccaggatagtctcgatctcctgacctcgtgatccgcccacttcggcctcccaaagcgctgggattacaggcgtgagccaccgcacccggcttctgagtctgttttcttatctgtaaaatgcgagagggggactctttttactcggtcattcattcattcatttatacaagatatatttagtgtgtatctactatggtctagggactgtaatagtgcttttctaggaaactagcatagaaaatggcaagaacagggtgaagagagagcataacgtaatgaaagtaagttatttgtatgaaggtagtctctgatttaccttcctgctctaaactgctatgtctctataactattctatttggaccactaagtgaactgccgccagactttcttcttcacgtacatccactttatctccaataccaatcacaaagtggtattcacatgaaatatccactgaggcataactttgatttgtttcttcttttaataggattttcaactcagccaaacaaccttcaataaggccttattatgtgctaagtaaacatggtatacatagaaaataaaacagtgagacttcaaaaagcttacagtcttatgcataagttagatgcacagatgaataaagacaactgagaagtatgcatacacttctgtaagagaataaatgaggaagttactgattctgcctagggagcagggagtaaaaacatctggaaagttaaaggaagaagacaacacttgagctgacttttgaagggaaagagagagggaagggcatctcatagtaggagctaggatagtctaccttgtggggaatggaaaactggggcattatggtgcccaggctgtgaatatatctatatatcaggttaaggagagctgacttttattctgtaggcaacaaggaaccacttaaacatggtgactgatcggaaatggggtgtgaggagagagagtcacaaatatgtccagggttttctagttcaggctactgagggaatgatcacatgagctgaatagaagaaataggaaacacatgataagcaatggcaggctcaggtgtaagatcgaggaaagggagcaaaaaggaattatttcagtcttggacatgaattcataaagacagacaattcattaaaatagcacttgcaataaaaatgtctcccattagagtctatttgtaaatgaaacataattaatcatttgtgaacatttcataaatattggacctggccctaatggtgaatagctaatccattctctagggaaaacattgtaacttttaataaattgctgcttcaaatacgttatgtacattacacaatatctgtggcactctaaaataataattctcccccaggaagtgagttttccagcatgccaactttcaattaatgctcaataattgctaaatgagaataattgtatgatggttttacttctatttgtaaagtagacagacctttcctctttgatggaaagctaacaaaaaatatcagagaacaaagacactatttataagagatgaacaacaatggattttttttcacctagaggtgactcccttctacttgcagggaactcaactcagtaagacatgtagtatatatagtttcatcccattgattctgtaaaaatcaatcatctggtactattgccaaatattgcttttggctatcatacaaatgcctcttgtagcaaccttcccatcccacccagatgaccatgagaatcaagattgtcacaagtcatttcaagagtctttaagattgtcagaagataacctacagttacagccaccattttaagatcatcacaattggtggtggtcaccatgaatgtgggttatattacagtaactccaatgataaaaaataactttcagagcacagaccaagtaaggtgactgcagcaaaatatctccggtgattcattcaccactggacctacgtgagttttgttttcttccttcatggtggctctagcacatcatgggaaaagggacccttgaatcacctaaaatgttccctagaaccttgaaagtagaaatgaaagtaatgtaagctaatttcagctaatgctaaatagcaaaaatcagtatgaaggaaaaacatcctggtcatcttcacttcattgacttatactgtttgctgagaaatgtttaccaattagctattgatcattttattcattttctgtctccttttataacatcaaggataacacacattccctttcagaagcttaatatttccattatcattatctccctttgcactggcaaaggcttccttccatttcacctacccagccagatggttccactcaaactacagtgtgaggaggagagggaaatattttctcctacccgccatattaatacatcctgtccttctgaaactgacacaagcccaaacactgacctgcctccctggtttactttgaatgtatgttattgcttaggtctacatagcaattgcagtctctttctgctcaggatcctatctttcctgtgcaaccaaattactaatgtatggttatcaagatccacaagagaaaataccaaaaacggtgtatatttctaaaactcaaacctgaatatccatacatctgggtaattgagggagagttctctaattcagaaatctccacaaatgaatgttgaaatgcttttgttctagaaaaggggtcaaacattcactttattgattgtttaaatttgtgcaaatgttttatgtgtgcttgttcagtttgcttggtgggaaaaatgttagacatacctcctaaaataacctgagcattatcagtgctttgaatttgatttttttgttcctcagctttttgggctgcataaaggaagatataaaatttcctaaaaggtaatgtatttaaggagcctgcaactattagagatactctacaaattttagttatcctcatcattatgattattcaaagaaaacatctatgataaagtattttaggaggtttttcttgttttttgtttgtttgtttgttttttaagacagggtctcgcttcatcacccaggctggagaacagtgggcgtgatctcagctcactgcaacctccgcctcccaggttcgagtgatcttcccacctcagtctcctgagtagctgggactacaggtgtgtgccaccatacctgtctaattcttttttgtatttttagtagagacaggatttcaccatgttgcccaggctggtctcaaactcccaagcttaagcaatctgcccgcctcagcctcccaaagtgctgggattacaggtgtgagccactgcttccagctttgaaaggttattttatatgtttttagctatgatgatgttgctaaatctcacacagtcaactaaacaggttaatgttttctataacttctttaaaaataaaattttttaaaagattattttacttatagtatgttcctcacattttaacactaagcaaatataacttatagaccttttatttaaaatgttcaaaaaagtgctgacacaatacccattaaatagttctgctgcgggcaattctctctgctaggctaaagaatggcctatttgcagttttctgttatgtttttaatgcatgaatatccattaatatcttctggcatatagaaagaatagagtagaggtagagggagaacttaatgcagagaatccatctctaagacctttgtggtttatgttgctagtcttcaggttatttgaaagactacattactatttgtttggtttgacatagtttatgataaaaatcaaaggaagtaaaaccatgcaatcaattttaaaaggagaaaagtagcaagagtcaataattcagtgggaattgagggaggtgggcaggtaggatcaagcaaatcaagcaaaaatttaattatactaataaaacttatgcagtcacaaagtattacatgagcacaacaaacttagccatgtgattcatggtagtcaaggcgaaaacaggagcaaaataatctatgtaaccatgtagtaaaagaaaatacttgaatatgtgtgagaagaaactatgttttcctaactctgttttctgatgtaaacttattatataggccttcataggaagtcatctaaacagcatagcaggtaccaccttgagtagcatttagacaatacgtgcatgctgtgcacacgcgcgcacacacacacacacacacacacacacacacaggttttaaagctgatgccatttttcttatgaactcaataaaagaatcacacgatattcctttcctttctgcttctcccaaggcagtttactatactgtgacaaatttatcatcctataaaattctaggagtagtgttccatgtagctagatctacagactaggccttcaaattaccacacagctgcatacttggaggagatagaaaggaaaagtgggctgaccccttgcttggcttatccactcagcttctaagtctagaagaaaaagacaatgcttgaatgtctagaacctgtaacagtgaccacttgagctgctacttaagactcctctttctttgaggtagggagaagtggaaaaggaatagtaaaccaagcatgggatagaaagggctgaaatttcacatcattcttacagttggcaggtgccaatgaagacaggcaactgattctttctaactgttggttttactacaccttggaaactgtagcctgtcatgaaattgttgctttcttttatatataaaagcatggttctgtgctgaagctaagatctcttcatcagcaggactcacattatgatcttttatgctatattctcctggcatctcactgtggggtattgcggttagagcaccaacaacagcgctagtccctactggagcttagcaggaacgtgtgcatctcatatgctaggtcattgcgcaagtgctccctgcctgggatgaagatgctttgtgggttttatcttgcaaagggcaatgcccttgcttgcttgtaagttgaagtatcttcattgtcagtgttgatttcatttgttttcattattttatgggtattgttcattgtctttctatccagtgacctgtttcttgttttaggacagtccttagtagagaatgtagggtcttgagcgtccaacctatgataaatttgtaagtccattgtttgttttaattttgaagtgttatctcattccctttgtgctcaccatatcaccttctccttctcaatctatccctgtattcaagattccaggatatgtttttccttccatattactgtatggagggtagcatgaaagaaattgaaatgtctctaaagatttatctctaaatgaatcaaattaaagactaaaaatttttaatgttccagtgttactctctcatcatactgttggggaaatgtaattaaaacaagtattttcccaagtcagaaatcctctccacaaagctaatagagaaagaaaaagcttgtattatcgaataaacattaagccaaaatgtggtgcacatcacaggcaacctaagagactgaagaccgaaagagatcttacctttttatgtagctaaacacatgcaacctattacatacatattttcaatataatcaacaagtagtcctcaagtaagaggattgacagcaccatttgtcatagatccttcattctaactgtttctggtaattggggtgaccatttatttatgttaggtaattgactttatgcaaaagaaaaacaaacttttcatattctcatgaaaggaggtagttctgcaatttggaataagcctcctgcccccactctgcctccccaggtccttgagaaagacattcccaggtcacaaagctgacaaaatgccaatctagtcttcaagtggattcatatgtatttaaaaaagaagatgaagtaattgcaattcacagttttctaaagtaaatccccaaatcaaaaggaagggagggaaatctctttctttattttcaatagggagaattaagccacctgtttttaatttgtatttgtccttggaagcacaaggaagaaaaatcaaggcagaaaaagtgagcaaccagccaggaagtctaaaagctagggctcaggttcaggtttcctgcctccaactctgaaatcattctgtgtttttcttctaattttaggtttttagggttttgtctcatttctttttaaacaatagtacaattggcagtgccatttaaggactgactactgaagattgatggaaagttcctcttttttcacgcattctctggcagttagaaccctgtgctccacctcctggttgctcctctaaagcccctgcagccacatcagggcttcttctataacacagtcttcacacatgcagagatgctttagcagcagacggaccgtgtaacttctaacaatgaaataaatggtaataaacaatttgacaatgtgtagaagaatgtttgagcccatataaaatgaggagaggagagaagaagaaatgaatattaacagtgtagatggacgtgattaatgagaaaccaaacagccctttttcctcggtcatctagtctcactcttacaatgtgaatgattttttaaagacatataaaatcatttacaaaattggcaaattctattacctttgtaaaaatgtatttttccctagtccattaaagtttgaaaatacttattacaaatcataagctagaagactttaggttatataaatatttttaatgttaattatgaacaagttctgcacggtagaaaagtggcttataggttttttaagtgttggttggttttaattatattaattagaaaataatctacaatttccttataaaacttacataaactgtttggtgtctttgtgagagtaattcttctgatggaattataagtactagaagtgaagctagataggcctcctttttccatgtttagacagaaggcaaaagggaacaccacaaagtctcactagattatcagttggctatgcatgatgaatgcttcacacgaaaattcattattttagaagttaattaactgttaaactttctaaatttctttctagtggaattataacatgattgataatttatttttattggtatttccaaatatcacaatacttagggatcttcttccaactctgagagttgacatctattttgcttatgtttattgtatgaaggaatcaaaagacaaggggcttgtttgaaataagcgtattacattggagctgaaactgagatgccacatagtttatgtagagtttgggggtgctttttgttttttataattttaacttttgttttagatgtagggggtacctgagcaggtctgttacctgggtatattgcatgatgatgagagtttatgttttaatatttgtttgacattatctcctcttcccactcagtcctgaagatttcagtgttcattagaagcactggactggaagtcaggaaacctgcaactaagttgtgtatctgctactacctgcccaaactaattaagtgattataaaaaaaaatcaacctctttaagccccattttctcatagtaaaatgaaggagttgaattaaaacacctcttactttatttccatttctaacattctgggattctgctgtttacttcccaatccagagactaaagtcagacatacatgctttattgttaagttaataccttttttccttcaaactcggtgcagtgtcttaaagtattcatgtcttttgactaattccatcctttgaagtatatctaaggagataattttaaatatttttaaaaacatttttaaaaaattaaatttttccaagatgttctttgcagttttatttataatagtgagtaatttatttataatagtgagtaatctgatccaaccaaaatattaagcagtaatgggtatggtgcacctattagatgaaatgttcacaaagtgttaataatgacatgaaaaaacttagcatttgattagagaaaaaaacattttaagttctgggatacatgtacaggacgtgcaggtttgttacataggtaaatgtgtgccatggtagtttgctgcacctatcaacccatcacctaggtattaagcccagcatgcattacctatttattctgatgctctccctctccccacctcaccgcccataggcccgagtgtgttttgttccccacctgtatccatgtgttctcattgttcagctcccacttgtaagtgagaacatgtggtatttggttttctgttcctgtgttagtttgctgaggataatgacttctagctccatccatgtccctgcaaaggatatgatctcatttttttatggcagcatagtattccacagtatacgtataccacatttcttttatctagtctatcattaatgggcatttggtttgattccatgtatttgctattgtgaatggtgctgcaatgaacatatgtgtgcatgtatccttataatagaacgatttctattcctttgggtatatacctagtaatggggttgctgggtcaaatagtatttctggttccaggtctttgaggaatcgccacactgtcttccatgatgtttgaactaatttacattcccaccaacagtgtaaaagagttcttatttctccacagcctcgccagcatctgttgtttcttgtttttttaataactgccattctgactggcatgagatgatatctcattgtggttttgatttgcatttctctaatgaccagtgatgatgagctttattccatgtgttcgctggctgcataaatgtcttcttttgagaagtgtctgttcatgtcctttacctactttttaatagagttgtttgtttttttcttgtaaatttgtttaagttccttgtagattctagatattagacctttgtcagatggttagattgcaaaaattttctcccattctgtaagttgtctgttcactctgataatagttgcttttgctgtgcagaaaatctttagttttatgagaacccatttgtcaattttggcttttgctgtgattgcttttggttaaaaggaattatataaacatcatgaccaaaactacttaacaaataaaatatatgcagagaaaaaaatagagcaaaatattaactgtaattttctttgtatggtgggaatatagataaatttttctttaagcttttttaaaaattatacttcaagttctgtgatacatgtgcagaacatgcaggtttgttacataggtatacacatgctatggtggtttgctgcacccatcaacccgtcatctacattaggtatttctcctaatgcaatccctcccctagccccccacccccaaacagaccccggcgtgtgatgttcccctctctgtgtccatgtgttctcattgtccaactcccacttatgagtgagaacatgcggtgtttggttttctgttcctgtgttagtttgatgagaatgatggtttccagcttcatccatgtccctgcaaaggacatgaactcatcttttttatggctgcatagtattccattgtgtatatgtgccacattatctttgtccagtattactggattcagtattactgaagggcatttgggttggttccaagtctttgctattgtgaacagtgctgcagtaaacatacatgcgcatgtgtctttatagtagaatgatttataatcctttgggtatatccccagtaatgggattgctgagtcaaatgatatttctggttctagatccttgaggaattgccacactgtcttccacaatggttgaactaatttacactcccaccaacagtgtaaaagtgtttctatttctccacatcctctccagtatctgttgtttcctgacattttaatgatcgccattctaactggtgtgagatggtgtctcattgtggttttgatttgcatttctctaatgaccagtgatggtgagctttgtttcatatgtctgttggccacataaatgtcttcttttgagaagtgtctgttcatatcctttgcccactttttgatggggttgtttttttcttgtaaatttgtttaagttctttgtagattctggatattagcccattgtcagatgagtagattgcaaaaattttcccccattctgtaggttgcctgttacctctgatgatagtttctttagctgtgcagaagctctttagtttagttagatcccatttgttaatgttggcttttgttgccattgcttttggtgttttaatcatgcagtctttgcccatgtctatgtcctgaatggtattgcctagtttttctcctagggtttttatggttttaggtcttatgtttaagtctttaatccatcttgagtcagtttttgtataaggtgtaaggaaggggtccaaaacagcatggtactggtaccaaaacagatatataggccaatggaacagaacagatgtctacaaccatatgatctttgacaaacctgacaaaaacaagccatcgggaaaggattccctatttaataaatgacgtcgagaaaactggctacccatatgcagataatatttttcttataactttaatacataatgcaatttttctttaaagagaattttataaccaaaaaatgatgtattttaaaattagacattttcagtgaaaaatgacaaacaccatacaaatgactcatgcaggcaatagtgaaggttttgggaggtggggctggtgttaagcaaagccagtgaaacacatacagcacttaatctttagtactagactgctttagtctccatggttattagaaaagttaattttctaaaagggcaacttcattaacattagtctcacagttcagcgcagtccagtgaccctgtgtggaggcatagttcctactagagctaactgcaggaagtggcctatcagtcagcccaggccaggacagaatgccgagttcagtatgcagagcgaagggcaaggagcaggatatgggggccaggagagcagctgaagtcgtctaatcttcaaaaagaaaaaagtcaaaatatctgagcctttaagtggtgcagtggaatgagcaatcaggaatgtgtgctaaaggcagttcttatgactgcagattagtgagcaggtaggaagacaattgtgcctgcctaataataactgccccctggtatttaaagctgtaattcagctgctttgctgctgctttgaaaggacatagcgtgtgtgagctaaaagagtaacggaataaagtccaggttgtagccttagtatgcagagcgtgggacatgacagaaaaacaggagacacatgatgtattcctaactcagagaatctatcatcaatgcagagcaacaaatggtaatgagtctgagttcagtaaatgtatcagaatgtactttttaagaatgtgatacaccaaccaatagctgagtttgaaaaggaaacagaagatgacccacaaattacagataatcaagagtgaaaaagcattttgagttgaattacttagcaattgttaaaggtagtttaaatgctatcttactaaaactatctacaacatcagtggcaaagacacttatgatactgtgagaattcaggaagaatttaaatggaattgtaacataattttatgatttgttgaagattatctttttctcatttttttccttactctttgttactccaactcaatatagcaaatctcatgtttagaggatcgaaaaaaaaacattatatgatctcattgaaaatatgggctgggtgcggtggttcacacctataatcccagtacttcgggaggctaaagcaggcagattacttgagcccaggagttcgagaccagcttgggcaacatggtgaaaccccatctttacaaaaaatacaaaaattagtcgggtgtggtcatgtacacttgtagtcccagctactcagaaggctgaggtgggaggatcacttgagcctacttgcagtttgaagctccatgagctgtaatcactccagccagagccacagagtgagaccctgtttcaaaaaagaaaaagaataaaagaaatatgaactaaattgagtatagaaaagttgcaatatttggcattagaaaataaagatattatgaaagaaataagtaatatcaggtatccattttaactgaaaaagcaaatgtattatgtttttaaatgtaatgctaatgaaataaaagcaagaaagactagtcttaggggtaggtgaagcacatatagacaggcagttagtagtctcactggagtgagttgccatctggggagccagtcagtgtgttacaagtttcttggtcatacaataaagtccagaacaaagctccagtcctggaatgttaattgaaaaaagcagggcaagctagtcagctggtcttcatgagggattgtggggtggcagccattagaacttaagagccaagacagccaaattttagggacaaaccaaattggtggcaagagagatgaaacgcaaaataaatatttcacatacggtcagccctgagggtctatgtaggaacaatggagacttgcaaaagaatttctaatcccagcatttggagcagatcatgggatctgaagcctggagggatgacttacctcttagcttctatgaacagagtttgcccaaagactgaccaaattcagcctatattaaagattcttaatggatctggtgcagaaggaaacataaatttgtggatgtagtcatttattcatcaattaactattaagcacccactggacatttttctgggtaccaaggatatcccagttaatgctacaagaaaatctttagctgaattaaatgtaaaagaatttaattgagcaaaaaacgatttgcaaattgggcagtgtctcaagccagagtacattcagagattccagtgcagttacattgtggaagaagattcatggaaaaaaaagagaaagtgatgtacagaaaatagaagtgagatccagaagtagcggattggttacagcttcacatctgccttatttgaacatggtttgaacagttgaccacctttgattggccagaacttggtgattgccacaagagtaagctacggtctgtttacaatttcatttaggttataattcaccgtgtactgagaaacctttaggctgaacttaaaatatgtaaagaggcaactttaggctaaatttgatttatgacaaagtagacaaaaatctctgtccttgccttcaagtttgaggtaactaaagacaaacaaaagcaaactaattataaattagaaggtagtagatgttatagaaaaaaattaagctagaagattttggaagtaggaagatgacaagtactgcaattttttatagggtgctcaatgaaggctcagctgagaacatgacatttgagcagccgtgaagggggtgatgagcaggcaaagtgatgcctggggaaaagcattctaggtaggggaactttgctagcaaaggccctaaagcagaagcattctcatgtgttttaaaaagcaaggatgccaatgtttctagagaaaactcacaaaactttgggcaaggaggaaatgagaggaataatggcagagatgtaaatggaggcaccaaatgatgtaaaagcctcacaggcctttgaagcactttgggtttcactctgagtaaaataaagagcttttggaaggttttaagcagaagagtaccatgacagaacttaaattctgaaaagtcccattagccatatgttgacaatggattgtggagtgttagggtagaatgtgggagaccaggcaggagatggtgatgtggttaaacggtagcaactgagatgtcaaataaaaatggttatgttactgattgattttgaaagtagtgccaacaagtttattaacaaattggaagtggactgtgaaagaaagaatggagttgaggataaacacattatctgctgctacgtagcaagatttattaacttaaaaaaaaacatttttgtcatattcagcgatgtgggctgagttcagtcaaatagttctgctctgtgtgtcccagattgctttggcactaacagagtgaaacaggagagttccctgtttcccccccggcaggatgtgacagggtgtgtctccttctgtctgttcagccaccgtatgtgtgcactcaaaccccttaagggagggggagcatgcaaacaggcaggtgcagaagccaaagcaagcacccctggtctctggccccaggccagcatccagggaagggagctgagactcccaaagcccaagtggacatgtgttacagtgcactcctttagccttgccatctgaagacagcttaagtgttaactagctcagtaccctcttggtacccgggtccttgtccagcatccaggaagaatcaggtcacacacagacttgaaagatgaatgcggggttttgttgagtcctggaggtggctctcagtgggatggatggggagatggaagggggatggagtgggaagatgatcttcccctggagtttggccacccagcggccaatctcctttccaactgtccccagccaaactcctcttggtgtacggacacttcttctcttctctctgctgcaccgttctgcctttcttctgctcttctgtttgtcctctcatctccccctggagctggtggtttggagtttacatgggtacaggatagggggcgttgcaggccaaaaggcaaatttgggcatgaaaacaggaatgccttttctcatttagggccacgggtttccaggcttaagggtgggcccttcgctggggaaccaccttcttcgacccagtactcccgtgtgttctgtccatatcaacagcatgtaaggttggaagctgaggttggcaggaatggctgtggtggctgagcctttttcttcacatagtctctccctggggccagcttaggttttatcacattatggtagtctcaaagcagttagagtttgtatatgatgactgacttcaagagagaggaagaagctgtttgtactcttcaaacctggattgcaagttccagaatgtcccatctgccacatcacattctttgtataagagcaagtcacaaggaaatagattccacctcttgatgggtgaggggaagaaactgatgatagccagactgtctaccagagatgtctccaaggtttttggaccaagcaactggacatatgaagttgcagttaagtgtgatgggaaagactgacagaagttagagtaggccaaggtgggtggtgagtaaagatatcatataggcaattgaatatctaatctggagttcaggggagagatctggactgaatgtgcctatttgtgagtcatcagtatatagatggtattcaaagccacaagactgggtgagaacagaaaggggataagaaaagatagaaaagagaagaattccaaggactgagctctacaacactctcaaatttgaagtcaagaaccagcaaaggtgactgggaggaagcaactagtgaggtagttaggctgggtggtatgaaactcagggaagaagatgtttcaagaagaattaatcaattgggtcaactgctcttcaaagttcatgttaactaataattcatcattgaacttagcattgtggagaccattcgagacattgacaaaaacaaacaagactttgaatccatcgggtttggtgttatggcttgatcctgcacaattatctcagagagcattccaggaggggatgtagaattataaacctacatcagtataagatagatacagctctatagagtgggagggattctaatgtgaagccaaaatgcagccttgccagtcacttggagcttccaacacaatccaggagtagataatattcaataatccaggtaggtgactggtatcacacaattttgtcaacctgtggcagtttaaataattacattctaaaattaagtgccaagatttaatgccttcagagaacaagggtccaggggagggtgggaaagcttggttagagaggggctgtggttaccaaaacaaaaactcagacaagaaattaaccagccagaccagtatgtgactgggaagagggaagaaacacagctaagcaaaacacacgtaaaaatgagttgtagttcaccaagtctatgtcagacattagctatgacttggtctgaatgagtttcaaatgttttattaagagaaaggatcagagatggtgaggttgaagctgggacctgatgggtatgagactgtggggcacaggtgaagagtatggaatggatggggggcagcagggagatacatggaaggacacacaagtcagctgctcctcccaacctactaggccagggccttgaaaatacatagatcatgtcatttagcaccatttacactctgcacaacttattaggatgggcgatcaaaagactacagagtattgactcttatatcttcatcttaaagtggagtaaaagataaatggcatcggcattctgcaaagagcaggactgaggatgaagatctgaaactggataactctgactgattacctccttccccaggctgcactcttgacagaaggcacagtttctctgtaggatttaacagccattagcaagcaactaagacaattgaaagagacagctgagcagccacatgctagtttttcttaaatttacttccctttacaagtctggaactgagatgagcaaatcttgctacatgaaaataattaagtttgaaagtatttcttttcagaaaatcatttttcttaatagaaacatctgcagaattgtgtggactcccttccagtgtgaggagcagtaaagttaatcctgtaatcatattggagaaaggatgagaccccactctttaccctaaccaaatatcttccagcaccatcctcactgctgcccccaaagctgttggagcatttcaattatcctaggagaatctgccagtggttaatgatctttcttgccaggaggttctttatccttcacctccattcctgttgctacagttcattcctccctgtagaattatgaaagaacattacagtccatccgagggagatgagccctgcagccttaatttccaatgtggcaaaagtcatgagtctgagtgtcagaactgccacagagattcttggttgataccacagccatccattaacctgtccctggagttagcagcccagatggtggtaactgcaaatgaaacttaccaaggggcttgatgatagccctaagcagagatttcagttgcagagatttcagttgagcatgaaagcctttgaaaaagatatcacaggaaatagaggggaaagctgcattttactccagagaaattgattctatataggaaaatcccataggaatgaaggagcctggctgtctcctcaaccttgtaggtaaatatgatgttcttctaatgatcaacaaataaagtattagaaaatagtataaatattctaaaatattaagactcaatgtcttaatcagactgcctgagttatcaccctgctctatgtcttcctagctctaagagcctgagaaagtttactgattcctttttatctctgtttttgtcatttataaaatagacatgataatgatgtcaacttcacaagaaagttatgaggattaaatatgtgaaaatgcttaaaatagagtgtcaaattctaaatattggctgtcatacatggggcattaaatatacattattatttgtacattggtttatggactatatgtctggaaatctaagttgtactgtggattttataccttttcattacttttgtagccttgagcaaatttctgtaccttccattagcacaagttggtaaatacgtatttggacataatgcttttcatttttcttcttattcctgtggcagacataggttaattacaggcccttacaccctgaggcctaagtaggctttagaattcatgtcaacatgatgttcccagcagccaccatcagtcagttgacatgaaaatcaaaactgatttgacctctcagctttagagctcacaagcttttaaaggaatgtttattcgcactttcagccacctcagactatcccatcacagtatcacccccactttgccaccaatttttcaatgttgataggacaccacaaatgtctgcatttgggataatctttgtgtattcatcataacactacacccttgtaagtagccacagctggagaagggatatggctggcacgagagtccactgtgagtacatgcttgaggtcagtatccaactatatcttgaccaaagaagctgactgacagggcatgctcagacttctttgcgcagatggaggtgaggaggtcagtgcctgtacagaccaaccagtgcttcttcccatgctatgctctaaggaagcttcctcctaataaatcttttgctctccacaacaaaaccctaataatgtgtctcctaggcatcttggcccaggccagccagcacagaagcctgggattgttttgtttagttttcaggttaggggacaagaataaccaagagaataagtaccaccgacagattctgatctttggtagatctcagaattcacctacagttatccatgaatatcctttccctattacataaagaagactctttctttattaaatctttaggcaataaatgaatttttaagaatactgataggattatgttatgttttaatatgcaaaatattctgtaagaagacacctaagaatcacttacaagtgcttatctttgatcagtcatcatctgttgctcccatttaaccatttaccttgtaacaaagcttttttaaatcagaatgccttggaatgattaaaatgtcatatggatgtgtttagattacaaatagttaaggatgagatataaactaaattttaaatatcaaaacaagatttctataattcttaagtatattaagttatttataaaatatcatgctaaattattgcataaacaacaagcaatcagttagctaaggaataacttaaaatagcctgggccaccatcatacccagtgtggggccagatagatgaaatatatggccagtgtagcatttattgtgttctttatcttttcttaagagtacagaacagtggctgtatagactttggagttagacctgtgactgaattcagactccgtcactttgctgtgtgtcttagttcgtttcctgctactatcacagagtaacactgactggatgatttataaaaaatgtaagttatttggctcacagttctagagactgagaagtccaaaatcaagaggcagtgtctagtgagggatttcttgttgcatcataatatggtggaaagcatcacatggtgaagaaacgcatgcacaaaacagagcgaaaaagcagatcaaatccacatctgcaataatgacataaatccattcatgagggtaaagtcctcatggcctaatcatctcttaaaggtctcactttttactaccatcacaatggcaattaaacttcaacgtgagttttagagaggacattcagataacagcactgtgtggctttaaacaaattactaggtttttctgaactttagttttcttatatactgttgtcaaaattccatgtgtgagagagcttggcagagtccctggcacatcgcaagctctgactcttgtgataattgttagactccctcgttgtttgcggaagtgtggtggggacagataggaatcagccacattgtttttttctacataaaatatttgcacccacattggtctttaaaactctttgaaatgcatatgaaaattcctttggagaaaaaaagtatgcagttaaaaaaaaagaagtcctgtattccctattaagagattaattcctaaagggtagacaaacaagatttcaaacatcactagatttggacactagctttggcctgtaaatcgactttagtggagaatgttaacacttctcaattcctactccttgctggcttgagtaaggcacacaggagccactttcagagataatcttctcttctttatttacttttatcctacagaacagattgaaagccagtggcatagatctaggcacaggttttctcagtcagtcaacatttggggagcatctgctatgtgttgggtgccatgccaggtacaggttaatgcaactgccagaacagatcttctgcccccttctgaactttgcttctacacatctaaggtcctgttagtgagcccaaataaatattcttcactccactcttttcttcttattcttcactatctctgggcgaacttattctctcttatgatttaatatactaattctgcattgataacatgactcctgaatctatttccagcccaaatgtctcacctgagctttgagcccacatttccatctgctgagtactgcatatcttctccaatatatcccaacctattccccaacctgaactctctatttctattaactggctatgaatgcaggaacaaggattcgaggactcagagattaaaaaaaaaaagtaataacaatgatggttaatatttattaaccatttatccactatttatttaagttatttagttatctaatgtgtgtagttatatatttatttctcacagtagctctttgagataggtctactattatttccattttgcaaatgaaataattgaggcacaaagagaagtcccttacttctccaaggccacacagccagaggtggtggagtcatgactggaattaggcaatctgattctagaacctgtacacttaagccctttggcacatccatcttaaatgtaggtcagggcttgggttgtcatagctaaaaagaacagatcagataatggtaagtagtatcactgcctggaaattttaactacaaaattctgtaaatataatgggtggatatttttataacatgctttggattcatgataaagctctagtctttcaaaagcttgtgaaattatttctgcaaaaacacacatatgccgaagcacaagagaaaaagcaggatgcgggaaagcaaaatgccaatgcacaggggaaaaagcaagatgccacccagacagtgagcaatttgctcagcttggctggagcgtggagtctgtagactgaagtcatagaagacaaaggctgagaaggtacactggaacctgattgtgaatgaacttttagttatattaatactataaatatagtaataaagttatattggattgtactctgtaggcaaaacatgggactagaagttggggagcaaggcagggaaggttcatctaacacaatcattactgagagcctccagtgaagtaggcatgattctaggtacttgaaatacagtttgtttgtacctccaaggagtgtgcagtcttagggggagcttggcaattacactggaaatttttaattcaccacggttaagtgttacagagtgctatgaaaatagttatgaagtaccactaacaaacccattgtgccttataagaaaatacttcctggaaacatgcagagatttgtaacgaggagaattacatgattatatttgtattttagaaatttaattctgttagtagatatggcaacaccaaagaaatactgaagaaggaaggtcattgaagagattaatggatcatataaaagttgatgatcacttgaactgtgaaaataagaattgagaggcaagtacagaatcaagaggacttttggcaacagcaacaacagaactagaaatgttgttggaaaggagttcatgagaatgattccagtctttctttttagtttggtcacctaagtggctgagttttccaagttagggaaaaacaaggaagagcaaaataagcgaggaagggccgggtgcgctggctcacgcctgtaatcccagcactttgggaggccgaggcaggcggatcacgaggtcaggagatcgagaccatcctggctaacacggtgaaaccccgtctctactaaaaatacaaaaaattaaccaggcgtggtggcaggcacctgtagtcccagctactcgggaggctgaggcaggagaatggcgtgaacccggaaggtggagtttgcagtgagccgagatcacgccactgcactccagcctgcctgggcaacagagcaagactctgtctcaaaaataaataaataaataaaataagggaggaagacagtaaatttagtttgagatatgttagcttagaggcatctacaattagagatatttcgtgggcagctatagccacctatcataaatagaatgatgccagagatgtaagttttggaatttccaacatctgaatccaggtgagctttctcaatagagcatagaagtataaagacagacaatctgacagtaccttgaggcacatgtaaacaaagcaaaacaaataaaatagatgacacatgaactttagagtcagaatgtctgaattcaaatcccagctcaaccacttatgagctttgtgattttggacaaggtacttcatatcttttggtctcagtttcctcatctataaaatgagaactacctcagattgtatcatgacgtttaaataaattagtgtttataaagaatgttgaataatacctggccttcagtaaatacaatttagtttttattaaataaaaagtattataattcatttagctccaaatattgaccttcattctgtgttctattttatttctccactatgtcttactcttctgaaggctgtcgtttgtttatcttattctactcctaattctagtgggtcctgaatgaagtattattaaattcactacctatttcacatgaaaagtaaatcttaggaaagataaaaaaaattcctttcttcatgaaacaattaccttgtaaaaaaatcttagaaaagttctctctaggcatatcacaatgtaatgatccgtttctacagattaaattgataaataattttctacaaaggaatattcctcctagcagtttccttcttttacttttttttcatttttcaggaccaacactactaaaatgatctattcatacatttcaagcagtttcagactttagaattaacctgtttctggtatggtcgtgaccatcaggatccactctgccaggaacagtgctagatgctctaaatagaaaatctcatattcttccccaaactccttgagttggctatgatgtttgctatataattgagaaaaatgaggttattcagagtccctgaatcataccaagcctagagaagctgcctcaatatagtgaacaacagctaagcagttggtttcaaagcagagcatcattcaacacgggccagttgtctctccactctacagtgtgtcatcatcattttgaggatgagacaaaaggtagagtggcctgatgggggcacccaccaagatttcctgccctattatttcaccacagaagacacttgggagtcctggtaccttggccttatcatctatggcttggaggaaccaatgaccaataatctttttttctttcagctcagttcatgaaccatcggcaacattctcccctctagacccatcatcagaagacttaacacaaaactgttggaagtctcttgtctaaacagagtacaggtttaatattcttaccagtcttaatgagactctaagttcagttttttttaattgaataacattgttcagaggatatgtcatagtgatggtgatgataagtattacctcagagatgggcttttccctgtaaaatgaaggcttcaagatcagctttaagaaggagttagattgagataaatgtaaatgataaatagatcatgcatgggaaaaaacagtattctggtatagatatataatgctaagtgtaccaaagcaaagccaaatcagatgtgtctggacaatacttagtttttctggaatgaagtgtttattgtttagttagagaagcagtaaagaatgacatggaaaactggtgagggcatgtttgtgaagatcttaaaagtttgggtaccatcttcttatgattaatgaaatcaagaaaggtggtaacacaaaaacatttcaggtgaatatgttagtaggatcagaggttgaaatggtgatgtagagaaggaattcaaattattctgaatttctaaatctaggaaaataaataacttgatatgtattaaaagtaaagaaagcctattttaggaggttgtttccaattccttccaacaaaataatatctcacacactggcatactttttctataaaggccacatagcaaatattttaggattttggacatgcagtctgctctgccacaactactcaacttgttgccgtagcacaaagcagccttaaacaatatgtaaatgaagtcacatggctctgtttcagtaagctttatttacggacactgaagtttgaatttcatgaattttcatgtgtcacaaaatattattactcttcttttgatattttccagctactttaaaatgtaaaaaccattcttagcttggggctatacacaatcagagggtgagcaggatttggccacagtttgcaaactcttggtttatagaacatcatcagaactttcaatccaacatcattttgaaaactttgaatttcttctgaagtcttctcttgagcatttggaaggagctggttgaagtgggcttgaagtggtaggagaaggggacaactattaataactagctagtcagacaaatcatactaaccacagggggcagtaggacaatatatgtccctgtatgctctaatccaacagttgcttgtctgaaaccttcaaaaaaaaagagagagagagagaaatcaatcaataaatactactgcaaacaaacacattctgaactcagtattttgataattgcagagggaaaatcaaaagtggtgggctttgcttttattcaagttgcttatgccaccctaaagtggtgcaatgcagtacttgcccaaaggaagtgagtggcagcattgatggaagcttagtgtgagagcagtgtgtaaagttgaagtgactttgaacaaagaatttcggagagactaactaggctggggtaactaatgaaaaccaggctgggaatggaatgcagagggggacatgagagtcccaaaggaaaaattgatgggacttgctaactaatgagacatggaggctgaaaaaagagagaggagaaagatataaaacctttcaaaagattctcattatattattcagtgccactaagaatcacataccagtgagaggcaagggggacgatgtagtgtatagaaaatggggaacataggaagctggagagtagcacttcaaacaagcaaatcacacacatacactaatgtctgataaatgtcaggctgaaattattggcaaatacagagagaagggatcccattaatgcccacatgctatctttatttcaagtattatcaggtggaaaataaagtagtaccattatcgtgttgatggtctaaatatgtgaacaatctcctgcatcatattatgtagaatccccctcatttcttcaaggcaatttccttttgatcacttggcactggtcatgtcttataaagcaaatatatccaaacatttttcgttgcttcagcttttccctccctagttctgtttgcttatgtagatcacaaatgtatgagaaaaacaaacacaataaggcaattaatgtacctacagttagagatgtgaataatattggaattcagaaaaggaaaggttacataaataaacctctccaaactcttagcaccaactattggttttatctgcttctaccctacctagagctgtccaaagggattgctaaggcacttgcttcctaaaaatcccttttctgccattatgattcacccaaagcagcatggtatatggcggagatgcatgtcagctctgcctataaatgcaccaaggcatatttctcataagcacatttttgcctacacagaatgaaatagagacaaaaaagtaattagtgccttcgttgtttggactcacatttataaaaataaatgtttagcctaattctaagatagtcatttcaactgtctttcttaaaaatcttaaacaccaggatttagttaaaaatatcttcagttcgcctacatttcacccttaattgtatcttaagaaacctataatgaaactagcgtggccaaaatacacttaccaacaggtttccttaattattatctaggaactatttagaagtggatgctttcctgatttacttacatgttgtaaaaaaaatggaaagttaatttatgaaattagaaaagtagctgaaagtaagcctagcccattttataatgagaaaaataaaacacagaatatgttttaaagtggctttctcaaatgaaccacaaccttcaggattagactttccctttgagatattgaggtacagaaaataccaagtttttagaagcacaaaggaggctgaaggacccaaatttgtgagctgacactaccccaccctaaggggtgttaagaccaataaataactatatatggtatgctgcttctctcttctgagtaaatcagttattcaactaacatgtaacaagcacattataaattatttcactattacaacaaccacaaatagatatatagaaacgtctacaaacaaattaccatgtataaagaaaatgagtagatacagagagtgcaatcagaattagattaatactatgatcatcttaatatatcagttaaatgttatgtcctcattccaagactctcattttatttagcttctgcattaatccagctgcaaattgaattagtccagattaggtcttagtatattatttatagctttttactggtgctacattatgcattttcatccaaacaagtataataattttgtcaggttcatgtaaaagcaatttttgaatatacagcaaatttttatattaaaagaaaattttcatattttttcatagacttgaatcaaaggaacctttcctgtctgttgggtaagtatatatttaaatactttaagtattaattatttaattcaaatttccaagaacttctgagatggtattttcagtcatttaacatcatattcaaaatcataacatatcagtgcatgcaacattgctatctatgttttataaagacttaactaaaatgctccctaggttgtattgtgacctcagaaatgcagctaatgaatgtatatgaaatcctgtatcttccataaaggctaaacaaggtacacagtgatcatccatattctcttcatgtaaaaatatactcagattggttttaaaaattcctctgagccatagctccaccattccaagcctgtctacccattgccattctccatttcttttcaatctactctattcactgtttcgtcacccacttccctaagtctgtcttcacaatcaatatctatcttttctccttatctctcatttcactttaatttctccagttcactcacattgactgcttctttgcacccaaagctgaggaaccctgaggcaaatttagataagacgaacgcttgcctgctctgatggtatccttcttagtcacaatacatatctttaagaataatatattgttggccaggcgcggtggttcatgcctgtaatcctagcatttttgggaggtgggcggatcacctgagggcaggagctcaagaccggcctggccaacatggtgaaactctgtctctattaaaaatacaaaaattagctgggcatggtggcacacacctgtaatcccagctacttgggaggctgaggcaggagaattgcctgaacctgggaggcagaagttgcagtgagccaagatcacaccactgcactccactccagcctgggtgacagagcaagactctgtcccaaaaagtaatagtaataaaataataacaataatatgtttttgacatgagtgcacatgttctatttttaggcatttcaaactaagaataagcaatgttgtttgtatctgatcaaatactcctttgactaacatattaaagtgtattatgaaaggacttttgcactttcaatattatagatgatattgtatgaaaaagttgtgaaaaatgcaatgtcttgcctagagaaatcatgctatatttgatgagggaaaaaaagctgtcatatataggcagccacaatactgatgcttaatgaccagaaacatggaatggggttagatttttaagtgaccagatcaattttcttttattactttgtacatggtcattgaatatttctatcaatcactcattcaacaacatggttcccaattcctttctactcttcataaaagcttttcagaaagccactcaaatcatggaaatcaaaataattattaggggatgtggaagacaaaaaatggaatatatgcatttatttgaagactacatggaaaatgaaaggtcgagttggtctggcccaaaaaaagtgataaagcatgcttttttccctacattgatcatcagctcctattgttaaaaatctctacacctgaagaaatcttttagtttgaatgcatgtgtatttgccctcaagtcaaaaggcctgaaatagcttctcttcacgcctcacttcatgtagtttctgtgcagcctttactgttctcctggctattatgagatggaattccttttttattgcatacttctgttttaaaaggcagaccctaagtaatctttgttttaaatttatcaacagtttagcactgattattagaaccctgagaaaatctctccaaaaaaaaaaaaaaatactgtatcgctcagccaatgctcaaagtgggaaaattagcatggcacacataagatactgcttatgtcttaaaagtaaagtggtgtgaaaggcaacccaaatgattctgctgaatggatattttaatttatagctaaatgtttctgttccctcaagaaaattattttaaataagattgtccaaaagtatgtatgctaaggtgggcgactcacttgagttcaggagttcgagaccaggctggacaacatggtgaaacatcatctctacaaaaaattacaaaaattagctggccgtggtgccgtgcctctagtcctagccacctggggggctgaggcgggaggatcatttgagcccagcaggtccgggctacaatgaaccgagatcgcaccacttcaccccagcgtaggcaacaaagtgagaccctgtctcaaaaaaataaaagcatgtatgtagctctctgctgcctttttcagtgagaagatgtaagttctttagtggtgattggtgagattttggtgcgcccatcacccaagcagtatacactgcatcatatttgtggtcttttagccctcacccccctcccaaccttcccacccaaccaagtccccaaagtccattgtatcattcttatgcttttccatcctcatagcttagctcccacttatcagtgaacacatacgatgtttggttttccattcctgagttacttcacttagaataatagtctccagtctcatccaggttactgcaaacgccgttaatttgtttctttttatggctgattagtattccatcatataaatatacaccacaatttctttatccactctttgattgttgggcatttgggttggttctatgattttgcaattgcgaattctgctgctataaacatgcatgtgcaagtatctttttcatataatgacttcttttcctctgggtggatacccagagtgggattgctggatcaaatggtagttctactattagttctttaaagaatctttacactgttttctatagtggttgtactagtttacattcccaccagcagtgtagaagtgttccctattcactgcatccactccaccatctactgttttttgattttttgattatggccatttttgcagaagtaagctagtattgcattatggttttgatttgcatttgcctgatcattagtgatgttaagcattttttcatatgtttcttggccatttgtatatcttcatttgagtactatctattcatgtaattaacccactttttgatgggatgtttgtgtttttcttactgatttgattgagttcattgtagattctggatattagtcctttgttagatgtatagattgtgaagattttctcccactctgtgggttgtctgttcactctcttctttttgccatgcaaaagctctttagtttaattaagtctcaactatttatctttgtttttattgaatttgcttgcgggttcttggtcatgaaatctaggccaatgtctagaagcatttttccaatgttatcttctagaatgtttatagtttcaggtctcagatttaagtctttaatccttcttgagttgatttatgtataagacgagagatgaggatccagtttcattctcctacatgtggcttgccaattatcccagtactatttgttgaatagggtgtccttttcccactttatgtttttgtttgctttgtcgaagatcatttggctgttaagtatttgggtttatttctgggttctcttctctgttccattggtctatgtgcctatttttataccagtaccacaccgttttggtgactatgtccttgtaatatagtgtgaaatcaggtagtgtgatgcctccagatttgttctttttgcttagtcttgttttggctatacgggctcttttttggttccatatgaattttagaattgttttttctaattctgtaaagaatgatagtggtattttgattgggattgcattgaatttgtagattgcttttggcagtgtggtcattttcacaatattgattctacccatccatgaacatggcaagtatttccatttgtttgtgtcatctgtgatttctttcagcagtgttttgtagttttccttgtagaggtcttttgactccttggttaggtatattcctaagtattttaaatttttttgcagccatcgtaaagtggattgcgttttttatttgattcttagcttggtcactgttggtgtgtagcagaactactgatttgtgtacattaatcttgtacccagaaactttgctgaattcttttatccattctaggagctttctggaggagtctctagggttttcaaggaaaacaatcatattgttagtaaacagtgacagttttacttcctctttatcaatttagatgccctttatttctttttcttgtctagttgctctggctaggacttccagtgctatgtgaagaggagtggtgagagtgggcatccttgttttgttccagttttcagagggaatgctttcaacttttccccattcagtattatgttggctgtgggtttttcatagatggcttttattacattgagggatgagagttttaaccataaaaggatgctggattttgtcagatgctttttctgcatctattgaggttatcatgtgatttttatttttaattctatttatgtggtatatcacatttattgacttgcatatgttaaaccatccctgcatccctggtatgaaacttacttgatcatggtgggttatctttttgatatgttgttggatttggttagctagtattttgttaaggattttagcatctatgtttatcaaggatattggtctgtagttttcttttttggttatgtcctttcctggttttggtattagggtgatgctggctgcatagaataaattagggagggtttcttctttctctatcttgtggaatagcatcaaaagataggtaccaattcttctttgaatgtctggtagaattctgctgtgaatccatctggtcctggacatttttttgttggtaatttttaaattaccatttcaatctccctgcttgttgttggtctgttcagggtatctaattcttcctgatttaagccaagaggattgtattttttcaggaatttatccatctgttctaggttttctagtttatgtgcataaaggtgttcacagtagccttaaatgatctttcgtatttcagtggtgtcagttataatacctcctgtttcgtttcttaatgaggttatttggattttctctcttcttttcttggttaattttgctaatggtctatcagttgtatttatcttttcaaagaaccagctttttgtttcatttatcttttgtattatttctttttgtttcaatttcatttagttctgctctgatcttggttatttcctttcttttactgggtttggttttggtttgttcttgtttctctagttccttgagatgtgaccttagaatgttagtttgtactttttcagtctttctgatgtaggcatttagggctatgaactttcctcttagcaccacctttactgtatcccagaggttttgataggttgtgtcattattgtcgttcagttcaaagaatttttaaatttccatcttaattttgtttttgactcaatgcccattccagagcagcctatttaatttcaatgtatttgcaaggttttgaagattcctttttgagttgatttccacttttattccactgtggtctgagaggtgcttgatataatttcaattttcctaaatttattgaggctcattttatggcctattgtatggcctatgttttagaaagtcccatgcactcttgaatagaatgtgtgtattctacagttgttggatgaaatgttctgtatatatctgttaagaccatttgttccaaggtaaactttaaatccattgtttctttgttgactttctgtcttgatgacctgtctagtgctgtcagtggagtattgaagttccccactattattgtgttgctgtctatcacatttcttaggtctattagtaattgttttataaatttggaagctccagtgttaggtgcatatatgtttaggattgtgatattttcctgttggacaaggtattttaccattatataatgtccctctttgtctcttttaactgctgttactttaaagtttttgttttgtctgatataagaatagttatccctgttcacttttggtgtccatttgcataaaatgcctttttccacccctttactttaagtttatgtgagtccttacgtattaggtgagtctcctgaaggcagcagagagttgattggtgagttcttatccattctgcagttctgtatcttttaagcaaagcatttaggccatttatattcaatgtttagtattgagatgtgaggtaccgttgcattcatcatgctatttgttgcctgcgtaccttggttttgttttttgtttttttttctttttaacttatacttttgttttctaggtcctgtgtgatttatgctttaaagaggttctgttttgatgcgtttccaggatttgtttcaagatttagagctccttttagcaattcttatagtggtggtttggtactggcaaactctctcagcatttgtttgtctgagaaagatggtatgtttcctttatatatgatgcttagtttcgctggatacaaaattcttgaatgataattgttttgtttaaagaggctgaagataggaccccaatcccttctagtttgtagggtttctgctgagaaatctgctgttaatctgataggttttcctttgtaggttacctggtgcttctgtctcacatctcttaagattctttccttcatcttaactttagataacttgatgacagtgtgcctaggtgatgatattgttgtgatgaacttcccaggtgttctttgtgcttcttgtatttagatgtctagttctctagcaaggccagggaagttttcctcgatttttcccccaaatatgttttccatacttttagatttctcttcttcctcaggaataccgattattcttaggtttggtcatttaatataaccccagacttcttagaggctttgttcatattttcttattctttattatttgtcatggttggattggtttaatttgaaggccttgtctttgaacttcaaatttctttcttctacttgttcatttctattgctgagactttccagagcattttgcatttctgtgtgtccagtgtttcctgaattttttattatttgtttctttatgtatttccttgaatatttctcccttcactttttttggacttccttgcattgggctttgcctttctctggtgcctccctgattagcttaataactaacctcctgaaccctttttcaggtaaatcggggatttcttcttggtttggatccattgctggtgaactagtgtgatttttgggggtgtttaagagcctgttttgtcatattaccagagttggttttctggttccctttcatttgggtaggcgctgtcagagggaaggtctagggctgaaggctgttgtccagattcttttgtcccacagggagttctcttgatgtagtactctccacatttccctgttgatgtggattcctgtgagccgaactacactgattgttgtccctcttctgggtctagccacccagcaagtccacccagctccagtctggtactgggggttgtctgcagagtcctgtgatgaaatggactctgtcagggttctcagctttggtggtttaatgctctatttttgtgcgggttggccttctgctgggaggtggcactttccagggagcatcagctgtggtagtatggagaggaaccaatggtgggtggggccctagaactcccaagattatatgccctttgtcttcagctaccagggtgagtagggcaggaccatcaggtgggggcagggctaggcatgtccgagctcaggctctccttcgatgggtcttgctgtggctgctgtgggggacggagatgaggttcccaggtcaagaaggattgtggctgcctcttctgcatcatgaaggttgtcagagaagtgggagaaaactggcagtcacagggcttaaccagctcccatgcaaaccaaagggcaggtctcactcccaccatgcccccgctaacagccccaagttggtttgcaggcagtgggtgagccaggcttgagaacttgccccaggctacctgtctcccagctgcgaaagaaaaaggtttggttcttccccagcctgtggagtctgcacactggattcccgctctcccttgaattttggctaggaggcttcttgcccctttcaagttgttacaaaattcagctggagatttccttctgcctgtggtatttttcccccgctcctctggccaccctcctgatggatccctgtggtgccaggcaggaatggcctgcttgaagacccagcgagctcccggggcttttcccactgcttcctctatccctgtatttcactcagctcttgaaattgactcagctccagataaggtcggaaacttttctgccacaaacagaccttcagtttctccagtcgggggtgtgtgtttgggagaggaggatctccctttcccacttctgcagttggggcactcagtatttgggatgtctcctgggtcctgcaggagcactctgcctccttcagagggtctgtgggtcctcttgggattgctggttcattcttgcagttgatctggagctaaaattcaccatgcgagcctctgcacgctgctctgtctgtccaagtgggaactgcagtctagtcctgcctcccattcctctgtgatgatcaaatttatgacttttaatccatagtcacatgtcagaataagtgcatggtatatggtttattacatcagttgacatgtgagtatgtaacattgaatttgtccacagcacacctcactcacattaattttaattctatgttcaataaaaatgtgtgaattatattaatgaataaatcactgctaaatattgcatacttcagtccactgcctgtcagtgtcttaaagtatttgttaatatgcactggtgaaagttgctttcaccctcataggcttggacacttacaagctagatgtgttagtttaggcaattactttttttttaatactttaagttctagggtacatgtgcacaacgtgcaggtttgttacatatgtatacatgtgccatgttggtgtgctgcacctattaacttgtcatttacaggaggtgtatctcctaatgctacccctccccccaccccacgacaggccccagtgtgtgatgttccccttcctgtgcctaagtgttctcattgttcaattcccacctatgagtgagaacatgcagtgcttggttttttatccttgcgatagtttgctgagaatgatggtttccagcttcatccatctccccacttaaactcccaagcttcaggttcttgtttgtgaaatggagattaaaagatttagataataatttatatcaaacatttagcacactttttgacacataagaattgctcataaatgttagctatcattacaattctggaaggtatatttatgtatcatgttctaaagagtcaatcagaaagctttaaaataataaatctccatttttataggcagtgctttgagttacattataaaaagcaaaagaagtttcattataaaaaccaacagaagttattataatggggaaagataaaaattgtcatgaaatgagttatcaagcaatatgagtacagatgtttcagattttaatgatgaatactagtaattgtcatttagattttaatgatgaatactagtaattgtcatttaaattttttaagtagaaatattgatacatttttaatatgcatctcatcttaatataaattggtgaaccaaattcttccctggataaatgtgctgtactaattttgaaataaaattgtttggtcacaacatagacccaatctgaatattgcagtggaaaaaaaaactgtcaaagaaagttacaagaagttatttccttactgagaaagagcatggagttgtgaaaagaagttgagtgaaatctcaggtctctgatctgcaactatatatatgatataaaaagaactttcttcatatgcaccaggaaatgacttctaaaataatgtcattgaggggggaaaaaagacctgttacttctttgttcatttaatgtagtttccctctaatacacctagagtgaggcatgaaagctcatcccaagtgtgattctgtttgcacaggtagatcaacagatgcagtgttttccaacgctacctaggtgattctgataccagtggggcctgggagccatcatctacaaggtgctttcatccacctccattgttttccatacacacatgcacaggttgtcattgtaaacacttaccatctctggagtcccttcagaaaatcttcgaaatgtaatgtccacaatccctccctgttttaaatgcatgtggtggaggcagccacattgaactagaactatcttggagttcactccacagagaccaggatagatgcaaagagcccagaatatatgccatggaagcctccacactgcctatgcagaagtacatataaattcattctgatgtcatcttagacctaaggctgggatcataataaattttaaacttcaaaatattaaataatataatttcaatatttaataaatgtctattttttaaatattaatattttctattttaaactattataagtatttatatatttactatttatatatttattaaatatatttaaatttattataaatacataatactgaatgtttatattattataaataaaatatatttataaaatacatttgaacattaaaattcttgcccatcttaacattttttaagatgttaagcaaccttgttttttaatggagggcttaagtttgggggctcatattccaatcatccttgaaacattatatttttttagagcaattaacataataaaattctgctaggagaatgcttcctttcaatgctgcatcagatatactctgatcttggaaataagctgagagaaaacaggcatcaagtttgcatttagaaaggtgaataaggccaggcgcggtggctcatgcctggaatcccagcactttgggaggccgagcaggcagatcacgaggtcaggagatccagaccatcctggccaacatggtgaaaccccagctctactaaaaatacaaaaattagctggacgtggtggtgtacacctgtaatcctagctactcgggaggttgaggcagcagaatcatctgaaccggggagtcagaggttgcagtgagccgggatcatgccactgcactccagcctggcaacagagagagactctgtctcaaaaaaaaaaaaaaaaaaaagaaaaaaagaaaagaaaggtgaataagcacagagtgatcatcaagattctaatatataaatcttagtttaaaaccagtcttgccttgaaaaagttattacaactttttaatgaaaacacaaatgagaaggaatcaaagatccttcatttgaagactgagatttccattttaaggttacatgtcaaaaaatgcatgaagtttcttcaagcactgactgttgataccttgcagacactgagccactttgagcatacactcacagcaccaaaggaaactttccacatgaattatttcttcttcttcagcatgaagttgaacttttaaagaagactttaatatgaattagttgtattttgaaattaaatatcgatttataccaatttttcatttgatgaattttttcataagtagctttatatgaggatgcttattacattggttaaaaaaaacttcagattttgttcactgtatcagaataatttaactaagtcagaacaatttaaaagttatattgacttatctcacaatatattatttcccaggtttggttggaagatcttcaagaatacatcactggggcaggggcgggggtatggttaatggatacaaaaaaaattagaaagaatgaataagacctatttgattgcacaacagggtgactatagtcaataataacataattgtacatcttaagtaactataagagtgtaattggattgtttgtttgtaacacaaagcgtaaatgcttgggagaatggataccgcattctccctgatgtgattattacacattgcgtacctgtgtgaaaatatctcatgtaccccacaaatatatatgcctactatgcacccactaaagttaacattagaaaattttaaaattataaaaagaaataaaaagaatacatcaatgataaaaatatcagaattattttattatatttatctctattgaagcactatgtgtgagctaagcatggaccagccaagcctggatcgcctaagtcctttgagatgcacgggatctattctactaaatccaaacaagagagagtaaatactttcagggcaacaaggcttgccctgcatccaaaaatgaccttataattgctaacagctgtagttcacgaacccattttccttgaggtttattttctcccttttctttccagtcttgaagtagaatttagatcttcaatatacttctgctgttatgaaaactttattaaaccttgatgttcttattaggttaaagactcacactattttacatttatccaggttttgtaggaaacctcatatttagtaacagatgctatatattattatagtattagccacttgctttaagagcccaagttctgtgatttgatttccttcctctgaatcctattctgtcacttcctagacagatggctttagcaatttgtttaactttcctgagtctccatttgctcacttaaggtagtaactaatcttttattattattattattattattattattattaatttcttttgagacagggtcttactccatctcccaggttggagtgcagtggtgcaatcacagtcactgcagcctcaacctcccaggcccaagtgatcctccctcctcagcttcccaagtagctggaactataggcatgagccaccacacctggctaattcttatcttttctagaaacggggggtctcactgtgttggacaggctggtcttaaactcctgatttctagcaatcttcccacctcatcctccaaaagtgctgggattacaagcatgagccatcatactgggtcataactaactcttaacagctgttatgaatgtgataatacttagtgtctgacacatcgtaaacaggaaataaatatcaattattaaaaacattctttgcagcaattaagttgtaaatcttttctaaagtttcactgaatcgcagaaatgttaaccaattgaatccaaaggactgaatattttagaagtgttaagagaatccaattctcagttcagaagagagtgaaatcagcacaggagtgacagactgccttactagggaagatcactgaggaagagagacaagaaaaaaagcaaaacagcagcctgaagacaggaagacaattccaggctgtacttagagtgatataaaatatggagtacaatattgaaaactttaataataggaacatgaaagagggaaagcaatactgatttaaggatggttggtagcagaacacataaaagcaaaagcagatttatattaatgccatcaaatgatagctgtctatcaagcatttaggaattgagaagttaaagaaactggtcagattattaggaaaatttccaagacaaaagtaggacctgagtttttcttcaaggtgaggtaagaattcaataaggagctattaaaatggcattcctgggagacaaagttggatgagtagcagcagagaaggcaccataccccacgtatcagacattccagtctagtgagctaggaagattcaggaaaagacaaaagataagattggcaaattcagggagaatctgtattgagaaattatcctaatacaaggagctttctgctcattctgtgggtgaagtggagccattcaatgatgtatacctgcttggctgttttgctttcaactgaagagtgatattatccaaagtgagccacttataaagcagttgcagaagttcaggcatgacttgaaaagatgcaggacttgaatagaatgaaataagaatgtaaagaaaatgcctgatgaaatagcattttctttaagaatgtcgaaatcagtgagtgagtggtgtcttaaagttttctcagttagacttgatgggatcatggtgacagcatgacaagctaaaatccatgcgtagtgttgaaactaagggaaggttaacaagaaattgtccccaagctttaaatatgcccatctaacatcacggaattactaatggccaattcaatgcctgtcttttgatgatgtggtttcaattttctctatgtctgcagggaaaaagggataaggagacaaagccaattttcttctaaaaatctacttttttgcgttttttttaagactcagacagtgctaccacaaaattaatgatttctttaccaactgcatttgcttcatttttttccccaaagccctccaggctacttctctggagagtacacaaagtttccacagcgctatttttgtaatctaaagcagttgtgctttcaggcctgatgctacaactgtaattttaatttatcaacctgccagtcagtgaaatgctgtaaaaacatgtgaaagcttaaacccatcatttatttctgcacctgtcaatgacacttttctgtacttgtcaaaatcatttaaactgcactatgatggcatatacaatatcaccagtaaattgggtaatcaatcatgtatgtgcatattttgacagtggcgtgttgaatgcatgggctcctgtatgcatttttaagaagtaggcactcattactgttcaatagtaaaatacagtagagtcatcaaaaagagtctccctcagtcttttacaattaaaaaaatgtcttaagaaacagaggggctgattgtgcctgaaatggcttttatttcttcagcaaaatgttctccttggggaaaaggaagcaattgcaggttatagcaggcagcaatatagtgttacatggagggaagaaaatgtataggatcattaaatagatttatttaagttctgcttataaagaaagcagtggtgcagtactttatagttgatgatatttcaaaagagtgttatcagcacttctaccactatctaatttgttcatataataaagtgtcacattaaacccaatatcacaattcatatcagttttacttcaaaaattggtatcatcatatatcatagggaaccctgccccaaaaaaattttgatgagatctttcatcacaataaattatagaatttaaaaaatcaatctattagagagtgagagagagagaacctgttcaatcattaaatccactcaacccagtaacaatttgatgtcatttaggctgtgtttctaagataaaatgttgttaaaattgtaacttaaatattctctaaataatctaactgtaccctctgaactcttggttgtagcaatcctcaccatttatttatttttaaaaagcaagtcttatgagaaaccctttaaaatctatgaaggatttatgaccacttcataacatgcaagtctaaattagccaaactaatttgtagacatcaaatatttctacataagaaaatgaatcagtaaacttgacatgcataagctctcactcatgggaaagaactaaccttaagtgatgtttcagaatcacatataaaacaaacaaagctttgggaggtgcattaatgtacacagccagcactgtttccttattgttaccagtactgttttcaaggaacatgaatttagttttgttttgtcttgtttttttaattttactctaagttctgggacacgtgtgctgaacatgcaggtgtgttgcataggtatacatgtgcgatgatagtttgcttcacctatcaacctgtcatctaggttttaagtcctgcatgcattaggtatttgtcctaatgctctccctcccctttccccttgccccctgacaggccctggtgtgtgatgttcccctccctgtgtccgtgtgttctcattggaacatgagttttttaaggtgtcaagccacattggaaagggtaatcatatagtcagactgttgaaagatatatttactgaatgtgtatatgaataaaatagaaatggtggctaagattagatgtcatatgtagaatcaatactgcacgaagagagttgttattgtttcaatttaaaaataagatcttagtctcatatacttttaatatcagtcctgaaaataatcactaaaaataatgcaaaataagtgctttgatttcactcggctaccttcaactcatctcaaagaaagctaattaagcttacttgaagagaactcatttctctttgttttagctccattaaatatactgaagactgaattttcaattaaataatacttgattatctaaataattttttggcagtttaaacagcatttatttcagacagttcaaagtattgactatcctttattttgtgttcttcaatgaatctttactgattctcataaagacaaaatagatatcatcattcatttaatgctgaataagtgagatacagagacatgatgatatctccataaataaacacagaatattggtagccattttggaatggagtccagtctgggacttttgcttacaaagctggcaacttcatgtatcttaacacctcatgttttcttctgagtttcatctgcacttgaatgtctaaataatagctttaattattcaggaaaataatcatgtatgtaaaaagttatttattgcttttagagctattgtgaatcccagatttgcactataaaagtgctagcaacagttttaaagcctcacttcccaatcacattctgttcatccagccaggagtgactgatctttattttatcaatctcaaaatgtgaccttttcaatgcttttaatgacattttcaaagtacagaaatgctttttgattcaaaaggattttctactttattctgcagaacaagtcagctatcatagtataatcaatagctgccaactattagcaaaagccacacatcacttatactttaagagcttatcaggaagaaaaaatgcattgagtggctatattttggcatgctaactaaggtagatattaaaatgaaaagtcaatcctcaaatgtttcatgtttttagaaatgttattatttccttagtaaaaatttcactagatcacattcaaaatataccattagaagctgctggccacattcaacttcaaaatgaaataatgtgcttgtagttttattcagtgttaggcaaccaactacagtttccccctagcttcaattaaaagcatataaaagatgaaacacttgttgagacatttcttccagatactggctaaattatcatatcatgcaagtggtatttcagttaagtgtatattatagcccaattggatactaaaagtcttgaaagcctttttaaaagtgaggttctctagagaagttattttaaagatgtgttctgtaaatcatgggcctttgattatccagcccatggcaggctaagcactccaaattcccatgtaaagccaccaagtcacaaattaagggattgcccaataaatcaaagcattcattcctaattaattttcttaagttgccaggttttcgtttgaagctcttgtgaaaggatttgatagcattgctgccctttctgtgaagaatagctgtctaatttcattaagtgcatcaattcaacatttgaagggcactgtgtatgtgcaaaatattatatgataataatgtcagttgctgttctaaactagcctgctagacagggatagtttcctactattgtgattaaaaattgagctttccttccatattacaaagataacaacaccaaatcatcattgatagggaatttagtaaaatatttagacatttattttggcaatgtaagatgaagagtagtatcaaaatcatttagacttaactaacaatatgtcttcaaaaattatgcaatgcacattgtttttaaaagcatcgttaattgcctaacagtacccgccaaactacaaatcaggggttaaaaacaggaagtagatcttatgatgccatttcattctaatcaagactttatttccagtatctttattgttatttttgaatatcaattcagttatatttagataaaatttattcagtgcaaaattccatttacgttatattggtagatgcaaagcaagatgcgaggtgcactgaactgctgcttcatctcatagtggattcagtaaagcagtgccaatcaatgaattgtttttaccatttcatttcagaaagtaggagtaagcattttaaaacgtgtagcatgtttatatgctatcgttatagcatgttatatgatatcaaaatgtatgattttgtacaaaagtatcagactgtgatagattggaaatattttaaataaaaaataaaaatttggttctttactgcaataagccaggaagccctagacaagactacatctttgcctttggggaggtagtaatctaatgaacaggacaaaacaaataatttggtgtctataatataaggcattgcttgggaattctaatctgctgaagaagataaaataaaaatgaacagacatctgtaacataagtcattccttgaagactcttgaaagagaggaaataaaaggctgcaggactagtggtacctaatggcacacaaagccaggtgggtttagtttctttttggagataggtagtagcaccatttttcttaaaagagacactggatgacgtgcctggaaaattaaacaatgactatatcaagggagactagaaagccctgaatatgttttaacttttcttcaacttccctctccctttctcacccctcccacctctgccttcttctcttactttctctctctcctccttgacacctctttattttcctctcactctccttcttttcttctctctttcctcttctcttcctttctcctcattctctccttgtcctacttcttccctctacttctttatctctctctattcctccttctttcagcttctctatattttttcttcatttaaaaaatgcatgccttctatcagaagagaatacctcaaaatattaagaggcatctgtgacaaacccactgccaacatcatattgaacagacaaaaactggaagcattccccctaacacctggaacaagacaagtatgcccactctgacactcccattcaacaaggtactagaaatgctagccagagcaatcagtcaagagaaaaaaatacaagtcatacatatgggaaaataaactatctctcttcacagatgacaagattttatacctagaatgccctaaagactccaccaaaaggctcctgcaactgatatgccacttcagtaaagtttcagcctacaaaatcagtgtacaaaaatcagtagcatttctatataccaataatgttcaatttgagaaccaaatcaagaatgtaatcccatttacaatagctgcaaaaaaaaaaataagtcagtaaacaaaggaatacatctaaccaagaaggtgagagatctctacaagaactacaaaacactgttcaaagaaatcatacatgacacaaacaaatggaaaaacattctatggctcatgaattggaaaaaatcaatatctttaaaatggccagactgcccaaagcaacctatagatccagcactattcctgtcaaactaccaacattatttttctcagaactagaaaaagctattttaaaattcaaaggaaaccaaaaaaagagcctgaatatccaaaacaatcctaagtaaaaagaacaaagccagaggcattacattacccaacttctaactacactataaggctacaataaccaaaacagcgtggtactggtacaaaaacagacaatagacccatggaacagaatggagaacctggaagtaaagccacacacctacagctatctgatctttgacaaagccaacaaaaataagcgatggggaatggacttcctattcaataaatggtgttgggatagctggctaaccatatgcagaagaatgaatctggacccctacctttcaccagatacaaaaattaactcaaattggattaaatatttaaatataagacctcaaactataagaatcttagaaaataccattctggacatcagccttcggaaagaattcatggctaagttctcaaaagcaatcacaatgaaaacaaaaattgagaagtggggcctaatgaaactcaagagcttctgcatgcaagagaaactatcaaggaagtaaacagacaacgtacagaatgggagcaaaatattcacaaactatatatctgacaaaatgctaatatccagaatctttaaggaacttaaatcatcaagcaaaaaaacaaccccattaaaaagaaggcaaaggacatgaacagacatttctcaaaagaagacatacaggctgccaacaaacatatgagtaaatggtcatcatcactaatcttcagagaaatgcagatcaaaaccacaatgaaataccatctcacagcagtcagaatggctattattaaaaaaaattaaaaaccacagatgttggcagggctgtggagaaaagggaacattcatacactgttggtgggaatgtaaattagttcaaccactgtggaaagcagtccggagatttttcaaagaacttaaaatataacgactattcaacccagcaatcccattacggggtatatatccaaaagtaaacaaaatgttctaccaaaaagacacatgcactcacatgtttatcacagcactatttacaatagcaaagacacaaccaggtgcagtggctcacacccataatcccagcaatttggaaggccgaggcaggcagatcacctgaggtcaggagttcaagcccagcctggctaacatggtgaaaccccatctctactaaaaatacaaaaattagctgggcatggtggtgcatgactgtaatcccagcttcttgggaggccgaggcaggagaaccgcttgaacccaggaagcagaggttgcagtgagtcaagattgtgccactgcactcagcctgggaaataaagcaagatccatctcaaaaaccaaaaatatagcaaagacatagcatcaacctaaatgtccatcaatagtgggctggaaaaagaaaacgtggtacacatacaccatggaatactacacagacatgaaaaataataaaattatgtcctttgcagcaacatggatgtagctggaggtcattatccaaagtgaattaatgcaggaacaaaaaaaatatattgaatgttcttactcataacaaggagctaaacattggctactcatgaacataaagatggcagcagcagaatctaggaactactagagggggaaagggagggagggcagaagtttgaaaaactgttgggtaccatgctcactaggtgatgggatcaatcatactccaaacctcatcatcatacaatgcacccaagtaacaaaactacacatgtatcccctgaatctgaaaaaaaaaaaaaaaaaaaaaaatgcatgccttcaacgaggagctttctttgctttgcaatagagctcactattggaaggaaaattaatgtatgtgaaatgtttgctgggtatcagaaataacataagttcctaatactccagcctgttctcctgctcttgctttgcagttgagaaaaaaattttaccagtagcttaatgaaaaatttaaaatactagggtataccaaaaatgtcatcattttttaatattaggccagtatgagactgctctctatttgggaattagcagtttatcatctctgaggaaattagtcatcccaaaagacaatcaaatgttgacatttgacatgcccagtaaactactaggacccttcatcatcacgctccaatgaggcccaccagtcgataagccctgcccacatgtacatctacacactcattcacacacccacccacacacatacgcccaaacacacccccacgcccccgccacacacactcacaaagctgacagccaggtttttgatgccttgccccgaaatataacctaatcaacaaggaaagaatcaccagacatttgaggaaatactctaacatggaagaaaatcccagagaaaatcagatttccacagaaataggggaaatatagagagtacaaaactaaacaaaaatactaaaaaactcataattaatgcccctagcaataggaaaatgtatctacatttaaaagtattacttaaaagaatatatgaagaacaagaaaaatcttcttagaaattaaaaaccttatagcagaaatgaaaaatttaataaaagtttgaaatatgaacttaaaagatcaaaaagataaacagatggaaaatagtaaagaaaaggtttttaaacaatcagacccttgctccaggggttcaatatcaagctaacagtgttttcacaaagagaaaacttagaggacaacattattcaatcagaatacaagaaaatatcctaaaactgaaagatacgagttttctaataaaatatgctcaccacaataaatgaaagatgacccaaactaaaacagtttactgtatataagaccttaaatgtctaaatagaggaataaaagccacatacaaagaatgagaataacatcaaatttttcaagattagaacgtgcagacaatagaagaatgcctttaaatgtcttttgatcacatgaatagacttattgtaacatggaatgctcaagattagtgccagtaaagtatctaattctgacttcaacttttaaaataattaaaatcaataaaatcaaaacaggatagttaccagaataacagtgccattataaccacattaaaaagaaaagcttccatcaaaattttatggtatgacaaatccagtacaatatattttattaaatatcgcattccactcaattttgtaatattccattttctgatgaaaatgttattcagaagagaggcttcagataaaaagaaaaattgaagtagaagtacatacgttgagatttcccaattttaccgttaaaaagtacgttagatgtcctgcaataatttgttcataagtatctttaacaaatgaataattattaatatatttcacagataagccacttggtaatttttactgacatagaactatataaacttttagtaaaacatttaaattgttttactttgaatctcctcacattttataagttagttttcatttattctgcttctttaaaaggcgtggccaggttgtttgtccataataggatcaacaaatattgaactgcactagatttgtataataactaatttatacaatttaatatgtgggaaattatacctctctgtgtatttagatatgtttatttgaaacaaaaataattaattttatgcatatgataagaaacagcctattaaatgtatatatttttaaaaataagcagcacagatagcagatacagaactctttactgtcagtactcttgactaccaagaaatgaagccacactctagaaaaatgcaatgcaagaaaagattcaagttatccctttgggtaaaaatcatccccttaataatattcttttgtaatctaaattcacagcatatcccatcagcccaaggtaatcttctaaaatgtcattatatttgcagtattataattttttttcaagccagtatttatggaggtcactgggctacggcaacaaaacattttaactccagggagagtatagctttgtaggattagctcctttgacaattgtctttctaaaaagatttttactttagaaacctctgacatatgtagttttcttcagatccaatgtatccaaatgttttgtaaaaaccaacattttgtggtagacattcaagagtaatcttataacagttcagtttcttgcttagcaaactacaagttgataacaatttgccaagctgtcttcctctgcattcactgctaacaacatctactctttctctcttagcacaggaaaggatgaatttatgtactattatcagagttgtcatggcaacactgtcaccgagtcacatcttccacaactgtaacataatgaaccacagatttctttgtatgctcaaaatgctttatacattatcaaggttgacaactccagtggcagttcgctgacccactaccttaaaaaaaaaaaaccctaggttagttatattagtccattttcatactgctatgaagaaacacccgagactgggtaatttataaagagaaagagttttaatggactcgcagttccatgtggctggggaggcctcacaatcatggcagaaggtgaaggaggaacaaggcacatcttatgtgatggcaggcaagagagcatgtgcaggagaactgtcctttataaagccatcagatctcctgggacttattcactatcatgggaatagtacaggaaaaacccactcccatgattcagttacctcccactggctccctaccatgacatgcagggattatgggagctacaactcaagatgagatttaggtggagacacagccaaaccatatcatcagtagacaaagaggccttaaaccaagccttctgggagatgtgttggtgaaataactggagcatatatagctgtattctgattccagtccacttctttaagtagacttgggtcaaacaggagtttcatgaggtttcatctttccagtaagtctgtttgataaacctgaggcaggcccactatgccccccaggacaccaggtcccactctcacttcccaacccccagcccctcctcagtgcctttaaaattttgaaggaagattatttccagccagaaggcccagaaaatcaatcaaaccaaacacactgtcaatcaagcacaaagacttttaaaagatacaggtgactcttgttatttgtggaagttatattctgtaaagtcacagcgaacactgagttagcaaatactgaaccattgctcctagcggaaatagagggctagatccctatgagcctctgatcacaacatttttgccaaccaatcaatacataaacttgctgtttgtttctgtttaaagactccatgtctttagtgtatgttatatcaatatatgatgttgattcattaacatcgaactcacagccagcagcacaactcatgcctgaaggaagctcatctaaagaagctcacatattttctctataagacacatcacagcatttcagcactatactgggggggggggggcattttaagctgcaaaatcaccaagaaaaagcacaaaagtatgaaaaatgaggcactaaatagatcataacatagatgcttatttgcagtatgaactgaaacaaagaggcagtgtcacctcattggacctcatctaggaacatgtaactcaaaatgtttaccctctatgcatgtttctgaatgatcataaaaaccctgcgagtattaattaggaggtcacaaacaaattttgcaaagttgcaaatatagaatccatgaataatgagaatcaactgtattttcagaaatataattattcacaagctatttctaagaaatctaaaggttgtttcaccaaaattatcgaactaacagaaaaaatggggggtgggggtctaacacaaaagggaaggaagtccccaaggtggctggtgaagagaagtaccaagatgacagctttgtaacagacccaaagagaaccagtctgggttgcagcaggacaatggaatgctccaggaagaatgaaaaaagtagaccattataagtgccaagtaaacaatgattgtacaagaaggaaatataatcattgcacagtatgttcctcagctgtaaataatatttatatggttatatcaatataaacattgaatattgacctaaccaaacaaaaaagaattaatgaggaaaaaaaatggaagttcacaaattcttcagtacaagtaaacagagcaatattttgagggctcaaagaggactcacttttgagtataaggtttttttctagaaactaaagaatattagataaaatgttttcttaataatattcagaaggaaagtacctctaagaaacatttatagattataataagaagagattaatatggaaaatatcagttaactctttaagacaccagatgcaatacaatgccccatttgaagcagtaaattaaagatttgatattgcagaggaaaagaaggtcaataaatgatattaaggaaaattaacaaatattccatgagaaaaatagaggaaaagtaaaatggcaaaaatgagaacaaaagaaaaaaatgggatgaaacaccattgagtttaatctgtaaataatagccattaccaaagatgacaattttatagaacatgagtcaataataaaaagtaaaatatataattcattgatttttctaaatgaggcatttagaatttgaaatgtaaagaaatctataggaatccataaatttaaaaagagactaactttaagacaaaaggtaaaatcgaactcagttttctctgtgatgtactactgtgaagataatcgtggagaatttttgtgggaaaggattgtaacacaagaactctgtgttcagctatgtcattttgtatgtgtgaagatgccggaaagacatcaacagaaaattatgatgtatcatgtaccaatcccagataaaattctagaagggtagtcactcacctggttttgtctatcctgaacaccagcatcttaaggatcaacctgttttacaaacgtatgtttaacaaatatttagtcatgttctttaactgggaactttatggaagggttaaagtgattcactgaaaatgactatgtagaaaaataatcagggaaggggaaaatttgacatttaaaaaattcagctggtaaaatagtgatgagattttttaaaaattttgaataatagtaataggagggagactatctcttctacaaattcatgatttagggataaaaattgacagtaatcagtggggaaaaaaatagaaaccataacaataagtcatgttcacacaaaaaggtcataattgacaaaaggtgcaaatcagttcttttttgcttctataatatttgtatgaaatactcattttagatagtatgtgtccagtgcagtatgagcttgtaacaaaaagacaatagaggacatgtataaatagctaggtattttgggaaaatgggcaatgcagaaaatcaagtgcatgtgcctagaggaatgacaatgtttagtataaaaagatttgctaaaatcttcaatattttaaaataataatggtgataaaaagctgtcctctcattttaatttgaatacgtttactgttttatgctgaattaatattccccacttgtttttgctacagtctattgtgtttaagtagttttcttattactattttactttgaatataagaaatgcctcttaaattttatcaaatgcctctttagtatttacagataaaatctgtaatctcttttaatttgtttttgttccagattacgttgatagatttccagacctgaaactgatactaatgacctctttctggtttactttggcttataggttgctctttttctaatgagattaggtctgagttcttttctttttcatcttttttctttaagaatgaaggcatctaaagctgtagatttttctgaggcaagtattcactgtgtctcacaggttttggaaaaagtattgtttttatttctttctagagaatatgtagtgcaatttttctttttttgacttcgcatcagtttggttggggagagtcaaagaaactgaactagtactaagggaaagtgagccagatttagggtatcagcttttgaaaatctgtaggtggatatctaaatgttacattttaacaatgtaacttaattttaatgaaattatgaaactttaacttgaaaaatatcccagaactatataatgctataatgcattaatcctcttctctaaaaagaatccccaacaaatagttttcagactcttgtggcatatgtatctgtgtgttatattacaacatacaatgttgtgtcatggtattttccattttacgattctattcttttttaaaacatactagaagctcaaggtattggtattcattatcttatttctttgttaaatttagcagtaacattcttccttataattactaccctttaatacttagtctgccttctggagccacaatgaagaaattcaattcctcttccacttgacaggctttcaaatatttaaagttaggcacccttcttctctagctgtcttctcaaaggctcttctctagcccaacatccttctctagcccaaacaaccttatttaattcaattattttttatatagggtcattgtcttgagactttttgccatcctaattttcttcatctatacggatcctagttggtcaaaattattctaaaagtgcactgacacatactaaactaaatatttccaatgatggctcaaagtgaaagtccaatggaattattaccctttttttatagacactaaaaatcatttaatgccaattaagatttcattatctggccgggtgcagtggctcatgcctgtaatcccagcactttgagaggccaaggcggctagatcatttgaggtcaggagtttgagaccagcctggccaacatgaagaaaccctgtctctactaaaaatacaaaaattagccaggtgtagtggcacacacctgtagtcccagctactcgggaggctgaggcaggagaattgcttgaacccaggaggcggaggttgcagtgagctgagattgcgccattgcactcactccagcctgggtgacagagcatgacttcgtctcaaaaaaaaaaaaaaaaagaaagaaagatttcattatctttgtggcttaatattgagattgcaattgacaaaaacactcaagtatttcttacagcaatatctgggaagccatagacaaggtagtctatgctatgaactttgattatattgatgccttggttctctcatatataaagtcaagataatattaatactaactcatagaattttgaagacaatgaaattatttgatatatgtaaagcatttagaatagtggctgataaatgctaagccttcagtaaatgataactgttaacattattataattattatcatctgttttgacatcattctccaacatttttaaaagctagtctccaccataaagagcttgtgtagttgatacattttcccttgaaggaaaactttgaaaaaatcattttaattcagtatgttaaatcataaaaatatcaactgcatgaactatgaaaaacatttacctgtaaatggacaagtgtactcttcgactacgtgtcacatatggttattctcaacaaacatggaatataaaaacacaaaacatgcaaaatacaacacagcctaaactgggttgtgtcagtcaggatctgcaaaagaatattggaatagaaagtgcttggaacagctactacctctgtggctgagggagagtactcaagggaaaaatgaagttgaagagagcctctctccccagggttgagatgcaaatctcactggaggagatgtgtttgcagctgacttgaggtcagagaagtctatgaggatgttagtggactggaggtgatgagtaggaaacctctgctgagatgcccatggttatcactgggcctctgataagctgctggtagctgtgccagagaataagaagaaaagcacctggaaaaagaagctccttcttcttctatgccttgcagttttcctccagcaccctgtactgccaaactttaacactgtgtcagcaggcaaaggaggaagtccagctccactattacaaagcaagctcaaaaaaagggtagatttagagctgaccagcaataaattgatagatggaagaaagatctaacccaatatcgcaattgtaatgctctaaacattctaatatcaatatacaggtgtttgaaaatttgaatgaaaacactttacttttctacagaaagtaaatactatagcagaaagttccacagatgtgtaacattcgatttaaaaaaatatctttgggtgactaaaacacctgccttttcagagcttatgatctagtgagatagactcataaacagccaaatacaatataatatatttagatagaagtgtgcttaagaagctgtaagaatgagacctgaacattaatgactacattgaacagttaaaacaaagagatggatcatagtctacaggattttgacatgagccatcctggaatattttaccctgaaaacttcagtgtcaagaaattctgataaattagattaagttcaaagaagagagacggtgataattaatggaagggaaagactggcttgtgaggggaaaggctaacaaaaataaatctatacaaattagctaagtgacaagagaagcagagagctgacaagcatgagttggatgtaaattcaaaaaagctataatcaaagaatagcacagaaagtggaatttagtctaattcaacaaactttataatgggggaagatgtggagcttgatttaggcctttaagaatgaacatattggctgggcacgggggctcacgcctgtaatgccagcactttggcaggccgaggtgagcggatcatctgagttcagcagttcgagaccagcctcaacatggagaaaccctgtctctactaaaaaaaaaaaaaaaaaaaaaaaatacaaaattagctgggcatggtggtgcatgcctgtaatcccagctactcgggaggctgagacaggagaattgcttgaacctgggaggcagaggttgcgatgagccaagatcgtgccattgcactccagcctgggcaacaaaagcaaaactccgtctcaaaaaaaaaaaaaaaaaaaaaatggacatacttccagcagaaagaatataccacatatgttgatggatggagagtataacaggaaaccttttgttgagccatcagttgagctaatgcaaaagattgtgtcaagatacaagaatgtctctgcctgagagcaaggagattttttttttttgcaccagagtagagccagacagagcgtaggtgctgagaaatgctgacggattaaaagagtaattgaatgaatagtgaaagaatgtcagagaaaggagctacattttggagagtgctgaatgttgaagagatctgtatgttaccttgtaagccatggggactaattgaagggttttatgctgttgctgttatttttatttaagtatgcttcctaacagacacagtagagagaaaagtaacaacataccccattcaaagtgataattccaaaatcagaaaccctgtgttactagccaaaagaaagaaaaataataggatttttcttcctccttttctcatttccaaaatttactcttcctacattctgtcactggtctatcaattaaagtaatcatcctttaaatgtgtgagacagtaaacttgactcacagcaagcaaagaatgagagctttcttaagttaggtggattattttaatctttagaacttcttagccattttctcttcctcaggtgacaggtcctgattcaccagtagcgaggaactctgtgaagatatcataattatttaggtcccattaggtttctcctcactttctcccccattacaaaggtccttgaaaataaattgaatatttcatcaatgaaacttagactaagtagcttatttcactgtttttgaattttgtatatatgtgtgcatacgtattggtgacatacaccaaagtaaaagtaaaaatttatatgtattccctaaagtgaaatgaacagatttttgttcacaatattagattggcaaagtttgtaaatttgtttaactttagatactctgacagctagaaacctacaccaacattttatgatgaattagaagaaggatcctgtagatacacctaaggatacctctgatttcaccttatccacggggaagtatgctctggaaattcagccagttagttgaattatatcctgcattatttttacattatatcttctgcattcataatttctagaactaaccatgggtattctgaagaatagctgtgccaaagagagagaataatctccataaaacatattgtccatacctgttccacatttttctaccaccagatttcttgatcatctagaaatacctaccctttgaacattcacttgtcaaatccctactctttgcaaggtccagttcaaatgccagctctttcatgaagccgtgtttgatccctgtgtctcactcaccacctcctatttcccctccttataagctctcatagaagttcttatttcagattcagttatcaaattctgcctcaacttacggtcaactgtgtatttgtctaatctcttatacttagattgaaattccttgaggttagaagtcatgttttactgataatgttattcacaactcctagtattgcacctgacttacaattaagaactcaataattgattattcaatttaatatagaaagccagttatcgcaattgagaaggctctagtagtagttattattggcaagatgtttgctaagaacacattaaaatgtttcctacttgtgctaggaaatttattagtattcttaagattatattttaatgaagttcggtgagggaaaataagaagaaatactttgggtattagcctactcatatgaaactggctttatgaattcaaagggattagataaaattgattacgtatattgtaaaacccaatgagttgtgattcttctataaatgaaaaagtttaaatgaaatttcaggaaagttacttggtcctcatttaatcttcagtaataaaagaaacagtgtggatatatggctctaagcaattactttagcaattctgattccccattacatcttgagagaatgtgaatgattaaggacacactgagaagtaggataaaattagtaaaggtgtactggatttttaaataaacaatatgaaatatttgtttgcactaaacattcaaaaccatcatttcatttttctagaaggtcaaatacctgccataagccaatggttatgcttccaagcaatagaaacctcagcatttccttggttgagtttcatcctagacagtgccctaaacttctattttattatcatttttgttttgagttacctaagaaccaaatagtcatactaaactattaaagtgagagcgacaaaagttcttctcttaaaagccaaaatagatcatcccataaggatcacagtaccactctcagtttatgagggagaaaaggggtgtggggcagggatttttcttaactgaaaaaccaactcttcttagcaatacagttctaggatatataaaattctttaaaaaactgaatatgactcctcacaatgccatcttttggtgggtgatttcaaatagaggttcactcagaaagaaaaaggggatttttatgaaagagatagaatctggaaagagagaaaaggatcccctcccccacaaaaaaggactgaggagggtggcaggaacattggggaaacaatagctagtgtgaatcagacttgccctggtgtgatctttggatctctttgaatctctttctctttcttggaaatccaccttgattttatagcttatgacctgagccaactactgccatgacatttctgctaaaagcccaaaccattaagacaaaagcagtcttgacatgattaccaagacaggtctgtttgtgcatttcattttatttttaactttgacagataaaattgagtttatgatggcaggcagtggaacctgagaatcaaacaattcagaatacttagctataactggttcttgtaaatacatcttagcagtcaggattgaacaaaaaaaagcaggttggacaagataatttaagcagcaactgagaaaaataaaaatgaattttcttttcctgtgtacttttaaattcccagaaggcttttaaattatcgaagtatttactgaaggtataagacacataagtggaaatcattactgtcatctatattaataatgcctttataattgatgagtgtgtcgtattttcttcttgcaattaaactctgctgtctgagattacagcataaaaaagagtctctgaaaaaaattataaaaacaatttgggggcggcaggtggggccaagatggccaaataggaacagctccagtctacagctcccagcatgagcaacgcagaacatgggtgatttctgcatttccaactgaggtaccaggttcatctcactggagagtgtcagaaagtgggtgcaggacagtgagtgcagcgcactgagtgtgagccaaagcagggcgaggcatcacctcccccgggaagtgcaagaggtcagggaattccctttcctagtcaaagaaaggggtgacagacggcacctggaaaatcgggtcactcccaccctaatactgcgcttttccaatggtcttagcaaacggcacatcaggagattatatcccgcacctggctcggaaggacctacgctcatggagcctcgctcattgctagcacagcagtctgagatcaaactgaaagggggcagcgaagctgggggagggatgcccgccattgcccaggcttcagtaggtaaacaaaatggccaggaagctcgaactgggtggagcccaccacagctcaaggaggcctgcctgcctctgtagactccacctctgagggcagggcacagccaaacaaaaggcagcagaatcctctgcagacttaaatgtccctgtctgacagctttgaagagagtagtggttctcccagcacgcagctggacatcggagaatggacagactgcctccttaagtgggtccctgacccccaagtagcctaactgggaggcactccccagtaggggcagactgacacctcacacggccaggtactcctctgagacaaaacttccagaggaacgatcaggcagcaacatttgctgctcaccaatatctgctgttctgcagccacgactgctgatgcccaggcaaacagggtctggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagtgcctctcctcctccaaaggaacgcagctcctcaccagcaacggaacaaagctggacagggaatgactttgacgagttgagagaataaggcttcagacgatcaaactactccgagctaaaggaggaagtttgaacccatggcaaagaagtaaaaaaccttgaaaaaaaaatgagacaaatggctaactagaataaccaatgcagagaagtccttaaaggacctgatggagctgaaaaccaaggcaccagaactacgtgatgaatggacaagcctcagtagccgatttgatcaactggaagaaagggtatcagtgatggaagatcaaatgaatgaaatgaagtgagaagagaagtttagagaaaaaagaaaaaagaaatgaacaaagcctccaagtaatatgggactatgtgaaaagaccaaatctacgcctgactggtgtacctgaaagtgactgggagaatggaaccaagttggaaaacactctgcaggatattatccaggagaacttccccaatctagcaaggcaggccaacattcaaattcaggaaatacagagaacgccacaaagatgctacttgagaagagcaactccaagacacataattgtcagattcaccaaatttgaaatgaaggaaaaaatgttaagggcagccagagaaaaaggtagggttacccacaaagggaagcccatcagactaacaactgatctctcggcagaaactctacaagccagaagagagtgggggccaatattcaacattcttaaagaaaagaattttcaactcagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaaccagtaccagccactgcaaaaacatgtcaaattgtaaagaccatcgagtctaggaagaaactgcatcaactaatgagcaaaataaccagctaacatcataatgacaggatcaaattcacacataacaatactaaccttaaatgtaaatgggctaaatgctccaattaaaagacacagactggcaaattggataaagagtcaagacccatcagtgtgctgtattcaggaaacccatctcacatgcagaggcacacataggctcaaaataaaagggtggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcatacagcaagtccttagagacctacaaagagacttagactccaacacaataataatgggagactttaacacaccactgtcaacattagacagatcaacgagacagaaagttaacaaggatatccaggacctgaactcagctctgcaccaagaggacctaatagacatctacagaactgtctaccccaaatcaacagaatatacattcttctcatcaccacaccacccttattccaaaattcaccacatagttggaagtaaagcactcctctgcaaatgtaaaagaacagaaattacaacaaactatctctcagaccacagtgcaatcaaactagaactcaggattaagaaactcactcaaaaccactcaactacatggaaactgaacaacctgctcctgaatgactactgggtacataatgaaatgaaagcagaaataaagacgttctttgaaaccaatgagaacaaagtcacaacataccagacctctgggacacattcaaagcagtgtgtagagggaaattcatagcactaaatgcccacaagagaaagcaggaaagatctaaaattgacaccctaacatcacaattaaaagaactagagaagcaagagcaaacacattcaaaagctagcaaaaggcaagaaataactaagatcagagcagaactgaaggaaatagagacacaaaaaacccttcaaaaaattaatgaatccaggagctggttttttgaaaagatcaacaaaattgatagactgctagcaagactaataaagaagaaaagagagaagaatcaaatagacgcaataaaaaatgataaaggggatatcaccagtgatcccacagaaatacaaactaccatcagggaatactataaacacctctacgcaaataaactagaaaatctagaagaaacggataaattcctcgacacatacaccctcccaagactaaaccaggaagaagttgaatctctgaatagaccaataacaggctctgaaattgaggcaataattaatagcttaccaaccaaaaaaagtccaggaccagacagattcacagccgaattctaccagaggtacaaggaggagctagtaccattccttctgaaactattccaatcaatagaaaaagaaggaatcctccctaactaattttatgaggcctgcatcatactgatatcaaagcctggcagagacacaacagaaaaagagaattttagaccaatatccttgatgaacatcaatgcaaaaatcctcagtaaaatactgacaaaccgaatccagcggcacatcaaaatgcttatccaccatgatcaagtgggcttcatccctgggatgcaaggctggttcaacataagcaaatcaataaacgttatccagcatataaacagaaccgatggcaaaaacctcatgattatctcaatagacacagaaaggcctttgacaaaattcaacaacccttcatgctaaaaattctcaataaattaggtattgataggatgtatctcaaaataataagagctatctataacaaacccacagccaatatcatactgaatgggcaaaaactggaagcattcccttgaaaactggcacaagacagggatgccctctctcaccactcctattcaacgtagtgttggaagttctggccagggcaatcaggcaagagaaggaaataaagggtattcaattaggaaaagaggaagtcatattgtccctgtttgcagatgacatgattgtatatctagaaaaccccactgtctcagcccaaaatctccttaagctgataggcaacttcagcaaagtctcaggatacaaaatcaatgtacaaaaatcacaagcactcttatacaccaataacagacaaacagagggccaaatcatgagtgaccgccgattcacaattgcttcaaggagaataaaatacctaggaatccaacttacaagggatatgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttacagattcaatgccatcctcatcaagctaccaatgactttcttcacagaattggaaaacactactttaaagttcatatggaaccaaaaaagagcccacattgccaagtcaatcctaagccaaaagaacaaagctggaggcatcacactacctgacttcaaactatactacaagactacagtaaccaaaacagcctggtactggtaccaaaacagtgatatagaccaatggaacagaacagagccctcagaaataatgccgcatagctacaaccatctgatctttcacaaacctgacaaaaacaagcaatggggaaaggattccctatttaataaatggtgctgggaaaactggctagccatatgtagaaagctgaaactgtatcccttctttacaccttatacaaaaattaattcaagatggattaaagacttaaatgttaaacctagaaccgtaaaaaccctaggagaaaacctaggcaataccattcaggacataggcatgggcaaggacttcatgtctaaaacaccaaaagcaatggcaacagaagccaaaattgacaaatgggatctaattaaactaaagagcttctgcacagcaaaagaaactaccatcagagtgaacaggcaacctacagaatgggagaaaatttttgcaacctactcatctgataaagggttaatatccagaatctacaatgaactcaaacaaatttacaagaaaaaaacaaacaacctcatcaaaaagtgggcaaaggacctgaacagacacttctcaaaagaagacatttatgcatccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgtcagtgggactgtaaactagttcgaccattgtggaagtcagtgtggcaattcctcagggatccagaactagaaataccatttgacccagccatcccattactgggtatatacccaaaggactataaatcatgctgctataaagacacatgcacatgtatgtttattgcagcactattcacaatggcaaagacttggaaccaacccaaatgtccaacaatgatagagtggattaagaaaatgtggcacatatacagcatggaatactatgcagccataaaaataatgagttcgtgtcctttgtagggacatggatgaagctggaaaccatcattcccagcaaactatggcaaggacaaaaaaccaaacgccacatgttctcactcataggtgggaattgaacgatgagaacacatggacacaggaaggggaacatcacacaccagggcctgttgtggggtgggggaaggggggagggataccattaggagatatacctaatgttaaatgacgagttaatgggtgcagcacacccacacggcacatgtatatgtatgtaactaacctgcacgttgtgcacaagtaccctaaaacttaaagcataataaaaaaattaaaaaaaataaaaaatttagtcacgtatttcctttgtgagcttatttggttacatctgaaaatactgagaacttttattccatgaaaatgattgtcccctcaatcaatagcaattgaatgcatcaaatatgtctagcaccatttctgctacacagtaaatactcaaatatatttattggaattagcaaccattcccttttctttgcatcctctacatctgttgtttttttattttttaacaaaagccattctgaggggtgtgagattgtggttttgatttgcatttatctaatgattagtgacgatgaccatttattcatatgtttgttgtcagcttgtcttcttttaagaagtgtctgttcatgtcttttgccttctttttaatagggtgggttttttgcttgaaaatttatttaagtttcttacagattctggatattagacctttgtcagatgcacagtttatgaatatttcccccattctgcaggctgtctgtttacttccttcatagttttgctgtgcagaagttcttgagtttaattatgtcctacttgtcaatttttgattttgttgcaatagcttttgaaaacgtagccaatatcaaaaaggggatttcctaggttttcttctaagattttcatattttgaggtcttacatttaaatattcaatctatcttgagtcagtttttgtatatggtgaaaggttgtggtctagctttattcttctgcatatcagccagctatgatggcactattgactagggagtcctttccttattgcttagttttgttgaatttttcagagattagatggctgtaggtgtatgtccttatttctaggttctctatcctgttccattggtctattgtctatttttgtaccaggaccatgctttttggttaccgtagccttgtagtatagtttgaagtaggataatgtgatgcctcttgctttgttctttttgcttaggattgctttggctattcaggctcttttgttgttgttgttccctatgaattttcaatagtttcttccagttctttaaaaaatgatgttggtagttttatagggatagcattgcatctgtaaattgcatgggatagtatggccattttaatgatgctgattcttccaatccatgaacaaggagtgtttttctatattttatgttgtgatttctttgagcagtgttttgtagttctccttgtagagatctttcacctccttggttaaatcaattcctgggtattttatttttgtttgtggctattgtgaatgggattgcattcttgatttggctctcactttaaatgttattggtatatagaaatgctacctatttttgtgtattatttttctttgccagattttggtgttaggatgatgctgacttcatagagtgagttagagagaagtctctcctccttgacttttttggaatagtttcagttggattggtaacaactcttttttatttgtctggtagaattcagctgtgaatacatctgatcatgagcttttattgattggtaggttttgtattatggatcccatttcagaacttgttactggtctgttcaggttttcagtttcttcctggttcaattatgagaggttgtgtttcaaggaatttatccattttctctagatgtcctattttgtgtacatagcagtgttcataatagtttctgaggatcttttgtatttctgtgggattgattgtaatgttatctgtgtcactgatcttgtttatttatttagagagccaacttttggttttattgatcttttgtgtagattttcacatcttggtttcattcagttctgctccacttttggctatttttttcttctgctaacttcggggttaatttgctcttgtttttctaattcccccatatactgtattagactgttaatttgggagttttctaatttcttcgtctaccagtttagtggaaagtcttgggagatgggcacctgtggccatgtcttgctgccgctgccccctacacaaaatcccttgggctctgcccagacaggagctccacctctgcctattttctgagcagattcccctgccaattcaaatgtctgtggggatcatggcatctcttatagctaggatcccagaggtctgtggcgaaagtggtttgccccacagtcacttcactcagccttccttaatagccattcagggctgggaattagtcctggcacttggcatccccatgcagggtccccagcttcctccatcttcagcctcagttactgtgtcacctctctgttgactctcagtgttttctctcaaaagatctgctttaagtatgtaggtttagtccacattttggtgtctcttggtgagacaggcactttctggctgcatctagttagccctcttgttctgatctcctgaggtgacatttacaccttagggtttgatggtagccaataggtgggctttagcatccctcaactcaatgtcacagttgtatctatactattagaataaactaaagcaaaaaccattattattttaataatccatgactgccagacaaaagtggctatttccttcttacactttaggcagtggtctcattgtccccttggtttgcatagatggatacagcattgctctagccatacaatgctcagtcttccattcagatgctcaaatggagtaagttcttactttatatttcagcacctgaacccaaacaccatgtgttccatttgacagaactggaggcagactttaccttcatggattaggtctgctcttagatcaggatttttcaccctctatgtaagagcatgaggagctataaataaatctatccttaaagccaaaataacaagcccatcttaataaggttatttcagttaacataagaatagttacaaagtaaaggtctgttaaatttatttggaaatataaaattattcctccattatatagtagtttctcaaaacgttaaacatagaattaccatatgaccgagcaattccacttctaggtatatacctaaaagagatgaaatcagggaatcagacacttttgcaccagtgctcatagaaacactattcataatggccaagatgtggaaacagccaagtgtctatcaacagatgaatgggtaaagaaaaagtgatatgtatgtcagtatacatatatatctataggggtgatatagataatatttacatatattttaataatattctattggagtaatacttttaaatattttgtgtgtgtgtgtgcatatatatatgtgtgtgtatatatatatgtgtgtgtgtgtatatatatatatatgtatatatctcatcccaatggaatattgttcatcctcaaaaaggaatgaaattctgatacatactacatggataaactttgaaaatattatgctaagtaaaataagccaaacacaaaagaacaaatattgtatgactatatgattgtatgatttgtatttgtattaatgacagaggctggagaggcaggaatgggaagttattgtttaatgagtataaagtttctgtttaggttgatgataaggttattgaaatgggtagtggcaatgtttgtacaattttgtgaatgtacttaacgccattgaatcataaactttaaaaagattagaatagtaaatatggagttatgtatgttttgccacaataaaaagaaaacgagtaagtaaacttttttttttaaattactcccctgtggtacagttactccattcatcatcacattaagacttcttccaggttggggagtgttgcgagatgttgtcaaaatgaccccacttgtgaaatcagaaaactttcccttaaatctcagctctgtcacctagtaggaatgcaaatttgagcaagtcacttaggtctgttgcaccttaatttcttcaggttatgctgtccaacagagttgttttgatgactgtaattgaaatgcatataaagtgcttcgtaaattcaaacaacaaggcaagtggatggaggtgactttttaaaatatattcttttagggagcttagtcgtaatactgttatctctgaaatgcatttactaattcatatttaaatatactaaaatattaaggtattgttggtaagacagccacagttatttttctaatttttctctatttaaagtattgaatccatagttttagaattaaaaaatcctgaatttccaaggaaccacatttctattcaccatttctataatgaatgggttattaaacctttccatttatcttatttcaataccttttgttcattatgtagcctcattgtacataccttaggaagaagggataattatattacctcagagagaagggacaactatatgattatcttgtctgagatgaaaaactatggtcttcattcatacctaattaaaagttttttgtttttgtttttttttttttgagacggagtctcgctctgtgtcgcccaggctggagtgcagtggcgcgatcttggctcactgcaagctccgcctcccgggttcatgccattctcctgcctcagcctcccgtgtagctgggactacaggcgcccgaaaagttttaacttatttattttgctacctgttctgattttcattccaaaccacaccattatcagtccctacattgtcaaacatgtaataataatttggcatgacattatatcaaattggacattatcttggaaggtcctttggatgcataattatattgaaaaataaatattttaaaagtaacaaattttatgctataacatcataagttaataataaaattaatgtcattgaaacaaatgccaactaatttttttgtttccctctttagcggttatgtctttgactatgattactacagagatgatttctacaatcggtatgtgaatttttcatccttgttttcctatgacttaaattatcttttaaccattttgtacattttattcatgggtgctcttaattatggtatttaaaacaatattattatagttaaaaataaaatactaaatcccaacaaaatatacagatttttatattttcattatacttacttgagtacagtggatcttggaattttaggactttggaggtgctcaaacctaagatttggtgtctaatatttagataaaatcctaaagatttaattaactaatattatctgccaagtcatttgttgatttagaatccttcaagatcaagagtttgaaaactcagaaaaataactccaaccttctgaagtccataataaaacattgaaaatgctatattgggtagagtctgtaaaatttacagatcgttcctgctttgcaggacagtaggaggccacaaaggtgatgatgcaagatgagaccatccaatgaggaaaaaacaggattgtctcatgatcttaaacatgtttgtcaaaacattaacaacttttattctcttctctataaactaatgggaaactatagtaaagctaattgttatttagtatactataatttaaaacaataaaatattaagaattaaggtgttttagttctttgtaaagaacacttatcaaaagtagttgaaacagtgcatgccttctcatttcctaactcaggacaggatacggagtaggcatctgttttatcccttgttggatactcctctctaaggttgaattagctttgacattctatcaatgttgtgaactatctctgagagttctttcaatgtgtgattctcttgccagggtcacttcccctccatagcgttatacgtttcatcacatcacatccactttcctcacttatgtcgataagtttgcctttactaagttcctctgactccatacctagagtctcttgagtagaggagtatcaatatccctataatgagctatttcttctgtaatttcatttacatttaatttgagtttcacatctagtattatcactcttcgattctttgctgcattttcatctttgatcaattctttcttttgattattcaattttgcaaaatgccacgttttgtcactgagagataaggaagcattacaattaatgatctgaaacaagtgagtgaagtgaataatcaatgaacagcaaaaaaaatcattgacagactttgaaagatggaatgtgattagtgatcattgttattatcatgcacatttattatttatgcatttatttgtggaaaagctagaagcaaagtttggactttattaaattacttaccgtttatatgttgtagtaactaaaatttgtgttgtcggagaactggtgttatttaactaatatcagtaactgaaatttatgcatatcagagatgaggatcaactatatatagatagattacgggattaaaaaatgaggtaaatatattttaagcctttaattatgagtattatgcaaacaacaaaaaaaaccttaggtactgtataaaaatgcaaacttagaaaaaatttttcaatagatgttttaaagaggaagtaactgtgatccttgaaagggtcttattctctctgctccagcctctagggccttttgtaagttccacaagaattccatgtttcttcctgcctcaggtcctttctctgtgttgttccatctcctcatacctccctacactacctggttcacttgactcctcatctttcagatctcagcacgaacatccctcacagattaaattaggttcctctgttcctctcgctcagcgcccagcactgttacttcacagcacctctcctaatttctattgctatatttctttctgcagtgtttgattcatgtctgtcttccttcccccacctgaacaatgttcagttttgcttatctttgtatccttggggactatcagtaaacctcacacatagtggatactctgtattattaattcatctccttagatttagagacacagtcattttccgaaggtcaccaagctaattagtgacagaactatgatcataatctaggcatccaatttagattcaataaccaactatgtgaatatgcacaatggggagggcaatatcagcctatggagctatgcgattcctacttgagaatcagacccacaactgtaacttcattgctgcaatggtcaaactactgaattaagcaacttatttcactagttatccttttctgacaaaaaaatataatctttaagaatgattttctcaaagcattttataatttctataaaatatattttaaatattaagaaacttatcataacttattctaaaagtgatgcaaacatctggcagcattaaaataatcccatttactattaaggaaggatatctagactgtttttatactatttgaaaatgttactttttgacaagtttaaagacattttctactatagctattttttcacttgctacgaataaagttttcaattaatatacattgtcttatactctgtctatataaaaccattttagcatcttttattttctatcatatgacttccttatacatttaaagaatttccacctaacatggagttttactctacaccgtaggagacccaagttctggttgttaccggaaaggggtcccaattcagaccccaagagagggttcttgggtcttgcaagaagtaagtcagggcaagtccacagcacaaaagcaagtttattaagaaagaaaggtggtgaaactatagctactccatagacagagcagagtattcccagtattcccaaaagtaagaggaaggacgtgcctgccctaggtacaatgcttgtttatacataggacaacaacaacaacaacaaaaaccatggggagttgtgctctactacaagggtttgtgataaaggatacatttttctaattactgcattttgcaagaatcaatatgactatctttaaagcaaaattaggaatgcttttgttctgaagatatggagatatcaagacattcctgggcctgagtctgtttagtaaacattattaatctgttctcttaaccataaacatctaggagctaggaataaatacctaacctcctgggaatgcagcccagcaagtcccagcctcattcttcctagccctcactcaagatggagtcgctctggtttgaatgcctctgacatggtaactagccttgtaactttaggcaagtcaggttttcagttttctcatctttaaaaggaagccaggatttgcattttactatttagaaatgttagctcaataaaatcattagattagataggtgatagatggatggatggagatagatcgacagatagatagatagataatcaatagatccatcttacttgccaaagaacaagagctttaaatagtcaaattattagagaggctgtagctttcaggtgactctctactatacaagaacttagctacagtatgaacaattttcaaaatcatttatttgttttgtgtacaatctgtttggcatggaagtatgaaatagatcagtatggttgtattgttaacagactgagcagtctgtgctctcgttagtttattttccatttttggcacttggctaagaaagacataagcatctgccactagtggatatactcaagagttccctataaacatagaataccatgaaataaaaacagaatggagaggctggacaagatacatagcttacagagtcactactaatccacagtcatttctcataagttacggtcttcttgcatttgtgttttctttttctctctctcttttagcagaggtgcaaacttgggcaagttagttaatatcacaaaatctgttatgtcctctgggaggtgagcatgaaattaattcctaactcatgaaatcattctaagaattaaatgaggtaacataatgatcagcattatgcctggtattttttagtgcttaatcaatattagctagtattaacagttaacagtaaccattaacaataatggggccaggcgcggtggctcacgcctgatcccagcactttgggaggccgaggcagacggatcacctgcagtggggagtttgagaccagcctggccaacatggtaaaaccccatctctactaaaaatacaaaaattagccaggtctggtggtgggcgcctgtaataccagctactcaggaggctgaggcaggagaattgcttgaacccaggaggcagaggttgcagtgagccgagatcgtgccactgcactccagcctggggacagagcgaaactccgtctaaaaaaaagaaaaagaaaaaggaagaaaaagaaaaaaaaataatggtagatgtatttctcatattgacattcatacagcagtgtccatataactgagaaacaaactggttggtcagtttttcttccattatagctgatttgggacatctctggattattctgttttcccagttttccctctcctactcccccaaagcattccggctgcagctgatcacacttgcctgcagagagcgctcagctgtttctgttaaccccatgctgcttgtttagatcatgaaaacagaaattacactacttacgtataacagggctaattgcatatagaaactcgttaagtcggtattaaagaactgaaaacgcaaaaagacaacactgtgatatactggagttagtgactgcaggaagctgctaccacttctagggctggagaaacaaaggaagatttggggtctcagaaattgctgtagaaaaagagcctaccagagctgaaactatgcataggagattctgttcagatggtgctgctgtgtctgagtccacaaggagaacctgtggtgctgacacccaaatctctgagatggggatatgggctgacaggtgctggggtctttgagggagcgtggagtggctgttctccaagtgttgcaaaattactcagactggattctgctgatgctactggaatgaattgttgttgccaggatgaagaaactagattggggtaatgctgaaaagagcaggaagccaaaacacaaataaaaagcaaaacaagaaggagcaggtcccttttccttgctccaaccttgcagtctctttcttaggtcctttattggctgagcccagcagggagctagctgcccaaccccaaccctaaccctcacctccggaagtgtggttttcagagttccaaacccatcatctgtggctaagggtaggtctgaaaccaagaaacaatagcttaataactaacatatgtccacattatattgtcatactctttctgccaggtttggagactctaatgtgattgagggtttccaacccttagatagttttagcttagaaaacttctttacacaatgttccaccttactgtgattcattgacctgtctattcgtggtttcagggatcatgaagagtatcattaaacagtagatgagtggttattctaaattcttatcttttctcttttacacaaagcattgcccaataatttacagcattgaatggcattttcttttaaaggtccatatatgactctaaatgtaggacattgtatgttaatacattaaacgtaagtatttatactctagcaaagtaaaaggagatgtatacctaaaattatatttaatctccctagggaaagtttttaacttctgcaatgttagctgtctaaatccaacctcttttttcaataatattaggaaaagcactgatcagtttataatttccagtgataaggagacttttattaacagagaaaaacaaatgccacaggtgttttacttctatgtaaaacacgtatacattttaaatgatccaaaataggcattgttcaattctggaaccattttgactttgtgttaattgatccaagaaactactagatttgcagttaacgcaagaacactaagttacagttgtttcagatagttgattagagagcacaatatatattcatgaatattggaaaacatattaacaagaaacaatgttttgttatgcaaatttgaactatcctctggtagtatggtattccatttgaaatgtttgaaaataacagcatggtacacttgacaaatggtattatttggagtcagaagacatgaatttcaggactagatgcacatgtgttgactggttaagcttggataagtcatctcttttttgtgccagtttccttcctgggcaaaatggcttcacactactgaccttacagaattacaagaattaaatgagaaaatcgttttagtggcttataaccccacaacaacatttgaatttattaactttttaattacacaaagctgtatacaaaatgtacagttagcaatgttagataaaatacagactgtattagaatcaaaatattgcaaaaaagatcattcaagattgcaatcaacttgcctttaaaagcatgttcaagaagtatttccgtgtgatccaaggagaaaacttcacagaaaaccttggaaaatttaataacaaaaaagatcaatggaatttactcatttactggtctcaggtagagtgtgccttttaaaattattttctgattcaactgtaaccaaagatttatttgaagtcagagtagaaattataggcagagtttatgagttttgagtagtttaaacagtacagggaacagatacactaccagcctataagaattatttgtgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaaaagaattatttgtgtagatttcaaatctatcccttcttagaaatgaataggcaccttactttggttttatatactgtacatctgtcaaagttaagcataatgaaaaggaaggctggaggttgaatcaagacatggagcaagatcttctctggtcctctggttattgatctttgtagagctactgaaaggtgctggtgagaatatggccctgaatttgttatcaggttttgcctctgggtagcccagaaattttagccccctagggaagaccaaatatttttgttagcatcaactacttagtaactataagttttgattcatgaacaaggaaaaagaagaattgttttcatgagggcaatttagaaagaaacaggtaaataccagaaaatgtttgaagttactactaatctaaaatgaaaatttaatattcagtaataaaatacaacacacatattacatttttcagtttcttttcttgtgttttaaaccacgtttgttgacagtaaaatataagcatcaagtcagaagtttagccatcaggtaatgatttattagaatgtggtgtatctacctgagaaaatgccccacagccattaaaataaacattacgaagaccatttaacaggcctgagaaatgtttgtttttaatataaaccaaagagaatgagctagaatacatgactgtacatatattatgttttcaattatgtgaaaaatatggatgcttataaaaacagattaaagaattatagtagttgttctggggtctgagacttagaattgtagtttttttatgtacttttttttcccaaaatgttactttattattgctaaagcttaataataacaagttcttttttaaaaaagacacttaaaataatgtttgctttgttaatatgcctttgtccaaaaggcacttagtttttaaattaaattacctttgtccaaaaacaattattgtttaagaacagtagatgaaatcaaatgtccttattcttcctagagaaaagttgtctattttatcaaataaactactattaaaattaatattaccagtttttagcttttgctagctaataaagttacatatgtcagatattatttaaagcattaaaaggcaaaataagaaaagggtacatagaaaatagaaatgtttattaaataaagaaattaaattctcaaattttctccatgagttggttttattaaaattggactgaattttttaaatttattacttgacagcaggtgttttagagttttcactgtaaaatggaccttgaggaaagaattattattatatgtttggcttcattataaaccattatctatttgatgagtaagtatttgggagaaaattatcctgaccaagaaatattagggaaaattaagggctattaaaggaaaggagtggaaatataaatccaaagggtaaggaacaagaaaaacaagaggaaggaaaaaaattaaagcttttcactagcctggagatttagattccatttaattctgctggattgccatttctgctgtcagtctacaatcttaaatgaactagttccttagtctcaatactatttgccaatctaatatttgataaaggtaaaatttctttgatttactgtaggccgaattctgatgagaaggccaatacctgtctttcttgggctgcctttcacctacttccctctatattttgaagaacccctatatcccatcttgcaatcgcagaaagccttccccgctttctatccttgtcttgttatgtttttgtacattaggacaacatccagtcttccctccttttatttctaattgactcaagagtgcccaatgaaaattaagaaagtcttcaggtccattaaaagttgtaaaattaaaaattatgccctcgtgttagcccatgttactggtggaggatgtccaggttcttgaacaaataattgggcaaaacgcacaaacaaaggaaggaaagaatgaagtaacaaaagcagaggtttgtggaaaatgaaagtatactccacagggtgggagccaaccgagcataagggctcaagagcctggtgacagaattttctggggtttaaatactctctacaggtttcccattggttgcttggcatacaccctatgtatattaagtagtggcccacaatcagtccgattggttgcgggaggggaccaatcagaggtactttcaatttttcatcggccatgcagaaaaaggtggcaggatgaggaggggcgcaaagggagtagcctctggtccttttgttacttgggcgtagaaaggtggggttttcctttttatttagttctaggaagtcagcatgaaacagccttaggttccctgcctccagaccctattctcctgcctcacgcattcccaattttgttttgtgaatgacctatcacattaaaatatttaagtcctgatgctgcccaacgtcccatcaaagtggaagaaagaattggtaaaacgttacccaataccttggtgaaagtcatccagccaggcttggtggctcatgcgtataatcccattattttaggagcccaagttgggcagatcacttcagtccaagagttcgagaccaggctgggcaatatggcaaaatgctatctctacaaaaaatacaaaaaaatttatccaggcacggtggcatgcagtagtcccagctacttgggaggctgaggtgggagaattgcttgagcccaggaggcagaggttgcagtgaggtcacaccactggtctccagcctgggtgacagagtgacactctgtctcaaaaaaacaagagagagagaaagaaaattagtcattttcctttgaagtaactcaccaaaatattcagagaacaggccactcaccataggaatttataccaaaggaaagttgtttagtaaagtactaagtatattactaaaatgtatgccccatactaaaagcatatcataaatacagtgagcaagtatggctctttctcagcataagatcaggccatgccactgttggaggtttggtaatccttggctgggggaagcaatagaaatattgataaacatttttgtttcctataaaagtagtattaaattacattgcaattaaagtagcagtgaatatagtgaactttacttggcctgtatttttactatagcactcttacatcattgtatattttgattgtgttttagagattttcttaacccaatttatagattggcttgtttagtgaacctgtaaaactacacattggtgtcctagggaaatggtcctgctaaaagagcttgcctttcatttcaagcagcaacttctactctagaagagatcagtcaattgccatattttcttttcactcaatagttttgggtgttatagctcatgcaaagtgcctttgtattttggttcactgacttaaggtgctctgtgaattcaacttataaataactaatgtagatcttgttttgtgattgaaatgaggggcaggtctagctgacccttttgattctcaagcccctagtggtatggatgatattcataacccttttcagcctcatcctgcctgtgctctttgaagtaaactattatgtgttgacatccatgacctgttctttgctagctgttcttcagctctaatggactttgcttagtcacagaagatggcacctctcttgaactctgtctcatttcatttcttttcctttccagatatctcttagttttttccccagcatgttctaaatcattttcgaataccctaagtctctaatgtaggagatattcttaatactaaggaattttgctttaaatttggtttaatagtgctttttgcgcttccctcacctcacagtataatagttttaaatgtctctaaatgaatatttggaaaccagtctatcttaacttttattatatttcatatattatttcctaaaaatagatgatcacattttcatctgtatgtataaacaagatgtaattttatgaattaacctattatagaacttgttttttttattttcttcccattctagtttctcatttctgactttcatattagattgtttttattgactgttttaaagtaattataagaatgtaatccaatattttattctgtcacaataaaatatgtaacaatcataattctaagtcaataatgctattttctttatagtgaataacgtaattacatgtctagttcactggaaaatagtcatgaaaatgaggaaatgtatcccagtattttttcattgaccttttaggttactcaaatgtgctgtcatataaaaatctgttgtatatgtggatgcagtacaaataatatgaagcttctgaatctatgaattatatatttttataaatgagttaacccttataccttgattcctttcattgtttaatggaaattaattgattgtggtgaatatcatttttcacttttccgcaaaggttttaagttttattgatttttttgttaaatatgcttgtaatatctaactataaaatatctctagtctcaatttgcaaatctaacaaatggtcagaataattaaaagatatcttgataaatatttcccaccgtaagtagtcaacagttttatcctcacgctagcttcatgtcattcaaactgtctccttttgtctgcaatcagaggagactttgttactgaaaagattcttaaagtgagctgaagcaccatattgatttgtctgtcatagctgttttcttgaagctggttttactttttatcttgctgggctgtttactgtttgaacagtaattttatttctttgttcctgttctgcaagatcttttcctcttttaaactaatgtgctaataagtgtttgatgtgtaagaggaatatttctgttcataagaagtgtaaatctgttttaccaagcaaagaaatatatttaggaatgaaggtcagcataatttcaacaaattgcatggtactgttggagcaaagctccttgtcctttcataccttacaaatgagttcctcttggaggtcacactctaaagtccagaaagcatagactatattagcatctattttcttagtgaaaattaaatctgccaataaatacctgcatctgaatattagagaacagcagcagaaagaaaacatttattgaaattttctaccaggacattctgttcaacatttcacatatttgatagaactctcgggcatcaaaccaactctcagtcccatttgtgttttgtaaaggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaatgtaagtaatgtccttcattttatttctctttaaagaagggagtgattaactatcattgcacgaatgcctatattcaataaattaaccagatagttatgaaggacctgctatgtataaagtgttagaaaatcataagatggataaaaaatggtctctgctttccaccatactgtgttgcagtaggggagacaaacacaaaaatgtctaacaaaaatccaggaccaatttgaaaagtattttatcagagcaaataacactgtgctcttggcttagcttgtgatatattaaagtactgaaatataatatgttgcttttaatgaagaaataattttacttccaaagggagtgcataaactgtcttttcagagaaacatacaaaattagttcatggtttgaatatttgagcaattaagagaggcaaactatagagatgttaaaagcataatttaccatacagtgataaattatgataagatatatgtatctgaagatatatttaatgtcataaaaagtaaaataatatttgcatagtttcacattaattagtaaaaagcagcgatacaaactttccaactaaacacattgctaaatttttatatggagtgatacagaaaaaaattttatttgttagaatattattcataaagaaaggataacaaaatttcccatattccttgagattgccttttatcagaaaacaaacagataataagctgacctataggtaaaagaataaacacatagagaaagttgagaacactatatttcattgactgaggtgacatttgagtggaaacctaaaggaagtgaggaaaagagaaagtgaccttgaaactgtcagagacagagcattctgtggagagaaaatggtcagtgcagagaccttaaattgaatagtcaaggaacaataaggaagccagtgtggctgcaacagagccgagccagagagagaaagtctggctggggatcaggtcagagagttagacacagggcaagttccaatgcagcttggtaagccgccgtagagacttggatttactctgcatcccaaccatttaagacaagtaaggcaaatactattatcccagttttattgatgagtaaacacagaaagtcatatagctaatagacatagtagagtctcttagttcttatgcctatgtgctatctgctgtagaacactgccttttatttcagcactatactgagatagaatcactattgaaacactttgtttttacaaaatgcagttcaaaatgcaggaaggtactgatgcttctgaaaaggctaaagtttgttgtactcaacaaactttgtggacctaactaagataacttcaatagcacactaaatagatttatggatttctatgtaattatgtattcatgtatctattctgtagatagataaatatgaattccattttgagtcttagtaataaaagaaaaggagtttctgcaactcgttggaggttaggtcaccccaatgtggagtatacacaagtttctatctctcaaaaagtctccaagtgttgaaaatttcaatgacttatttcttacattggaaaaaataaaccatgaagggacttttatagaaagacaaattaccaaagtcagctacttggagaaataatgtgaagagactttacagtttgtaaccattacaacatgtaacataagaatctatccttaagtccaatggtaaatcacacatgaggtttaatttcatcttttctttgtgtgtgtgtttgtgtgtgtgtgtgtgtgtaagatgcgacagtcttgaaaaaaggctaaatctgaaaattggactactaaatacaaactagagatattttgaaagaaatgtggtgtgttttattttttagcagcaatcattctttggaactgtgtatcctagagtatctctgttatgctggaaagatatagataagcaataggtagaaatataaattatgggataaaaagattttgtaaggacaatcaagacaaatgatcatttaaaatctattcagcatgttataattgtgttaattttacttacttttgtgaagtggtgtatctttattatattgaggttaaatcaaaaggaaatgtttcatataaagcactggggaaaatcactttaaaagatttatcctaaggattaaatctaagcttggaggtagaatagtcatgtggtttccagcatcaataagatagctccaagggattactgcagagagacaggcaagccataggctataggtgcaaccccagtaagatacttgagtcagggagcttggcaggcctggtttacatggtagaaaacaggggcccctgggcctgctccaagccagccctgcagcagagcttctgtgtagtagtcaatgtcatggtcagtcacatcccagagagtacccagaaacaaggggcagccagccatgatgtacttgagcatgatgccagccccctgttattatagaaagacaacagactgatctattctattcatttcatatagttctataaatttagagctcaagtcacaaaagctaactgttgattagtgttactttagtgaaacattaataaaaatttataattcactggcaagcataactagaatcatgatttaatattctttttaggagcatattggcagattacattatgtatacatatatgtaaataaaatatatatgtgcatgtataaatattcattaatttatagtactttttataattaggttggtttctggaaataacaaaagtttctaactcaaatcacaaatgaaaagtatcagtgaaatttaaaatatactatgttaatattgaaataatttgaataaagatttactaaggtatatagcttgctctttaattaatagctctttccagcatttaatggtttggcaagttcagaagaggaaattaatgttatagcttggataatttgtcatttcttatttcagaatttgtaatatgactgaattctgctaaggagaaaactatataaagaaaatatattaatgtcataatttaccaaaaatgaatactgataagcatttaaaatgaactgctttaaatagattgccactaggcatttctgtcccttttaaaatcaaattgaactaaaactataatcagcttgtcctttcctgacatcatagagtcataaaataaagaaaatgtgacattgcagattagcattttacaaaagagaaaacatgaatatcagtgagctttagctgtagtttcttagtggaaaaattgatgccctctggaaaaaaaaattcgatcaagtcaatttctttaaagaattaatttaaattctaatgtctaacaagaaagactctagtaagtttgaatgcctttggggacctgtcaatgcactttcagtgacagaataggtgacaaactaatataaatgccctgaagcatctaacaggaaattaaagacaattcaattaaagttaaaattgagaatttatccccaatgctaagaaggctttcttatgttgggttcctcccctcaaaagtatgattgaaatacagcgataaagcatcaaccagagaaataatattaatactcagcaacatatcattaaacattcccatccatccattatcctaggcaaagtatattctgctttagagatttttaaagagagaatgtactattggccggaaaggttagagaaggcttaacagaggattttgaactgagtttagatgagccagtagattctgaaagatagaatgagagatacttgctttctgggagacaagatctgggtggagaagaacagaggctttcctgtcagattgcctggagtggagtctgttccatagtatactaccatcgtggccttggggaaatcctttaacccctatatacctctaatttctacctggaaattgaaaataatatactgtgtatccaatagttattgtaagaattgaattacttatgtatataaaatgcttaggcacatagtaatgttcaatgaggttaattattgctactactataattattatagcagttaagagtattaaatatgaaattgctgaacctagaatccaatagtgcctcagccatttattatgtgtgttttgcagcaaggtacttgcttgctgtgccttagtttcctcatctataaaatgggaatgataatcttactgccttctctgtagagttctgaggattgaatgagccagcacatgtagagctcttagaacagtgtcggctaatataaaagccttaatagataatactgtgacagtaaaaataataactattattatctgaagtgaagatttactgctaggaatgtcagttaataaactgaggacattattattaaacaagatataaaaatgggtaaaaggataatgaaaaactgtgcagagtattgaagggttcagatttcatgcagggccaagataaaaaaattctcagcaaagtgctacctgctcaaaatgatattttaggacatctatatgatgggtggcattagttggcgagggctgccataacaaagtaccacagttcgggtggcttaaacaacagaaatttattttatcacaatgatggaggctgaaagttggagatcaaagtgtcagaaggcttggttccttctgatggctgtgaggtaaggatctgtgtcagtcctctctccttgactggtagatgaccatcttctccccatgtcttcacactgttttctctctttgtgtgtcttgtctaataaatttcctcttgttataaggacaagtttagacccctctatgttacaagggcatcacctgtcctctaacttcaggccagttgttcgtttttttattatgggacttacacttttctgcttcatgttatagttatttgtatgcacatctaatctttctattttcaattacaaattcattcaagttaattatgctttgcacagattatactcttaaacatttgtgaaatgtgacatcactactatttttgctttttgcattttactttttgtcatacattttatatttgactttgaaccaaatctttagaaatgctacagttcagagaaaattagttacagaatatgttgcatcagtcggtgaaacaaggggacaaattctggcctacactccagggtctaaaagaaatcagtatgacgtgtattttcaagctatgtgatttgagatctgctacttctgttacttagaagactgtttttgcttgctgaaatctaaagtatcttttcagtcataactcaaaaactcattcttttgtgactattttcacaatcagttatcatcaaaactaatttatcttttttctttgcccacatagctgatacaagttcaattaatcagcacctaacacagacaggtactaattttccattgacgaaatagacatgagccctgaggaactatttcatagacaaaatagacatgatctttcattttcaggcacttatatctggtcgggggcaggggggaccagaaaatttaaaaatgtgagataatttcaatatcaggtgacagaacatttttactatttctcttttttttgtattttatatgcataataataaattagttacatgtttcttgtctgtcactagttatagagtccatgagaccagggaggcagttcaccatgatgggcagtggggggtaggagggtgggacctatatacccatggctttggagtcaggcagcccactctaaacttgaattgttgcctattggctaaagcaatctttttaaagaacacttaaaaaatttttttagaaatagagtatcactctgtcacccaggctggaatgcagtggcatgtaacctcaaactcctgcactcaagctatcctcccacctcagcctcctgaagaaccaggaatacaggtgcataccaccatgcctggctaatttccttattttttgtggagttagggatctcagcatgttgcccaggctgatcgtaaactcctggctcaagcaactctcctgcctcagcctcctaaagcactgggattagaggctgaacaactatgcccagcctgctaagcaatcttaattaaacacattacttaacttctctaatattcactattcaaatccaaaagtaagtttaacaattctgatttgcatattgggaataaattaaatgatacacttgcagcttctaatgaaatgcaagatgaacagatgcatatagtaggcatttaatgaatacttactgaataaaatccactcattctccatttcattttctttctaaaaaatatagaaagaatgggtatagatgtatgtaggcataagtattatgaatacatatatatgcatatatatgtaattccctgttctaggaaatttcatctatggggtgggtgataaccagttgctgcaatttattttagcaaaatactttaaagtttgacttttgaaaactattttctagactagcaaattagccttttcatattaaattagcttcaaaaattgtattatgtattatgttacaagggtatcacctgtcctataacttcaggccagttgttcattttcttattataggatatttatatatatatataaagaaagggacagatgggagcagagcggaggcgttgaagtgatcatgataaagagttccaggaaccttccttttctttttctgaatattattgaattaagcacagtgattccttgatcatatttttcacatcaactgaagctgcatggcacaataaaaaatatagaattgaaagtaagaaaatctaggtttgagcctaaactcttacctgtgcatatcacatgactttgggaaaatcatgtacatcatcagattctcagattctttattgttgaaatactgtatttaaaactgatttataaattaagtgatatgcaaattttatttatttctttgttttggacattcaaataatgtataatggctggggaaaataaataacaaattaatgtgatttactgtcaaagtccacatgattataaacatttttcagttttctaaatagttgataggaagcatggtattggtaagggaggttatatctagagcagggtttcaatagtttggcatgatcggcatttggggtcagataattctgtgatgcggtgtgggctatcttgtgcactgtaggatgttgagcagactaaatcctcactagaagccagtaggaccaccccctccaagtcataacaaggaaaaatgtctccagacacagcagaatctctcctgcagagcaaaatcaccatgttaagaaccacggatctagacagttagctgaaacttctttatttaccctgaatagacttgacccaaagatgattaaaataaattgaaatatttttggccacataagtcagaaatgcacagatttttatatagacagatgatatcatcccgtgtgcctaatattctttttggattatatcttatgtcacagcagaaggcacaatcattttgtcaactgtatcagaatgtaataacatttatcaccaaatcaatgaactctatagagagagcagatctgaaatgacttaatgtgacttatttttaaaaacaaagatactacagtgatagtgatgcaacctgacttctatttctctagtgttcttcttgcctaaaaataagctaaagtaatttgtcctaggaactttgtaatttttttaatttatcattttgctgatttttgtttggtaattctaaattcaagccctataatcactcatagaaaaataagttgtcctcaacaagacaaccagagatttttattatgacagtatgtttgcttttgtgtataatttttttttttttttgagtcagagtctcactttgtcacccaggctggtgtgcagtggtgcgatcttggctcggtgcaatctctgtctcctgggttcaagcaattctctgcctcagcctcccaagtagctgggattacaggtgcgtgccaccatgcccagctaatttttgtatttttagtagagacggggttttaccatgtttgtgtataatttttgacaagttttttttgtggtaaaatttatctagagaaaaagagcaaaagatatttttcctgtgaagatagtattaccaatgtcttctaaaatatctgtaatgtatatatatatatatatatatatgctcaactactagagaatagtaagcaaaaatagggatttaatataattcactgtgcaggagagaagttgttaacaggaggggaaaaagtagaaaacaaaagcagaagagagctagaaagagcagtacatgagagatagaggaggttcatcccaggcattccatctagaaaccacatgtaatagcacaaaaccgtaccccatatatagatagtgactctgcatgaagaaaagtagaaagtggactaaggccaattggactaggtaaggggcaagccttttcccaaggacagcactgagatattgaagtgtgatgaggaaacgacttctacaactgctcaagaggcagccaagactatttgtagagcctgctttgcaggacctagatgagcatttgctgcccccccattctaagagggaactgagcagcctgcatagggttagaggctcactttaacatttcctggtagggtccaggaaagaactgacaggatttccgtgttacatttcaacattgtttcttgagtaacattaacttattagacccaaattccataataatccagctgagatctgaaagatgttctttcagtgctagacctgagtctagacttaaatgaaaccttggctccctggagacttctaagttccagccagatgagtctatattgttttctaatgtagtttcaataaagtggagtagtagtggtttattggcttgttttttaaggcaatacataaattaaaattagtcaactgcattcctgggctaaggagtagctctagttgctaagaaatatattctgttagttttcagctatagtcctatttatttctcctgcattgaaatctaatgttataagataaaatattttctattaaatttgatacgtttaagtaaaactacatatgccttcatcaaaggaatgagtaccactcttcaaagcaaaatcaatttgcaattgtgacagatgatgtttttcaaatttagctgcaattccacaatggtactttgatgtctttgaagtaattgacatgaggagtgattctctattttaccctgttctactttcagtttagtcattcctcagagggatactctagagggcccatgcttcttgcagtttttattttgcaaactactttgcattgtaaataaaagtctgctttaaaaaaaatctgatttgacaatgggaaaagttttctcatttttatacaaaaatctgttcttcccttaagatttagtgtttatgatccataacatatcatgtatattatatcatttatcttaatcgacaaatagttctattttaagcaaacataaattgcattttgtttttgtttttttattttttcaaaaaagtctgaagactaaagaatcaagttaaacactctaatttcctcagaaatttctggggaatatctagtctgagattattagaaaccagaaggaaaagagacagaagataaatagactggaaacaaataagtatccaagatcttgaaacttggctcttgaatgaggtgtgaatactgccagtccacctaataaaagctcggaggcagatatagctgttccattgtaatggctttaaaatctttcatctctgattgttgtggattcaaaatatttctaaattccattatccatttgcatacccttcagtcaaaagatttaggattaaatgctcgtgtcactgagaatccccatttgtaactggcataatcattcagtattccaggatcactagaagtaatgagaagttgataaaattgaaatggttttcagaaaaataaggacagtgcagtaaattttttacaaatataaacatatttcatttaaagaattgtcttcgaaatatgagattgttctttccttaagcctttttcccttataaaataattactgtagtcaatagtaggctatttattgttgtttttaacatccatacttggcaaaatgaaaaattgtcatcttatgttagtccccagttgttttctttgaaactgtactaaactctaaaaatctagaatgggaactactactattgaaattatcagtgagaacttctgtgattttcctttccatcaagcccagggcttagagggaggcatgtacaactcactgccttagttttatttaggaaaactgaagcttcatagcagctttgagtgagctggaaagagttttctcacatctaagacattttctttaaaggataaattgtatatcctggtttccatcaatcttcaaggagctggattaaaatatcattgactgctgaaatacatattacaacatagttcctcaaagtagtatctggcatgatttaattattgcttcatctgaatccctctcacattgaagatttactctattttgtaaaatttagcatcattgggttattttaaaaaatatttcttaattccgttatccatttccataaccttcagtcaaaagatttaggattaaacgctcatgtcactgagaatccgtatttgtaattggcaaaatcatccagtattccaggatcactagaagtaatgtgaagttgataaaattgaaaaatgtcctatgtgatttgacacagacttgagaaaatacggggtccctgtgagttcggtcctaggtgagttatggtgcatttgatgctctgttgttttcttccttctttctactttccagtgaaatcagatgagttacagaccatcaagaaagaattaacccagatcaaaactaaaattgactccttgctagggcgcctggagaagattgagaaacagcagaaggcggaggcaggtaagtgatctctgatcacagacaggtcagaattgaaccagtgaaacgttgtcaatcacagaagcagtacagggccaggaagacactggctgagtttaacagtgtttaatacagatgtgccaacaatgtctttaagcccagagttgcaataataaaatgtgattttttttcttttagagaacatgaactaatttttctaaggttcatactaaaaataaaaggcaaggacaagtgttttggtggaataatcagtagtagttgagtcacagttgaaactttatctcaatatcaagtaacctttcagaaaataaaatcaattaacagaataatgctatcaggctaacataatattcatatataattaaattaactgcagcaaaatttgacaggtttcaacaattattataatgcccaactcctgcctttgctgccaccctgaaagacttcagtacccaagttcaggaacatcaagactaagaccatgcacctggctacccacaggccaagttatttgatcatatattttacaatttaatagcctctgtcttttgaattatcagccctgacccagctcctttctagtaccagtctaatgctcttttcatatggctacagatattttttgagtcacaagtatatgagacctggtataaacttagaagtaggccacagtttgaaaagtgtgctctatgaggctttagacgcctcagaagcctccttggagttaagatggggattaggaagagacccggtaggtagacagacttatgcctcttcgaatcccagcccttcctctgaccagtgtaacttccctgtatctgttctagatactggcattcaacataagacttaatttgctggaagagttccatttcttataaaataaataaataaataaagtgtgaaagcccttgataaatccaacctcttcattttgcagatgagaaaacaaaggctcaggaaagtaaatcgattttcctagacctgtatatctaattagtgatagacctcggtctcaaactcagggcttgtaactgaatttagtgccctttcccatttacagccccaatctcaggttctcctcagagctttgtcccaggatttcactaaagtaaggctatctgggtgacacctaaatgatgagaactcatggggacctagggcccctgagctaccacacacaggagcctgtcagtttgttgactcatatcactggggtgagggttggagcgtacccttggcagtgagccatacagggctcaagaatgaaaagaagcacatgtgaggtggtagtgtagcataatggatgagagaaataaactctggttcaaatcgctgtataccacattcacagttttctcatttataaaatgatactgatggctgcctcacatggtgagtaatgaacaaagtggcatatgtaaactatatagcacagagttaaaaatataataattggagttatcaaggactagtagcaacacacccatgtacaggcaaatggacatttcctccgactttcatacggctcatttttaaaaaacataagccatgtacctagcacatggtcaactcacactaacccttgttaaggtagatgaggaatgatagactaaatggaatctttcttaattaaagatttctattacaaatgtattatttccaattcagaaaggcatacttgcctatactttttaataaaaaaaatagattttagaaagtttttaacatgctgtctatggcactgaaatgttactgtaactgaaatattctgtcatgttgcctaaatcaatatttccctttgaggaactctgtaaaattcattattatgtaaaacaacccttacagcaaaggactttgataaccaatttgcacttcagtttaaaggattatggagaactcatttaaatatggagaactcatttaaatataaatcacctcaaagagaaaaatgtggtccttattccatcataatatacctttcagtttgctgcaatgactaataccttccatatatctttttggaagatcatttagaaatgtaacactaaaattcaaagcttgcatctttttttcatgagatgtcacttacttttgaacatgtttaaacttttacagtcatgagacagttgcttttaaaataataagacttagtcctttgatatttatgtctctttaactttttatgaagaaaatgaatttgtaactccattcttttagtaattgtttcctgaatagtgtatttatagaaataaaagataaatgttttatatattttactatattttcttcacgaaaaaaatcaggtttgcttggaaagaattaacactaccttatggaaagtagagtgaaatgcactaaaactcattttaaaatgctcagtggctccttattcaaggggacagtcattacaatgcttaattagttgaaagctaattacttacttggtagctagcatttactcttcattattactctttcataaatttctcactcctaatttactattagttatttatttaatagtgaaattttccagcagagaaataatggcaggaaggagatggagaatctgaaagtgtggggaaggacacacaacatgggctgtgcctgaggtcaagttccatagtatcttttttttggaagcgaactcctaagctctcagtacattactttggattttctataccttaaattgctcaaatagatgtgtgtgtggtgtcctgtcatttgagattgttaagttcctcagaacaagatcatgtcttctcttccctaactctacccaacaccaggtattatgtactgggcacaacttagcaagtcatttaactctcttaggtctcaagtctttcaaatgtaaactagaggaatgggttatggcctcaaatgtatattctggcttctaaaactatgattactgtgaatccaccatgcatgtattattttttccattacatcacacaacttctttggggatatagtgactatgtagattatagaaaaccacaagtaacacttaaaatcagttcggccagcaattttgcctcattgttagatgattcttttaaaagagccgcatataagttgccacatatgcatagcacaaattacatgctttacgcaaagatgttaagtgaacaaaaacagtgaaaagcacaagaaggaaaagtaaaaagactggatagcatgcaatgggaacagttactccatgggtaactacattttttaaaaaattacatttcaagtgcagactttctgaagtgaaaaggcaattattagacattatttagttcaattttattctcactgttattcctgatacatgagcagccaagtctgactgggacaattccagtgataacattgggatgttagacttacgtcttagagaggttacaagcaggagtcccacaagataaattcatcctacccatatgtttggtataagagatgaagttttcaaaaataaattaatgtccaaaaattggagtattgtaaacaaatctcaaaatatgagctcttttgaaaatattgaacttttcaatactgctactcaatcactctacacatggcatgcacttttcagtttgctaatatctttatccagccagttcatgtatttatattatctatttggtccctgttcacattcatgtctgagactcccattgcaggttttccttacactgagctaaaatgtattttgctttcacttggttcagttatcactcttatgttctctgaaaagaaacttaatgtctaattctttgtgatacaacagtcaattaagaatttaaagggagtggccggccgcggtggctcacacctgtaatcctagcactttgggaggctgaggcaagtggatcacttgaggttaggagttcgagaccagcctggccaacatggtgaaaccctgtctctacgaaaaatacaaaaattagccggatgtggtggcacatgcctgtaatcccagctactcaggagtctgaggcaggagaattgcttgaacccaggaggtggaagttgcagtgaactgagatcacgccactgcacttcaacctgggcgacagcgagattccatctcaaaacaaataaatatatatatatatatatacacatatacgcacacacatatatatttaaagggagctatagtattctcacccctccaaaacctttgaacagagagttgatatcattggcctatgggtattcatcttaactgcattcaaattttgatcacagcatcgtagaggcctttttggtctagagaaatatcaacagttcctttagttgcttctcatttaacttggttttgcaccttaaactattgccatctctcttctctagtcattatgtagtttgtcaacacagattacgttgctcagaatggaaagtgttgctccagatatgatctgactgctgtagcctataacatgactaccatttctgttctgaataccttactgctctcattgacacttcagattgaattggtgatgcttccggttaaagatgatgaattaaacacatgaattgagcagtgttttctcttgaagctgcattaaaaacaaggaaagggtttagcagctggacaggaggtatacctaatttagcacatcctagaaatccaagtccaattttaatcacaaactcccaaaaagctcagaattcaaggcatcatattcccctggaaaataaatggttgaaagtctgtttaggaaacagattcctatgtcccagctatcccaactgcactttgaaagaaggctggagaagtttcctctagtgaaggtaaaacagtgggtctcagggctggtagacaataaggaaacttgagagcacttaaaagcagagagggagaaagtttccgtaattactgtagaaatgcccaccttctccctgactcagctaccacagcactggcaggacactagaagagtcttcagttgagaacatgagcagcccaagaggaaagacttaaagatgctgatagagggtcaactaaggaatcactcagccagaccacctacagagacagtatctctctatacttacaaagttgccagtcaatattttaatgccctactgttaatgtgaacaaacaagaatcaccagatcaaagaacatagttaataagcaaatgccaaaaaaaaaagaagtcagaggaaacaaacatatacaggaagaataaaacttcaaaaagaaaaaaaaaacactaataccctcagagaaatgagaagatactgtaataaaaacataaaattatagaactgagtattcaaagcgctgataaaagagcttttataaattaacatatgatagcacaaataaataactcaatacaatgattggaagacaaaattggaaaaactctcccagaaaatatggaaaaaaaaacagaaatggaaaataggggaaggatatgagaattacacgatgaatatctgaataagctttagtttcagttttcctaggtcatctgtattcattctgagttgggtttcagtttacctatgtgggaacccaaggcacgggaaccatctcagcctaatggccttccaattaactgttttaatatgccctttctctgaaaagtactaaaaagagtacttcaccaaaaacacagcgataaaccaagaaagaggaaaaacagagccttcctaaagcatggactctaaaagcaaaaaacaaaaggaattctcaagatagaggtaacagagatcctaggagatgagctgtgcaagagatctggaaagaaatgagtccagatcagaactgctcaaaagctctgggatagactttttaagacatcaaaattgatgaaatagctactgggtgggaaagaggattggttgagaaggaggggtaagtttgcataagtacgtaaagagaagcacatagagaacgaatttttaaaacttgaggcaatttttaattctagagaaaataaaatattcttcaggaaagaaaaagtattcatcctgtactaacaacttagctgcacaaagtactttcaccataaaaattgtgtaaaaactgaaaatttattaaatccaatttacaatatgattctctagagagatgggaagtgaatggggattataggaccaagaactgaatcctcagcttcctagggataatgtcaacagatagtgcataaaactgatcgagaagtagcaatataaacaatatttagagataggagtgcatgtatttaaaagattcagccaagtgagtggaaagcctttaaggagctggaaatggtgaacaggtaggaacaaaacgctgctgttttccatagcaagcttgtagaaatatttgagtacaaaaattaaatattttaaagaagttaaatataagggggtgaaaagacattgagttgtccttagcaactagatcaaacctttcaactgcttactggagtgcttcctgtagtgcttcctcagttaactgtaaaggcaagattgccctggacacttactaaaagcagcaaggaaggctttgttcaagactattgcaataggagataaaattgaactcaactctgcaaaaataaaaggcagaataattttttgaattctagaatgagctaaaggcaggcagattcttgaatgctggagcaagctaatggaaaagtattgggggatgttggaggaggatatttggccaccatctgtgtttgctaattagctcttattaaagttaggctgctactctcccaaggagactggaagacaatggctctatcttattcaatgataacatgtcaaagagatagctcctgaatcttaagaaaaatattcctgggttacagaaaatttgcctctcaaatgggcagagaaagaatttacaattgcaagtttgctaaagcaaacactctaaggaaaggatgctccagggcctatggtcaggaagaaacctacctgtagtttagtcaagccaaggggaatattgaagccatcttgtgaataactcaatcacagtctttcaaaattgaattctttctcctcactttcctacctagatatactcctctgtaccctatctctgtcatcactattacataaatcctgtccatcaaattgccagtctcaacattatcctctattcctaccatagcagtgttgccaaatcttaccttgggtatatttttcaccccttccctctattttcctaaagatacgccaatacccaaaccctcatcatctctcacatgttctgttgcattcatcttattttttacaccaatttattgaggtacagtttacatagaataaaatttactcatttcaagagtacaattcaatgacttagtgattttaccaagtgatacaaccatcaccacaaatcagttaggacattttcatccccctaaaaatcaccttttagttggtctccacttctggtttgcttcctcccgaattcaccttccttgtggaaaacagatttacattatctaaggtcccagacaggaataaaacaaaactaggttcacatcccactagagacctagtttaacttactagctgaatgaaatttggaaaagtccttataaaacctattaaatggttttataaggattatataatatctctactaaaaccattattagatttaaataaacacaattatataccagtaatttttaaatgatttatgttgcatttgtgtcatctcaacaatctagggtatttcatgtgaacaactttgaagccatttcctccaaaaatgtactcacataactaatatattcatctaaaacattctatgtaattttcctgatgttcatttatgtggctgatagtaataccatccaaaataagttgtatttttctaaatggaatttattggaaccattgagttaaattaatactatatacaggtgttgtaatataaaatttttcttaaaatacagtttatgcttgtatgcaaaaacaatgattcaaggatactaacttggctctagtgaataatgtgactgtttttgtatcaacattctttccaaccatctgctaagtacaattcagctagcaattatctagcaattaagccagcatgtcaaaaaacttaattgccaactcaaccaattttcatagttatattaatgataatagctatgcagcaaactcaatttaataaaaacactttgaacataaatcccaacaattctaacttgttttctgaatcgtagatagctttttgaagtagagatgagatgtgcagaaaaaatatttgaatatgaggattggaatttaatattaaattcttttctttcatggttttttaaagctttaggcattttcccttaaacagaaatacttacctgtaatttgtacttcttttcctttgatagtcattgtttagctaactagaacatgtgcccctaactaaacagacttcttcattcttgaacttaaaattggttattgaagagatttgaagtattcccttggtatgtcaaattaggccttctttttttagagatatattagaaaacagccaaggttataagatcagaaatttaaacttggaattccagctcttgcacttattactgtgtgaccatgagcacttatttgtgcctcagtttccccatgtgtaaaatgataaataagcctacattgcagtatatttcaaggactaaagttaatgaatcttacatggtcagcacttcataagcacacactaacttgtagccattataaaccgtttctttttgtaatccataatgtaggtgtcttagaggtgtctttttacataagctgttggctttttggcttctaatcgacctttaaaaaaaatctaatactcatttctcttttcacaaaagaaatgctatggtcatccatcactctgacttaaagaagccaacagacactccaaaagatgccagtgttcgaaggcagccctcctccaataagcactggaagacttcacatttcatttttctcttgaagacttgtcaatataaacacaaacaattttcttcccagaaaatttcagacctcacattttactttgactttgtggtttgggattgtcatgtagaatgtggcaacgaggtttttcagttttgtttctttttaagttatcttggatttatatttttgttaccatggtgtgcaaaattcaactgtcactttaactgaaaagaatttgacacatttgatatttattttaattagttgattccacaattcattaatatattcagcaaacacttaacttgtgattaagggtctgagttagccaccaggtaaacaaagatgaataataaaaatgtttctgacccaaagaagctttagcagcagagagagaaatgcacatacacacaaacacacatacacactcacacaatcacattgacagtaaaaagagtgatgactagaagaataactatgcaaataaagagaattgtataaagaacgaactaaacgttactcatctccaagaaaagtaaaattagataattattcataaaaaaagaacaagttgctttatctctacttcagcaatgtaattactgaatcaaaactgcctattaaactgtgaaccaacagtttaataaagaagatgtgctttcatgtgtgattttattcatggaacctatcattgtttagtgattataatatttcccattgagatgatgacaaaagctatgttgactacctattactaacacacaggctgattgtatttgttaaactcctgtgactcaataccattataattaaagcttttttttccctcaactcagataatgacttccaagcatttagctttcaagttaatgattggatgatgagaataatatataggattttttgcaatgaactgtattaatataccactgcctttgaaatacatcgtcagaatcacatgtatattgtatgttaatacaaaaaatagagtaactatgtctatgtactatatactgtattagtttgttctcatgctgctaataaagacatacccaagactgggtaacttaaaaagaaaaagaggtttaatgaactcacagttccatgtggctggggaggcctcacagtcatagcagaaagtgaaaggcacatcttatatggcagcaggcaagagagaatgagagccaggagaaacgggaaaccccttataaaaccatcagatcttgtgagacttatttactataatgggggaaaccacccccatcattcaattatctcccactgggttcttccaacaacacatgggtattatgggagctacaattcaagatgagatttgggtggggacacagacaaaccatatcagtactggactatgcctgtctaaacatagaactaaaaaggctgtgttgaaaccaaaacccaagataatctttataatgcctgattcttaatgatcagtaggggcgaataattttgacatgggaaatttgtctatagcaatcaagaaataaatatagattcaactcaagaactgttttgagcctgttataacatgtttgtgtggtctttgcagtttaaaaaacacagtcacatctttttcttcgttagagcacacagcaactctgaaatagatgttattttcatgcttaccttttagagaagaaaattacaattaataggactagtaattagcagaagtatggatctcaaaccctatatccttcctgataccttatctcttcatgtgcaaggcattcagtgaggggtacggagcacatcaaaatgttttgataactgacttgaattgtgcctttcagtttactaaagatcgacctctgtatcatcctttttgagtgtgacaacgatcttctgaggcaatagctcaactttccaggaagcttaaacactaatgagaagaagatgagaaaacagtagaactaactataagacagcatttgatcagggccttggttgatcaaagagggaaagattacattcagctgggaagatcaggaaagtcagctttcctgatacaagctgaaacaaattgatacatgaagccagatgaggactatgcatgtttaaagtgtggtcctacaggggtcctttgaaaatctgctatgcttccttggccagagatcttctagagaaaaaattatatatacatatacacacaaacacacacacacatatacacacacatatatgtatatatattacacacacacacatatgtatatgttactttcaacatcaaaaagtaagagttctcaaagagcaaatatttctggaatcattagagaagaaatggatatactaggccaattgaattcctaatatatgtcaatcttaagcaaaagtccatttatgtgttgtaacaaaaagataaacacaatgacctgacattgagaatgtttgggtttaaaaaatttataagattcaaagcatttttcactgtacagaattataagaatcccaaatttctatttctctctctttcttcaggtaccaacactaggtcttgaaagctagggcattttgaacaagcggcagggtgacatagagtggcaagaagtgagcggtttagatgatgtgtacaaaaacttcttttaggaggaagagtggggggccaaaaccagagtagccacctccattgtgcagtcaaaggatcagtgataggagaggcaacagaatagaacaagagatgtgattaatggtaaaggattcaaaactgtccaatgctcgagctagtcaacttatcacatcattttctcagtggagcctactaatagatgtgtatgtgggttaacctaggttacagatctagaactgtagagcacaatgaatgatatgtggaaggaaaatgagaataaaacctagaaatcttcagtaagagtaaaattgagagtgttttggtctttcttgccttatttaacttcctttgaattcaaacaactgagtcttctctagattaaacagatttttttctttaactcagttttaccttcttaaattggataataattttctatatttagaaaaaatcttggttacattttacaataaccactttatagtcttcataggactttctgtgctaaatgttatatagacattaggaaaaatgggaagaatttatgtactatacttccttccatcagtacatctgtatatgcatatcaagataaaaagtatagttttaaaagcagaattcacatccttactgcacaaataatgttgttaaatggagaaatttgaacctaataagttgattttaaaaacatcaaggcgtgtatagcttgtgtctatttatatgaagtaaatgtctttctcttaatgaaaaagagcctatgttttggtcatttatgatacccgtagtaattatttccagccttggtttgatctaccagctctttttctcctctgaaacacagcctcagccccatgagtgttgttctgtgatctcaacaggcctcttgatctaagtttactgttgttgttattcagtgaagagcataccgtctaccttttgtatataatagaacacatttatgtagtcctttataatttgcaaaacatttcccaaatataagctctgctaattctcacagtaaaacccagaggtaggtatagatgaggaaagaatgacttaatgtgcttaaaggacctgccccgaacaaatggccaaaacttagactcaaactcagtgtctataattctgtgggtaagtaacaaagctagagctagaatcttgtcaactagagctcagagtaactaaactctgacaacagaggcaaggcacggcaaccctttactactgtcttattttcaataaactttatcatttggagaattaaaatgcaagaaagtatagatacacatttatttataaaagtaattattattttaattataagcaatttcttggaaagaatatctgcttatttgcttatttgtacattatatttatatcagtttgttgatttatatattagttatgtttggaaagtttggtgctgagacaaaatgtttatatcaatgctcattttccttttatctcacgttatgaaaaagaccagaaatgaataccctaaagttatttagctctataaactacctttattgtcataaattatcaataaataagataaaaaattaggctatttaaaaactcagatcaaaggatagattaatcatctgataaaaaataacccagcaaaattagtgaaaacaaccaacttttgaatagtcatgaacacatgggaataagttagagaaggaggaacatacaatgatctaatttatcggatacccaacatttctttgtattatcataggggatgaataccacccactagaggaaataattacgatgctgtcagcacaatttccatttgagcaggtttctgtatatggaatgcacagatcctgacaactagaggaaattctagtaatgtggagtgtagcttcatttgttgagcacttattatttgcaagtctctatactaacactttgattcactataccaaaccctgaaagtttaggaaatagttgtccttattgcatggatgagaaaactgagacacatggagggttaatcatttccactttgcacagcatcacaaagctattaggtgatgaagctcaactttgaacccaggttgtctgaccccagaatttatgttcttaaccattgaagttaaccacatctgtcaacataatttagactttaaaatttccggcaattattcacacagacatgttgtctgaaaaacaacatatttgcttttgtacttttttcctcagtgagtttttgtctttttcacttaggtttgaacttgtcaatgaattttctcaatcctgcttccttgagtgaaaaagttctatgttgtatctgatttttgccatttgtttttgctctatttttcctctcagaaagaccatccttattagaaagcactatatataaaataaagtagccagaaagatcaatctgtttatgtaaatcttactaatttatgtactactaccatctggattccctaatttttgctaattctgttaaataaatatgcttacatgtaagtgcacatagaaatctgtacatgatttacatgattgaaaaaattcaacttaaagcataatattaccttaccttctgtacacctttaatagcatatagcgtttaccctttcatggactgttttttcatggtttatccaaatggctcatgagcaacccaaggtagtagtcatttgctttctcccccccccagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctggtaggaaagaaacatttggtattcacaccctttgggtaacaacactagcatgttagcaactcattcattctaaaataaggattaaatcatttggggcttatttctcttatatgcatatatttaagggaacatgagtatagtgctttgcacataataagtgctcaatactttattgctaacttaaaataggaaagtctaaatgaaggagcaaaataaatatcatgtaagagattaggtatatttaaagtccaaagtgaaagattctctccaaaatgctccattgcaaaaggaaccttgcatttatgcaattacaagtgaactatatgtggatataatatcctggtaacaaactacaatatactggaagatacctggtttactaactgatgataattatttatactatttgtatggccaacagtcttgtctacagtgtgctccctaagatgacactttggtagatggccagttcatcattttcaatgcctgtactgcctgataatcagttattatgagttgggaatttggctaagacctgcttctttacaagttgtattttcctaatattgtaatcattatactgctcatttccagatgtcctttcctgcataaccacatcacggacttggtaaatgtatgctgatgaggatgttatttctcatattttatcaagcatgaaattaaatatactatctcaaaggacttaactaataaaaatgatatgcgggcaaatgtgggtatatatgtcgccaacttccaaatatctatggactgatcatgttaaatttggcttatcccaggtaaaaatcaggttccagtttaatactgtacctttagttacttaactcattttgtcatggtgcttgttttatcaatagtttccaagacagctgaattgcatagattctatattaacttttaacatgccagctctgttaaaatttatggcacctttattattttttgtttatttattgaattaattatttttgagacagagtctcactctgtcccccaggctggagtgcagtagcatgatctcagctcactgcaacctccgcccccctggttcaagcgattctcctgcctcagcctcccgagtagctgggattgcaggcacctgccaccacatccagctaatttttgtaattttaatatagatgcggtttcaccatgttggccaggctggtctcaaactcctgacctcaagtgatctgcccacctcggcctcccaaagagctgggattacatgtgtgaaccactgtgcccagccagcaccttcatttaaacttttcaaatatgaacttttaacaaccacccctatttccatgaaagtctgtatcagtttgcagaacacaagcacctgttcttagactgacattgatttcaggaatctattgattaaggattaaagaacaaacaaatgtcccagcttctccttaggcaggactacatgattcagcaggactaattcgacaacatgatttcttcaactcattctaatcagatctctgctgtcaggattccattgtgactacactccttgagctctctggaggcctccatgctgccatttacaatggttacttctctgttcttattttaatttacttctcagcagaatttttcataagctgaccacttccttcttctgagaaattctcctaatttaccacttgctcattatcagtttcctgtactagaaattttccctccatgctcccactttaaatattgggtagctcagggttttgtcttaggccatcttctctttctacaccctgtcccaagatgtcttcatcaaatactagagcgttaaatattatctataggccaagattcctaaattcacatttctatccctgatctcttcatgggactctagagtcaaatgtttagttgcctatcaccacatagctctccaataaacaattgaaacttaacatggccagaaacagtcttgatttttttctagtcattttgcactttcccaggcttcctcattctggtaaacagcatcgccattcacatagttattaaaaccaaagactaagatcatccttggcccccacctttatccttgttaatgctacttccaactcacacccccaaagttagttacaactccacaacaagtaccatgacccaagccacgatccctgctcttcagattttccataatatctaaactggttttcttgcttcaactcttgcctcatgcaacccattctccacagaagaagggtaaatatctttataaactatctgtcagataatgccatttccttgcttaaaaccctacaatgtttttcatcacacacagagtcaaaatcccaaagagtgtgaatgttaagttgtgatgagattaggtgaaggatgccagtagagagagagaacttggtgaagagaaagagaaaagatccccaatgctgaaaggaaagggatctagaccacaagtatacatacctgaagactcatccactgcaagtgactgtgattagtctaaggatgttgtggcaggagtttgagggagttcaagcacaaactaagataagtcagagagtgataacctctggggaatgaggagagatgggcactatcacagatttgaggggaatgaaaaagatttgaaaaggctcctatggaaaacactaaagattactaatttaaaaaacatataaagattggcagtgttagtagccagttaaggttaaagatcaagaattaatagagtagtattttgcaaactttaagatgtatcagaactacttagagaactttgtaaaaacgcagattcttgtgtcccattctgagagattctgattcagtatgctgaagggggctctaggaatttgtatttgtaacatgttcctaaattatactgatgctgctggtctgggatcacactttgagaactactgttatcacgttatcaatctgccttttctccattggcttttatcagcccttatggaagcatgaagaaagcaaacatgttcaaagttgcatttttgtcagatagtgcaaaaaaaaaacaataaataaaaggagttaggatattagtaaaaaaataaataaataagagtggctgactagatgggtcatggaatctaaccaacagggaaggaaaggaacacggttgtggggggcagtttaaaaatgagaaaataaaggcacaaagggaacaaaaagcccctacatataccattaaggactagagaaagaggaactaaatgaataaaagaaaaacaaagtctgtacttagggaccgagatatttcagaggtggacagtttaagagatgatgagatgttctatgggagggagtgatagaagtgggatcagtgcgaaagtcacagcagatgaagaatctaaggaatgaggggctcagatgcaagatgagtcatctacatgggcatgaagtcactccaaatattggatgagagggtgaaagagtaagacagttatggaaaggctgacaagaaagggagggcatggccaatttcagtcccagatctgtcattatcagtccaattgaactacctaaccaaataacttctctgagtctctcttgactttctttttttacaaaataggcaagatcagaaatttcaaaaaccattctgtttcagttttactctggatgcatgtttcctaggagcaatatgtctgaaagagcaaggcttaaccatacagtcatggcaataaatccaaaccatggtatctggactatactctaaacacacagaaaatagctgattagaactgagcacctgcctggaggtactcatcaggttttctccctcaaccctggtattatcattggaggcttagggaactagagataaatcctatctctattatatcattttgtttctaagacttggaaaataataaatgaggaagggtttaacactcagtccttgcaatccggattgaaactaaggagtctctcctagtgattggccaagagaaaattccctagtctggtgttcactgttatctcctttccaggctactgaaccaaaccatccttggttcccaaaaagtgaaataaaagcacaaatattttctttttaggtaataaagggcatcatagatttgaacagcaaagatacaatataattagagtttttctcacaaagaagagctggtatccacatgcccatttggctgctcaaggcaaatccagaatgctcttgaaaaagaatgaacaggaaataagaattggatctgaagtgaaggaaattcaacaaaatgagctagtagggtagctgtaggtggtggtgccccttgtgaggtggtgagaagccaaagatatgagcacagactatctacataatgtctagttctaaatatacacttagtgaaaatgatttccatgaagcaattctttcaactaacatttgggaatctatcatgtgtgcaccaggtgctaccaaaaatgcagggataactaaagtccttgctttatgtatgaaaggaaatgtttaagagtatggctccttgtctcaagtagcttagtgtcttgtagagagaggactgatttcctggctgggcatggtggctcacgcctgtaatcctagcactttgggaggctgaggtgggtgaattacctgagatcaagaatttgaaaccagcctggccaacatggtgaaacttcatctctactaaaaatacaaaaattagccgggcatggtagcaggtacctgtaattacagctactcagaaggctgaggcaggagaatcgcttgaacccaagagacgggggttgttgtgagttgagattgagccattgcactccagcctgggcaacagagcaaaaactctgtcttaaaaaaaaaaaaaaaaaccaacatggcacatgtatacatatgtaacaaacctgcacgttgtgcacatgtaccctaaaacttaaagtataataaaaaaaaaaccagacagatgactgatttcctcatgcacaaaaacagaaaaactaaacaaaaaacaagctcggactttataatttataagcagccagccaagactaaaaatctgtgattctacaataatctatacctatatatttcagtagtgcatagaagtcaaaatttggatttatctacagttaaattctgtattgatgcactatacatacactatgaaaccactactatagtcgtgtttctgaataaatccactagcaagtattcactgattgactgctggggataaagaaggaaaataagaaagatatgaactaactgaggataaaggccacagacaaaaaatacaatgcagcatgtcatggtaagaaccatacaaaaaacatagtttatagttggggaaccagacatagccactatggtcaataaagactcctggcagaaatggggttggaactttaccttgaaggatgacaaattagagaaacgacatgtgctaaaattgaataaacaatattcaaatcatccttcattgtccccagatcattttatggaaaatatatttaaaatcccaaaagcattagataattcacattatacataggtaggtaaaggtgaattttaaaaaataaaaactactggaaacttcacaaatacaacatttcaatctcttttattctctatatttatatccaccaaatctgtattcccctttatataaaataacatcatccaaaattaaagtggcctttgccataatggaaatactataggaaagctagtgcttaacacagtgctaattcaaaaaagcaaatgagctctcctcaggtgtatgagaaaaggcttctgtgaacactctaggacattataaagctttcagatgtgttatggagccttaggctaatccagtgttttccaaaggagagtttttggtcaacttacactcaatacctggggtgctaaaatgccaacatagattatctcaagaagcagccctggaatctgtgctttatcaaaccaaggtttgaaactacagagctaaaccatcaattcccaaaggaaactatagacaagcaaaacatttaaatggattaaggagaatttgagttcttttgaattctacttataattacttttccttttgctgactacacacaatcaaatcaggcaaatctagcaagaatccacagtagatttacctagctgaactgtgtaatacttagacatgaaagctgagtactacgttgtaatacatctttcaggatttaacaaaacattcaactaagcagtaagtcacctgggcttaccaggtattgaatttctgtgcacactggggaaggtctggacctcaaatccaatcctgcagttgaagacaactgaaagtaaacattctggtacaccattgaaaaactggaatgcataaagcattctgatcagtattcttggtctttctttataagaaaggctgaaaatgtctccttctttttgagactttttgtttctttcctaatgaagtccttcacctggatgatcccccttatcaactgcgcttctctttctttttcttatcattttgaatgaatgctggctagaggacaaacaagaactgtgagacatgttccacaaaggtagtgccaactgaattagttggaattgtaaattacaaggaagaaagtagtactcaatctgttggattttggcatgtatcttagcacagcattcaaagaccttcatcttgaactctgtcaatccatcatatgctatcttccctgtcctactgagaatagatattgagggcataaagacagcagtacccttatttggatggagttagggataggatgaacagccatggtgaatgtgtcctgcaactgacctggcctaggtgacctgcatgggtcatgcatgtccactggccatctgttctcaacagaaatgggatatgactcagcctttgatgtgagagaaagtgtaataagcaggtatctctgcttccagctttccacctggaatccctcctcttcaagagttctgatccctttgtaataagtgtcccctcttatttcagacttgctactcttgccatctcacttgatttcaatcatttttattgtagttaacgaactctgccattaaggcaaaatctctcctggaggttggatggcttaactgttagaaacaagagctctgcctgcagtctgacagaagcatattcaaagtcccatgactttgagcaagccacttacctgtgccttcactggctttagtttttccatctataaaagagggttgacaataatatgtgtctggctcacaattgccatgaggagtgaatgaactaatgtctaaaaggcacatgcttggcacagagtaggcattttgtgctactctgtagttacttaatctgtttgattttgaattttgtttgattttcgtattttagcacagcattcaaagaccttcgtcttgaactctatcaatccatcataagctatcttccctgtcctactgagaacagatattgaaggcataaagaaatcagtaccattatttggatggagttagggataagataaacaaccatggtgcatgtgtcctgcaattgacctagtctaggtgacctactgcactatgacaaaaaaaaaaaaaagacttagaaagtcagaaagactttgttaagtcttttatgatgtagagcatttgtatcctcttatatatttttttccaaagtcagaaaaactttgccaagtctttccgtttttattgtagggcatttttatccttgtgtatattttctggtttgtgtgtttgtttgtttctttgttttgagacagagtctctctctgttgcccaagctggagtgcagtggcgtgatcttggctcaccacaacctccatctcccaagttcaagcaattctcctgcctcagcctcccgagtagctgggattacaggcacccaccaccacgcctggctaatttttgtattttagtagagatgaggtttcaccatgttggccagagtggtctctaactcctgacatcaggtgatccgcccacctcggcctcccaaagtgctgggattacaggtgtgagccactgtgccaggcctgtattttctgttttattgtcctacttaacttcatgcatttaattttggtgacccaaatgtttccatgcatttccagacatgggataaattaagtcacagttatattaataataaaagtctactggctttatatcagcctctgcatagctgcaataccttgccactccctcacaatctctcccagctgcttctgggagtcccaaaaagtatctcacctgtgctcaggagcatatctgatgatgtgcttcttctacctgcccactacctgccctcccccttgaggatgcagccttgccacagactttgctgctgccttttgtgagaaccagtatgactctctcacactcagaggtgcaggacccacaaggtgcacttggtgtaagatcccttcaggtctcattgtgccagagaagccacatcaggttccacattaaagttgcaaggacaatgccctgtccccagctctaaactgcaagttgtcaccaagaccccaagtaacacagcctaaagcctgaaccatgagttctactatagagcaaagcagctacatgagctaatgactgaatattttgcaataactccctgcttctggccttagtcttctgcagattgttctccaaagagctgccaatttggctgtgttaaagctttagccaggctatttcattgtacttaaaactctctaataactgcctaccttgcttggaatagataccgaagtccttacgttgatctacaaagtcttgcgtgatctggcccctgctacctctctgatctggctcctagttctctcccattcacaccacatcagctctgtagtttccaggcacacactgctcagctcctgtttcaaggccttggcatttgctgcacccctgaatgtggggacaaggagaacagagggcaaattataaaagaccttgatgctttactaaatgtttgaagtttattccacaaatttcatataagtaaacctgtacttacctgtacataagagagaattggaatgcaatacaacctagtggtctgatgcaaattttttggagtcagatagagatagggtctccagatttagcaaataaaatacaggacactcagttaaagttgcatttcagataaatagtaaatgattttctaatataatcatgtcccaaatactacatgaaatgtaccaaaaagtgttatttaatttgaaattcaaattcaactgggtttcctgtattttatctggcacccctacatagaaatggaattgaatactggccttgaacaaactatttaacttctttcagccttggtatgaaaatagagtaataatacccacctcatggggcttttgtaacgattaaaaaatataatgcatggactgcacttagcaaagtcactggcacaaagtaaacaagtaaattgccgctgttatcattattgctattgttatgatcatctcattttgccagtgaagctttcaataaaacattacattcctagcaacataatcttcatatgaaactttgtatttttaaaaaccctggattatccaaatttgttaaaaaagcacttcttatttgataagaaagacttcaggaaacaaatgtaatattctgagaagaattatgatttgatttcagtttgttaaatttttatttgattgtatagctctcagcacattcaattcaaaacaatttatttttaaattccattcttatggctttcttttttttaataaagataacactaacagtatcctgtgatgatatagggcttttgcttcagtttttgctatagatttgttctctgactcatgtgatctggccatgaatttagtaacagatggtaacttgtggttttatgaaaaccgagtatgtgagaagccttacatatcacattttctttagtcacccagacacttattcattaaaataacaaccgaaagaatttttaattaaataatggaaactcagtaatgtgccagatattgttggttgcttaagattcaaagaataagacctactggtttctggtttcacagagctctcactgggtagaagagaagatgttgcaaccagaacaaataagtaaaacagtatgataggtaaaaatgtcacataagtcatacaatcgggtgtaggaagtgagatgatagagcagacttcacaaagtctgtgtaacattgtagttggttcttgaagaatgaaaaaatgtatgcaaagtaaaaaagaattagatggcattccgcatggaaagaacagtatatacaaggaagaaaggtatgaaagaattggggaagttgccagtttagtttggctaaagcagtggaactcagaggatggcccagaaccagcagcatcatatcatgtggagtatttgttagaaatgcagattctcaggctctaacccaggcttactggatcagaaactctggggcggaccccagtcctctatgttttaacacgcattctaggtgattgtggtgcctactgaagttcgagaaccctgaagtacaacagtagagttttcaaaactgagtgcacatgacatcactgagggtgcatctttcataaacaccaatgacaggggccacaagccataaaaattaaatcagagtttcagaaggtggagcccagaccaaaagtctaaagatgttttactgtgcagccaaggctgagaaccactgggatagagcacatggtacatgaagaagaaagggcaaatagacacttcacaaaagaggtaaacacatgaaaactcactcaaaatcatcagtcttcaagaaagtacaaattaaaaccacaataaggtaacactgcacaccctcactcagactgaccaaaattggctgctataactaaatgctggcaaggaagtggagcactagtgtatcattgcaattaaacagacagaggttgcctgaagggtaagggtgagggtcagggattgactttcctgaaatgtcattccgtacctgatcctggtgaacacccacttttatttcactactcggttttatctggaaaccttcctgaaatttcaagttactcaggcacatcctccacaactcctgcaaacctctgttaggacacttccttcagtgctgctaccactttttaaaatgcctttctcttcaactagatttaaaaccgtttgagccagggtgttcttttttctttgtggatccctcacgcatagcacagtatctagcatttgtatggggatggatgagtgagtagactgagggatgttgggttacctgatgattttgacacaccgtgtcatgactccatgcatttacatatgctgttccctctgcctggaataacccattctaccttttattttgtctgtctggcaaaaacatctcctctcttaaagatcatcattctgtgtcacccattccataaatctgtcccccaacaaggacacatccatttggatttgcttctttctttaggccatgctttgtacatagctcctcacacttaacttactatattgtaattaatgattttccttctttctggatcactgatttgtacatttctcgggggttatttcactttgtatttttcctcagtgtagtgcttagcatatgttaatgttcataaatatctgttaaagaaagagagaggaaaatgtcctcagactacctcaaacatattatgagcattttaagtgcatttttattgtctgtcataatcagattgtgttctaagtattacttttgtgtgcatcccctctgtgattttgaggattattatacaaagaatggaagcaaacagttttcattatagcttaatcactaggtcattcaggcagcagcctgagtcttgaaggcactgaggaggaacaacagaaggaggcttaaaaccaacacatcaaagtcaacacagcagtattgactctatcgtgttggttttcagtggttctgaaatattgtctcccacgagtgatagaaatgcaaatttgaagtaacctgaatttagttagcaaagctagaatgctgacttataaaacaaaccagaaaataagacttcctctcactcctgatctacaatttttaaagccaaaagaaaagagtcacaagttcataagaaagtaaatttcagaggattccaaactaaagtatgcccagataagtaagatagatgctgtgatttcaactgcagctatcagtgcagctatcaaacaacgtgatcattaaaaaacaagctttagttctaaggatttttgagatgttaagagtattgtggtagatacacaattttcaaacagcctctcatgatgttaaaagccaaataacaaatctagagtataaatattttcaccatttctgagtttctatacagaggataacacagggggaagagaacagaaagattctggagtcctttggaaatgagaagcagcttaaaaataagctttaaatatacaaaaataggaaaaaatagttacttttctaaaaatgctataatgtgttagaggaaaatggagaaatctaaagtcttaattctgtgagatttcaaaaagctaattatgaaagtagttagaaaaacaaaacaattctgccaacaaaaagacctctcccggctgggtgcggtggctcacgtctgtaattccaacactttggaaggccgaggcaggcagatcacctgaggttgggagttcaagaccagcctgaccaacatggagaaaccctgtctctatgaaaaatagaaaaaaattagccaatcatggtggcacatgcctgtaattccagctacctgggaggttgaggcaggagaatggcttgaacccgggaggcagaggttgtggtgagccaagattgcaccactgtactccagcctgggcaacaagagcgaaagtttgtcttaaaaaaaaaaaaattctccctatcaatatagtaggaaaacaaaattttttaattgcataagcagtaacaaatttacaagcatgtaaggtagcaccaaagtgaccacaatgttagtgtcatagcaaaaatagcaatggatgaagttaaaaaagcaaggaagatttaagactgtttcaacagaaatcaagactattgtagtaagagagagattgaactcagctctgctgaaacaggcaggagagattttaagcactggggtaactagtggaaaagtactggaggatggtagaggaaggtgggtcagtgtaattaggccatctgtgtttgctaattgctgcttatctaagttaggtttacacctcccacagagactgagagatagaggttgcttcttacttaatgattacagttcaaaggaatgattccaggtccttaagaaatatattcctgggtttatacaactggcaagaagctgggggaagatttatatctccaaggggcagaggaaaaatttacaaatacaatttttctaaagtaaatgctctaagaaaagggaggtcaggagcctatagtcaggaaaaactccgtctaaagttttgtcaagccctcttggtcatcaggacaaaatctcacacattttatttggccaaacagaagaaaggacaattatttcctcaaaagacaaaaaatcgtacctcatgacagttttctgaacaactcttaagagatctcagaggtaattccagagctacatttttacatttgtcaagtaaaaaacaaatcaagacttagtaatgagagacttatttgaaagggctattgcaaggcgggagagggactactgcaatagggagaatgctttggccatgagatccgcaagcatctcaagtactaggcaagaagggtttttcttttatgagaggagtaaacaagattagaaagaacccagggtggagaagtgggatgaaagactggcatactaagtaaatatatcagaggatgttttaccctgaagccagcatattttccaggagggcccttaaagaggggatggatcctggctcaggctgaggatggactgaagtttggggtcctgggagaaggagagactcttatttgattaataagcattttgttctcattgaccaatggagacaaaatagttcagttagtcatgaatgagggcaagagtgggaatttggaggatctatgtctggccttagcataggtaaataagcaggtgtgagtcttatctaaatcaactggagaagggtggttctttgcaataagccatttcccagaacaaagggtttcttaactatcttaatgaggctcacataaaattcaacatcatcacatatccagaggttatttgactcacaatcttggagatgtgttaggccatcctcacattgctataaagaaatacctaagactcggtaacttacaaagaaaagaggtgtaactggctcacagttctgcaggctgtacagggagcatgatgctggcatctcctcagcttccgaggaggccccggaagtataatcatggcagaagatgcagcaggagtaggcaggtcacatgaccagagcaggagcaagagagaaagctaggtgccacacactttcaaacagacagatctcacaagaagtcactcaccattgtgagaacagcaccaagaggatggtgctaaaccattcatgagaaatcctccctcatgatccaatcatctcccaccagatcccacctccattactggggattacaattcaacatgagatttggacggggaacacatattcaagctatatcatatgtctacactgtaatcattggagaatgggcttaatccctaataaaatttattttgatgtcaaaggtaggaggaaggacacagattcaccaggcctccaaatagacactctaaaaatggggaaacgggaagtcagtgtctttgccttttataatggagaaaatcgtttccatttgcccttacaaagtgcagatatacatttatcgattcagttatttgggtttcaggttcagatggacaagccaaatcactgagtctctgaggctcacttccatatctgttaaaggaagtttttttgggttattgaaaagattaaataggatcatgtttatgaaaatccctgctatgggattttgtatgtcaaacttaatattttcctcaagtaacaaaatttagtggacatgccaattataggaagttttagtaacattgaaagaaaaaaattaaaatgatttggtggctcatgcctgtaatccaatactttgggagtccaaagtaggaggatcacttgggcctaggagtttgagaccagcctgggcaacacagtgagactcttattttttttaacgacttggttatggtgtttatgcataccccttgtaacttttatgtcttaaaagtctagaatattttattagtaatcttgtatctcacatcaagacactcttttgaggaattctctgttgagctggggtatagtgtaacaccaaatcatttgaaattgctgagaaaagttgcagtgatctcaaatttgaaagaagttattttcatttatatgggaatactaagaagaaaggaactaatcaagataaaacagttgatacataattatcttatttaaagagaagggtttgtcattatttagccatacaaaatctgaccacaaattctagatctttgtattttggtcttttgaatcccaccccatccccaaccctaaccttcaccctttggtaccttagtctcctcacattgccctaaacacagagagacagactagaccactcacaggcaggtgactgaacacacacacatatgagggagttctatgggggagaagtggcatcttctgcctgcccaggaggtaactcccattgttctataaggatgagtaagatgctacatactaatatcagtaacatagggttcttaaatagccttgcacgtagtttgcccagaatgcctatttttgtgtagggtgggccaaacccgtattatagttctatgatgccaagccaaatttattaaatcaataaactcttctaagattctgagaggcaaacaagtctttcccgtcttgtaaattattcccaaattccaaagggcaaaagctattggaaaaatcatcttagtgacattaagagttttatgcaacagaataataattagtctagatatgtgttttgcccttaatgccatttttattcactcagccagcaaatacttattaaatgattactgtactcaggcaccattgtaagggctgagtaaaaggaagtgaataagaaagaaaaaaacctcttttggggagaaagggttgcaggcaggccgcttcattctcaaatcgcagattatattctaaaacatatccaagattcacattctaaaatatactattcaacctgaacacattctataaaactaatacagtggagtatgactggagtattaaattcatttttacttcagtgcccattgttacgcctcattgttatttaaattcagacttgtccattaaaaggtctatttgtaattcactgaaaaaaatagatgatatgatagatattgtaaatagaggacttatcaagataaggtagaaatatgagcacaaggtaaattttgttaaccatcgctaattgacctgtgctttctaaatttctaggtttaaggaaactagtattaaaacaatgtgatttttaatgccaatatttacacaatttttgtaagaggtaaaatgtaatttgagcaaataatgtaaatataagagaaccaaaagaattttatttctataagaaaataatttcaaaatatgtgaacacatgcttatgagtatgcttaaccaaacctattacatatattcaaaactatttccattttctgttagccactcatgagaaagaaatagttcacgggttgtctagtgattgtagagttgcttcatttgacttttaaagtatcattttaactagaattacctccagtttatgggaaaatgtaaagactctacaaattgcattggttaaaagtaatcctaaaaaatggcactgtaaccatggaaatatcatttagactcataaaattttaaccacactttttttttattccctttctggtttctatgttgcctctgttcactgtggcatgttaggtgcatattccacccaattttcttatgacttaactgtttagtttttaaatgggagaattgtctgccagtgaagagagactgaatggaagaacacttaacatgagatctaccatctttaaaacattttaagggtacgatacagtattgttgactatgcaatgttgtacagcagatctctagaatttattcatcttgcttaactgaaactttatgcccacttattagcaacaccttcatttctctctgccccctggtaactaccatttcactctttgattctacaaatttgactattttagatacctcatataagtgaaatcacacagtatttgtcttactgtcactcagcataatctcctcaaggttcatccatgttgttacacattacagattttccttcttttttaaggctaaataatatttccttgaatgtatataccacactttacaaaatccatccgtcagtggacatttaggttatttccacatcttggtgattttgaatagtgctgtaatgagtgtaagagtacacataactctttgagatcctaatttcaatttctttggataaacacacagtagtgggattgctgggtcatctgatagttccctttttatttggggagagggggacctccatactgttttccagagtggctgcattatattgcattcccaccaacagtgtgcaagcattccaatttctccacttatctttgtattctaagaatacacataaaagtaattctctttatcctattaaacaatgaatttttggattcctgacacaacaatgttctattccttgaattttctggcactaccattatatgaatactattttttttttttttgagacagagtcttgctctgtcgcccaggatggagtgcaatggtgcaatctcagctcactgcaacctctgcctcccgggttcaagcaattatgcatactattttttttaattatcctcatttctttcttccagagctacatgatagtaatactcctgtttcctacaatctataagaacactggaacctttagttgtgtgtttttttacattccaaacctaaaatgttttgaatacgtaaaatattctacacagaaataccagaagctatttatttcttagaaacatccagcaattcattgaagtaaagtgttaaagtgtatacatattacacaagccaattcccctacattgtatttattgaatagattaatagacttttctgggaaaaggtaattaactgtaaatgctgacctctcactgccttttccagaggttgttgaacttctgtggcctaagtattttatctgccaaatagctagaaattcttttcaagtttattttttaatgctccaaatacaaatataattgattcatttcccagtgtttcacaggcacaggactttaatgatttttttctagctattttttaaaatattgagtatgatgagctgtaaaaactctaaaaacagaataaaaataaatgaatagacaaaagacaatgttcatttgataaataccagggcaagaaatttgtacttgaacaagctaagaaagtcattaacagcagtatttctggaaactaatggtatacctgctcaagctacactgaatctaataatctgtgacaaaagaaatggcaacaggtatgaacacatttcatttaatctgaaattgaaagaaaagaaagtggggcacttttcttccccaacttttttcatacctcaacagacaaaatcacaatggaaaagagatttattgccaaaatgttgctgaccttttacaattcttgccccatattctggaagttaattgattaaaaaaaaaaaaagtacattttcatggactggcacaaagattttatccagatagcattcaagttgcaaagaggcatcctctagctcagtcccttgcatggtgcacctttgtcacccaccagccaggactgtgcccagctggttctcccctcattaagtctctcaccggcacaaccatgctgcactatcagccttgccctgcctaaggatcttcccttctaaaccttcgctgtctttagaatgtctctgaatatggaaaatcacaagctccggggttgcctgctccaggatagcctgagatgaaatgaaagttcaggcctttggaaagctggtaagaattcttttcacctggaatctgataagtatcccggaaaccttatgcatatttgatattttctgccttgccacagttttaggaatacattttaataatattaagtaacatttcctaaaagtaaaccttcctagcctgtagtctactggaaataatacctacccctgctatttaaagctgtgtgaattgaacaagttctggaatcactttgggccttagttgtttcaaaaatgtggaaaacagcttatctttaaaaaggcagaaatctgagaaaataagatatagcgtcacacacacacacacacacacacacacacacacacacacacagtgaaaaactgagaggatttttattttattccaagtcaggaagaaacggaaagaaaacaatactgtttccattttcactaccttccaggaacaatgctgagttttttatatatgtcttgtcattactgcctaaaataacttcgaggagtagctatttcacaaataactgattttagaaagattaagtaacttccccaagctcacactgctcataagaggcagaatcaacctgcagtcagggtccgtaagattctaacacccttagatattttcattgtattagggtttccacaaattttattaattttgatatgtatagtacccttttggtttgtgccaaatctatgcatcagtggtactattttttacttacttattaaattacctcattatttaaaataaatgtatcttttacactaaactttagttcactctaataaatgaaaaaccaagcatctcttttcataagttggagaaatatttaaaataaatataatgaaaggacaaaatttaaaaaaaaaccttgatatttgtgaccaaaaaaccctgtgttcctgctgtcctctcctgtttctctctcaatctctctttctcccattaaaaagaatagacagtactagagaaatgttaagactgacacaaacataaactttctcattaatgcaatccaaagaactggaagagcagtgttctcactacatgagtcaatgtttatattttattgtatattgataaattataattgcatatatttaaggggtacaaagtgatgttatagtgtatgtacacatatgtagaatgattaaataaagctaattaacatattcatcaccccaaatacttatcaatttttgtgatgagaacatttgaaatttactatcttagcaatttcgaaatatacattgcactgttattaactatagtcaccatactgtgcaatagatctcaaaaaacttactcctcctctctaactgaaatcttgtactctttgacagacatctccacatttccctcacctccctgtttctcgtaaccaccattctactctctgcttcctacctctgttttagattccacatagaagtgagaacatgcagtatttgtctttctgtgcctggcttatttcatttaacgtaatgtcctccaggcttatccatggtgttataaaagccagtccttccttcttttcttaaggctgaatagtattccattgtgtatatatgccacattttctttatccattcacccattgttagaaactcaggtagatgctacagcttgactattgtgaataatgccacaataaatatgagaatgcagatatcctttcactatgagtcaatatttttaatgaatcttcccatataacaatatattgggcagccctagcagtttgtgcatctccccaaaacccccgggaaatgcagagctcaatcctgctgatctgcatttcgtgcttgacaagttgatgtcactgaatgatattctgactggatgtcaccctccagcacttttttttttttttgcgcaactttctacttgaagttggaagaaactctgcatgcagatcgacttgttatatcacattggaaaagtaccccacattttacagagtttgatacctcacaattgttaaaagtgagacagcatttccatgccatgtattccaaatccctgaggatctcagcaggcagatggccctctaggtcactagccactgctgacaacatggatgccctcacctgggctctgtctgtgacatgtctaatgatttccatcaaaataggatattgccttctcaaatgtcctcatttttaacaaggaaagcttatgacacacacaatgaaaagaacacttaaagtcataaatactgtatacacatttgtttctatagagcaagttgattgtagagaagctgccaggctagtgcccaaatgttcctgagatagttcaataaatatctctttacaagcctgttattgcctttcaaaggatgtaaggtctcaacattcctaattaataccataggttttgtccaaagggaataggaagaaattaacacaaaaatactgaaatagatacaaataattttgaataaaccttctatttatataacacagaactggttgagcattagctgctaaatataatagtattactatttgggtaacaatgatgttgagagcttaggcatgatctaaattgctgtaaataggagagagtgtatgacacacaatggtaagaaataaaggctgtatgaacaaagcactgggttagttacagccaaatatgaagacttacgtgacttgagcaaatgacttacctctctgtgcctcagttttttaatctataatatgagtataaggatggcacttccctcatggtgctggtgtgaatattaaatggaaaaaaatatttaaagtacttaaaagggggcttgacatatagtaagccctcagtgcatgtaagtttttaactaaataagttaagcctcaaagtcttactgccaaggaaaaagcagtgacaaaactatttaaagaacccaggtatattaaggagaaaatttcagtttggtgttctctaacaattaactaacaggtcctcatctcccactttaacctaaagaatcagacactcatactttgtttcaaacaatagctaattagattttaataacaaatgaggttcagaaaaggatggacagaggaagaggctgtgtcacagtagagaggcatccagggtatgccagttataacatgcccccttagcacacctacacaatgctttggatcaagagaaaaacatttttcatgacacttgcaattacaatcaaacatgaagcaggatggtgtatgaatttccatatgtacattctaaacatggcatggttctatttgtactgccaccatggaaaaattagatatttttttcaaatgaaaactggaaatgaagaaaaagatgtcagagaaagatctacttcttctactctgttagtcatactatcaaagtcttgggctataagatgttaaatgcttaaaatacatgatctaatatcaacaggggtacctaaaatacagacagtcacataaacatttcataattaattacgctgataggtgtcatatgttattatgtctaaatgagacagctttcaaatctcaaaacaaaaaatctgttaccatcaatgatgatgttaagggctaaaaagtttataaagtaaaaatatatataagagataagtatgaattctacataaaaatcaattacatctaaaaagcacttgaaaatgctctttatataatcatgtgcatagcttctcacctcagtactgattgcacttcagtcctctgaaacttacctgtgtgccagagaatcaatctttgttcctgtaaaatataaaatatcatctgtttttttaaatcatttacctttgctataggaaaaataatattaataatataaatttaaatcacctgaaattgtatatttatatgaaaactaataactttgagataaggcccaattattctaaaactttacccagaattttaaatgatttcaaaatttaagatatatttcattttctgatattcatgggcatgtttgatctccattatttactgatactaagcaacaaatagatttttctttgagttgtttctatcaacttaaagagagtaactatatctggaagtattgatatattagattgaaaaatttagccaaaaagaatgacgtgagcaagatggcagaataggaaatctgaggcttaatttccttttctccccaccagaaagttcaactagcaactatccattgcagaataggaaatctgaggcttaatttccttctctccccacaagaaagttcaactagcaactatccattgactagaatatgcttttgaaagattcagccatatcactaattttttattcctatgcaagatatggtattttctatataagtaataaaactggttatatcttttcataacccaaacagatccaatccatgagtcaattacattgaaatattcaatggctatttgctattattaatactttataagtatgcagctattgatagagcatagagataagaagatttggtgaaaaatatactgatatcttctattgtattctcacaacacagaacacttctatgaccaaatgtggtggtagaggggtttccccacaaagcaagctattctccagtggataccaactgggtgtcctatagttgattcagttcacagtatctatctggagatagcatccgaacccacaggttaaggactcagtcccacaagaccacccttcccactcccccatttcatgtaccagtgcaagtcccagctttttacctgtgctctgccctactggctataaatcaaggttcccatgtaccccctccttgtgttcaatatttttctaggatggctcacagaactcagggaaacacttcacttatatttactggtttattatgtaacaaaattataaacaatacagatgaacagccagataaagagatacataaggtaaggtctggaagggttttgagcacaggagcttctgtcccagtcagttggtatgcaccctcctcctggcgtgtggctattttcaccaagtgagaacctcattaaatttcatgttcaagagttttatagcacttaagctccagcacctctcactttccttgaggtcagtgggtggggctgaaagttcaaaccctctagtcattcagtctttctggagaccaacactatcttgagactatctaggggccttgccctaagtcacctcatcatcataaactcaagtgagagcaaagggcttgttatgaataacaaaagacactgctatcacttaagaaattacaagaactccagaagctctgtacaaaaaccaaatattataatgaaagatgctcctatcacccttatcatttaggaaattaaaagggttttaggagctctgtgctaggaaccagagactaagaccaaaaatatatattccttattatgtagaagaaaaaaatacagaaatccagtttcaaaaaagcattgttcatcacccccttaaaaaggtcaataatgtttatttaaagtttattaaagttatgtgcacatatgcaagtaaatattcacaattcttctttgtgacccagaagctaattccctgtgctctttcacttgctgatattgttagcagaagaggatctccaaaacagtgcaaaagatgcttgccgccattggcttcctaacgctcatttgccaaaactctgctaatcaaaatagttcccagtgcccaaagtaaatctaaaagtaactcccaccaaggacccacgtttttagaggaaggtttgttgggaacatgtcattgccaaccttcacacaaggggaatcaatattctgtcatgttgatttcaaatcaagtatttatttaatgtgaccctcaggtaagtgcagaaatatgtgattgtgtgctggatttatttgatcaccttcagtaagaccctggtcaagtgactttctttctttgtgtctcaggattctcttcattaaaatgagcatttgtgaaatacagtataaatgatttagttttggatgtacagtgcagacccaggatggatggatggatggatggatggatggatggatggatggatggatggataggtaggtagatagatagatagatagatagatagatagatagatagatagatagatacacatatacactaagtaacaccacaccttgtttgctcagcaagtaatgccaggtgtagatgatacaacagaaagaaagccaggcaaacacagtgcccttcctctttatcaaagttcagtctagtcatcatgagtcttgtggattaccccagtcaaatcccaatgaacagatgatgttagaaccttttgttcaggtctataacatgtggcttattagaggaatctgattataaaggaaaaagcccttccaattaagtttgttttcttatttgggaacagatttgttcacaaaaatctaggagagaattcaacttttactgaattatttcaataatttattgaataaaaatgctctaatgttttatttatcttgatctataccaggataatcatataactgacgatttttctaaattctatattctcatataatgaataaaggaaaacataggtaagtgagttggtatctgaaatctatttcaaaaagtaacctgcagaggatatggcatgatcattcataaaacagattaaacccaatttccaattccttctacatctgttataattctggaaattcttttataaacatgaaatagaaggtactacaagactctgaaattctgagttatccagtattctattatatccagcataatttgagtgttaaaagtgttttggtaatattacaaagctttaagtggttttttttaaattacctatgtttcccaaatatactgatttaaaaaaaaggagggttatgtataggataatagtgtatttttttcaccatactatttcacttactgtcagattaattttatgcaattttaaaaatgaagtcattttattatattgtaatctttgaatgtgtatacagtaaatttaattaaatgaaaattgttaaacaaccgtgacaacctttcccccagctattcagaataattatgagttaactatatgttttcaaagggcttttaaaattattcctgtaaagcaattaattccaaataacatttttgttggctataaaatgatttttaaaatatttctacttgtagtacttgtagtgctaaaattaatcccataaggaactgtggaaagcagtcaaatgtgtaaaatttcaaagttcataatcttagcattagtcagcacttggcttttcgcactagcattaacttaggcaatttagagtactatcctaaaattatcattatcatttctagcattgggagtaaataacgatttttagacactacataattagtatgaaaaatcaaaaatcgatgcatgatcaaacataaattatgtgccaaataaaactactataatctatcaatgcaactagttaaatatgattgtcagtgatcccaaaacactcaaaatacaatcatcattatcttcagaaagtatcagagtacaattggaataaaataagagaaatgttaatgtatgtgtaagagaacatccaagcaatgtgactaaattttttgaataattaaatttttacacattttaaataaaattatgtaactcacgataattttactataaagttaattgttctttttacctaatcaaagtagttttacaacataaaaggtctttttcagagaaatgccaaaagcacgttcttaattaaaatgatttttaattagttcaaaacagaacttaaaaaaaatttagacagaactactacaaatcagggaaaagcaggtagaagtttatggaaaaatcctagtatgtttccactaattccatcccttatctcctactaattatgagggtatgtattttcacataaagattatctgtgctataattagtggtgttcccaggctgcctcactacaacgcttcttcccgcaattggtcagaacagaatatcagagaaagctctagtctgggcagacaggcaaatcattcattctctgatataagaactaataatcaatctgaggatgattcttgcccaagaacctacctcactgatttataatagaaaccaaatgaaaatatacatataaactgtttttataaacttccacccactataagaataagtgtcattatgatgattgtcacccatgcccacaagcttagcccagttccagatcctaaacacccatttccatactctaatgatagagactgcatagtctatctggagggaattaagggagccttagctaggtaactcagctgtctttaatgttgtttctaaaaccaacccacctcccactggagttgctttctgccttactctctcttgccatcttagaagatctcacctgaatttatagctcaaaaccccctgacacttcaatacctctcacattctgcctggctatcttactgatcgtcatactctctagatttttggcttaatattaataaatagttcagtcatttagctgatttagactcaatgtaacaaattcttttctaaccacgattatctacaaatagagcaagctgccttaagagttctgtatcatttgagatagacaagacacagctacatattcattggccatgattactgtaaaagacactgctgctctgtttgcaagattagacaagatcactgtacgatactaatcaccagcttcaccactgaaccactctgattctctgatgcttctggagttacagttctgaagacatcattatggttcctgacatcattacatcttatcaaactaaaaaaattattcctgtagaatccaaaataaatagaatcttattagaaaattatttgtgatttcagttaaatgaaatgtactccagaaacacaaatgatctgtgtgtctagatgttaaaactattactgcactaacatcttcattaaagacagtaggttttgttatttcatacagaaatggaaagataaaaaggctaggaaaatcagccattttctatagtatcatagaatttaagttactgtatatggtatgctaagatgttttattttctttcctaaaactgaagctaaacataaaacaatactatgaaacaatcataaaaggaaaaggaaaaaggaggaacttaatgttaaaataaatttaactttatttaccaaatccacagaaacttttcctataagtattataaagtgactgtcaaacttttgcatcatgttttactttagtttataagattgatttatcttatatcacatatcttgtatcttataaagtacatcttcataattagacatagaaaatgatatcattaactctgaaaaagagggttctttttttttaaatcacatatggtaagtcatatggtttggctgtgtccccacccaaatctcatcttgaatgcccaagtattgtagaagggttctggtgggaggtaattgcgtaatgggggcacatctttcccgtgctgttcttgtgatggtacataagtctcataagatctgatggtgctataggggggagtttccctgcacaggctctctctttttgcctgctgccatccatgtaagatgtgacttcctcctccttgccttctgccatgattgtgaggcttccccagccacgtggaactgtaaatccactaaaccctttttccttataaattacccagtctcaggtatgtctttattagtagcatgaaaacagactaatacagtaagccatgtcccaaaacaaatatccataaagaatatggtagttctaattataatttatgttagtatattgttttcaatttgaaatcaaaagctctttatactgtgtctataaatcaatcttataaactaaagtaaaacatgatgcaaaagtttgacagtcactttataatacttataggaaaagtttctgtggatttggtaaacaaagttaaatttattttaacattaagttcctcctttttccttttccttttatgattgtttcatagtattgttttatgtttagcttcagttttaggaaagaaaataaaacatcttagcataccatatacagtaacttaaattctatgatactatagaaaatggctgattttcctagcctttttatctttccatttctgtatgaaataacaaaacccactgatttgggcatttgtgatccactatgctaaaaagccctgttgtttcttggtcttttttatttcatgactattgtgagtcagatggaaaataggataaagacatgagaattactgagcagaacaatgggtttgagttataaaactgaacagttaggaggggcagggaaataaggacagagaaggtggaatggagacagggaaaaaagcagtgagcatgttcagaagacagtttgccagtgtagtcacaatttaccaagaatcactatagacaatgtcaagggttagcccaatttacattcaagcatttatcctttgtgttacaaacaatttaattattctcttttagttatattaaaatgtgcaggtaaattattattggctgtagtcaccctgttgggaaattacatactagatgtcactcatctaagccttgtttttaaagttaaaatctcagatgattctcccctgtgttttctgattcactgtcctatactctaaatggccatcaactcaggaatagagattattcagcctccaagaactacctaatggagcagtttcctccattggtagttattccaataagttactactcattttggttttcattccattacagttttttgatatgattatttgagcctaaaaatgtaacgtaatttggttcctaagagtttattaacagaagacaagttttaacttatgatgaacagtaggtgctgagaattagtctgtgttacttaaaaatttgaattgaattgtatctcatttagaatgagggatttgtgaaagccaaatatattcacattgtctataaaaagtgtgagtggctgaatgattactcaagaaacatgatccatagtggcaacaagtataattgctgttcataagactttgcttttctataaagtgttatgtgacctgtcttacctacagtttctttcaccttatttgcatttatatatgctccctaaaaatacagatgatgtaaatttctctaagttcttattagttataaatctgaattagaacaaaaataacaagcattcctgctactgaagaagtcataagacttatttaaaagtatgattttctgggcagagtgtaaataaggtggatttattctatatattgctgtactcttttatttcaaatatagtaatgcataaagtttaaaattaaatgtgccttccatgtagattaatactatccatttcatctttgtcaagtagaagtaattgcttggttcaatacaatccagtcccatccgagtagatctctttgttctttttcagaaatgggagagattgagagtttaaaaagcattcatcatcaggagaatttgttttaaaagcttccaagctcccaaacagccagtagataaattacccactattcagagaaagagagcacaattagttttacattatactaaaacaatcagctccataagtgactatgtttcttaagaaaaaagcaatatgaatgtcatagtttgtcctctttctcccaggctttacagccaacagcaagccttttctcatactagaagttttatggaaagctttgtgaatatgttttgacattgtttttagataaggagaaatatattcatgacttgtaaccatgtggttaataatacctacttcacaatgcaaagttaatgagtcttttgttttattcaaatgctttgaagctttatggtaagaaggaagacttcaataaattattttcaaatctacctttctttccccaataattatttttatgtaattatttacaactaagaagcaaaggaaggtgtaagaaaaaattatactgggggtaatgaattatgcacaaaaaatctacaggttgtttttttcatcttaacaaaatacatagttgctaaacagtcattacctcttttgacacatgcaggatggtgtaagaatgtactaaattcatgtcaactgccatgacttaacctggagaaacaccatgactagtaagctttacatacacagctgctacagtatttttagcattttccatttataataagaaagtgatcaatggaggccttagaggaaagagtgcaattgcaatcatataaatagccttatttccttttttgcacacaagtggtatctatcaaaattcaaacattgtaatacctattttcatatatcagtgttcatctatgggttacttttattttattttttaagttattcattctcataatgataattgatcattgttgatatgtgcatgcaggtcatatacaaaacttcctttacaccacacaaaaagtagtctacttatgttgtataataagttcgaacctttgtgccttaagtacaaaactgactcttctcatgcacataaacacaacctggaactgcatgacaaacacatttgaataaagctttcatttttcaaaattcatatatatgtgatcagtgtacagtatgaattgggtaaggagaaagagagggaagagaaaaggaaaaaggcagtgaaggagagaaatagagagaaagagaatatatcaaaatacagtgtcaaaatgtcttattcatgaaagcttctttcctagggatataagtttttaaatgtgtctgactatagaaaagactattaagtgggtatgttttgttttagatcagtttattaaattttttttcatgttagacaggtaatgtgccaatatcataacaagatttgagggaggcacatctcacacatgagtgtgaaaattcaatcatcacattcactgagtctctttcaaccagtagtcttagccaggcatgaaatctggggggctgcaaacctccaaagaaattctcaccacccatttgccacactcagtctttttcataatctttgtatcatggacttcaaagctttaataaataaagtcaagttacctaattctctggctacttataaaaggtcaacatgtcccatcccatctgataccttgatttgcatgtctttgactcttaagacatacacagattttctatctaacccctaagacctttgaagttgatgggataacagtaggtctaatattttttatctaaatataaagacctggaacttgataggattctaagataaatacataattttccccactgattgagtcttgcattattttgtcttcatattcaatttcaatcagttgttcaaccaattgaatttgggctcttacataatgcttcagactcatggttgcaccatgaagtctttcaatgtttctgattttcttcttttgcaaccaagattgtgaaatgcagatcaaagacctgtattggctttttctcctatcccagatgcataaggcttaggacagcactgttcaaagcctcgtagtaggggtatcctatggtcattcttgttaggggcacaacaaagattcacgagtaattgaaatctctttccctagtctagaactttaagtggttcctcctttgacttggacaagagctcaggttgaaaagtaattgctgacctcaggcaataaattagctggattaaaaaaaatcgtaacattccataaatgaaaataattatagatttgcctacaacaaaggacctaagaacctaccatcaaaattatttgtcctaaatatctaattcttcctttattcttcccctgatctaaccttaaaatctaacttacatatcagtatacgcatgctatcaacaataaaacacaaatctctgtattttaaaatttttttttattttctcagtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaacaa

SEQ ID NO: 593 - DNA, 738627 bp, Homo sapiens; identical to SEQ ID NO: 592
